United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 24

SEQ ID NO: 98125 - DNA, 468 bp, Triticum aestivum
  unsure (1)..(468): unsure at all n locations
  Clone ID: PAT_TA_98125
accaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttccacccaacctcaagcagcagcaacaacaaggtcaacaacaancaacagggtctgggttctagccagncacaacaacagtcacaaactggattcaggggttgggnttgcggttattggggacatggggtggntttcaagaccnaaccccgggcnantgttgccgaacgntgcaatggttcccaccantactngcttacacccanc

SEQ ID NO: 98126 - DNA, 451 bp, Triticum aestivum
  unsure (1)..(451): unsure at all n locations
  Clone ID: PAT_TA_98126
aagcgccgtgcccaacaactgcaagagggtgagcgagagggggccagccattcctctcttctctaccacctactcccctctctctcctccccttctctctaggatcgccagccagccagccagcgccagccaatcgcgcacccacagcgcgcgcgcctccccccgagaaagaagaagaagaagcagaagaagcagaggaacagagagggagggagcaatcactggtcgaaaagtgaacaagtgttcttggcctccggtcctctccgcccgccatgtccattgatgaaggctatgggccctacctgggacaagcgacgacgaagtacgacaacttcatacgcaagatgaacccgccaangttatcatcattcgacaaacgattcngtttggtnggacgcgaacgaatttggtcaanggntgggtaggngcnaaccgangtatngggaattnt

SEQ ID NO: 98127 - DNA, 427 bp, Triticum aestivum
  unsure (1)..(427): unsure at all n locations
  Clone ID: PAT_TA_98127
ggggggtgcagctggttcccgagactcactcgagcgacctctccatcagccatggcggcggcggcggcaccgcgtccatcttccccgcccctgaggacatccattgcgctgctcctcctcgccctcgccctctccgcgctcgtgccgtcgtcagatgcgtatgattcgcttgatccggttgggaacattacgatcaagtgggatgtgaagaagtggagggaagatggctacatggccaccgtttcactgtacaactaccagcaagtatcgccacatccaagcgccgggatggaagctcggctgggtgtgggcggggaaggagataatctggaaaatggccgggcggcccaaaccaacggagcagggcgaattggctccaggttcaagagaaggannccgtccgcccgcaattggtnccngggacggt

SEQ ID NO: 98128 - DNA, 445 bp, Triticum aestivum
  unsure (1)..(445): unsure at all n locations
  Clone ID: PAT_TA_98128
gcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccanttctaccacagcaaccaccattttcgcagcaacaacaactagttctaccgcaacaacaccaatttttcacaagcaacaacaacccagtttttacctccacaacaatcaacctttttccacaagcaaccanccagcaccnaacaggcttgggggcaacnaacaaaatcccctg

SEQ ID NO: 98129 - DNA, 166 bp, Triticum aestivum
  unsure (1)..(166): unsure at all n locations
  Clone ID: PAT_TA_98129
gntttttttttttgccgganaaacccagtttattgcatgtcanaancattgtccactggtacaaaacggacagacagctntaagctccacagaaatgtcacaaatnggcaccgatacatggctgacatacattccaangggcaacaatacatcacanaattgtggt

SEQ ID NO: 98130 - DNA, 440 bp, Triticum aestivum
  unsure (1)..(440): unsure at all n locations
  Clone ID: PAT_TA_98130
aatcggggtacttcccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccaagcacaagggcaacaaccagcacaagggcaacaatcaagcacaaagagcaacaggccaggacaaggcgcaacaatcaaggacaatgggcaactngtngtanttaccaaacttctncc

SEQ ID NO: 98131 - DNA, 417 bp, Triticum aestivum
  unsure (1)..(417): unsure at all n locations
  Clone ID: PAT_TA_98131
gcacctgccgccgctgagacggaggaggccaaggagcccgagccagcagctgcggccgagccggaggccgaggcccccaaagagacagaggcgccagccgtggtcgagacagagaccaaggaggccgtggctgaggcagagccagcggcgcccgaggaggtgaaggaggaggccgcgcctcctgccgagccagaagcaccggccgtcgccgaggaggcaccggctgcaccggaggaggcgcccgcggccgcggcagaggagccggccgccgcggtggccagcgtcagcgtggtgaggcgccggcgcgcgcggaggaggaactggccgggtcagcttccaaggngggcggccgtgtgctcctacntggcacggcgtgatgctnagtcaaccagttggagtggagtggattgatacttt

SEQ ID NO: 98132 - DNA, 447 bp, Triticum aestivum
  unsure (1)..(447): unsure at all n locations
  Clone ID: PAT_TA_98132
gacaaggacaacagtcggtacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccaagcacaagggcaacaaccagcacaagggcaacaatcagcacaagagcaacagccaggacaaagcccaacaattaagggacaatgggnaactangtngttactacccaacttctccgcaacaagtnaaggacaangggcaacaangggtactaaacccaactttttccgnnacaaagtn

SEQ ID NO: 98133 - DNA, 427 bp, Triticum aestivum
  unsure (1)..(427): unsure at all n locations
  Clone ID: PAT_TA_98133
agcccccgcccctcctccccctcctccctcgtagtagtctgatctaacggtctcctgacatgtgcagctgctgttagacctccatgatggctgtgtttaggtgtgtggagttagcgatcaggtttaatctttatcgtgcgccgcgcgctcccactggagaggcggtgatcgtgttttgtaacctacatcctcgcccttattttgaaggcccttttgtaacatattcgcgggcgctgcgcggacggagagctcgctgaccggtgtatgtatgtatgtgtgtgtgtgtgtgtgtgttaaccatgtggtggtgccctcgggccggaattcgcgaaggtgtttgagatgtgacccgaactcccctgagttatgagtgtgtgtttctgcggttggggtataaaatgtaaattggnaagtgtgaaaagggcan

SEQ ID NO: 98134 - DNA, 410 bp, Triticum aestivum
  unsure (1)..(410): unsure at all n locations
  Clone ID: PAT_TA_98134
gtgcagggagattgtgacgagcccggagttttgcggaaagctcaccttccccgtctctctgaagcagcctggccctcgagatggnatgattcaatgttttataaagcgagataaatcaaagtctacttatcatctctacttgtgcctgactaatgcggtacttgtggagaatggcaagttcctcttgtctgctaaaaggatccgcaggacaacctgcaccgaatatgttatctcaatggatgctgaaaacatctcangatcaagcagcacctacattgcgnaaactgaggtcaaacttcctcggcacaaacatttcatagnatatgacacgcagcccccctacaatggggcttttagttcctccggttgggaccggngtancccggngattcaactccnangaaaaggtt

SEQ ID NO: 98135 - DNA, 294 bp, Triticum aestivum
  unsure (1)..(294): unsure at all n locations
  Clone ID: PAT_TA_98135
atttgatcgatcttaccgcttccatccattccaccagcgatcagagtgtagactaggctctccacagcagcggcaacgccaccatgcggctgtacgtgtgcgtgctcgaggcccgcgacctcccggcgccgctggacgggggcggcgaaggattttacgcgagggtgaaggtggggaggcagcgggcgcggacgcgggcggtggagctggcgggcccgggcggcgcggcggcgtggaacgangagttcgcgttcgcggtgagggaagaaggtgtccnangtccaantggcgcgg

SEQ ID NO: 98136 - DNA, 409 bp, Triticum aestivum
  unsure (1)..(409): unsure at all n locations
  Clone ID: PAT_TA_98136
ctcagatccgcctccgctccccgagcaagtccacccccaccccccccccctccccaccgcggcgcgcaatnacgcacccggccaccgcccacccggatccagatcngcgcggcggcggcggcgcaggcganggcgaaggcgaagganggagcgatggccggcggcgggggcgncggcggtttgtcggagtcggtgatgcggaaggtgctgctgtcctactgctacgtggtcggtgtggntcttcctcttcttcgccgtcatcgtctanaataangtaaatccttcganccccaaggatgtataacttggnccttccccatctcnnttaactcatnggntgcaacatgaagcttctgnctcctcgttcgcncgntgggggtctcngtccgtcgntccttgcggggtcgtc

SEQ ID NO: 98137 - DNA, 441 bp, Triticum aestivum
  unsure (1)..(441): unsure at all n locations
  Clone ID: PAT_TA_98137
gggcaacaagggcagcaaccaggacaagggcaacaaggtcaacagccaggagaagggcaacaaggtcagcagccaggacaagggcagcaaccaggacaagggcagccagggtactacccaacttctttgcagcagtcaggacaagggcaacagccaggacaatggcaacaaccaggacaaggacaaccagggtactacccaacttcttcgttgcagccagaacaagggcaacaagggtactacccaacttctcagcagcaaccaggacaaggggccgcaaccaggacaatggcaacaatcaggacaaggggcaacaagggtactaccccaacttctccgcagcagtcanggacaaggggccaacagccaagggacaattggcttgcaaccaaggacaattgggctgcaatcaagggtaacttaccttaacnttctccggca

SEQ ID NO: 98138 - DNA, 438 bp, Triticum aestivum
  unsure (1)..(438): unsure at all n locations
  Clone ID: PAT_TA_98138
gttgtttctcaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcaagatccccgagcagtcgcggtgccaagccatccacaatgtcgttcatgctattattctgcatcatcatcaacaacaacaacaacaaccgtcgagccaggtctcctaacaagcaagcctcaaggaacaatttccatcaaggccaaggggtcctttcaagtcatctcaagcaaaaacccacaagggccaangggctctgtccaagcctcaaacaaactggccccagtttccaaggaaaataanggaactttagcggcttcaanacgn

SEQ ID NO: 98139 - DNA, 449 bp, Triticum aestivum
  unsure (1)..(449): unsure at all n locations
  Clone ID: PAT_TA_98139
ctctagccgagcgcagggcttcgagagctggtttcagtatccccaagattgatacatctcgtgtgggttcatccacagttattcgatcacccatagcaattccacctggtcttagtccaactactcttcttgagtcaccggtgtttctctacaatgctatggcacaagccttctccaaccactggcaaactgtttgttgctccagaggctaactcaacaatgccaccaagatagcacgttcagtaacgatgttttctccttccaaccccactctgggccaagcaagctactcaaatatggaaaagggttacaatgtttggccaacaaaancaagtcgtttgtcaaaatattcaatcaagcaagggttcaatcctcantcaaagcntttactggcagccaaaggacaagtgccgacgaaaacaaattttcaaaaccgaaanacgtcctgg

SEQ ID NO: 98140 - DNA, 437 bp, Triticum aestivum
  unsure (1)..(437): unsure at all n locations
  Clone ID: PAT_TA_98140
gaattcttaattcaanaagttatagggaagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccaagtcttgatcgttacaaaggacgatgctatcacatcgagcctgttgctggggaagacagccaatggatctgttatgtagcttaaccattaaacctatttgaagagggttccgttactaacatgtttacttccattgtaggtnacgtatttggtttcnaaagccctncgtgctc

SEQ ID NO: 98141 - DNA, 425 bp, Triticum aestivum
  unsure (1)..(425): unsure at all n locations
  Clone ID: PAT_TA_98141
atcaacagagaagaagaagaagaagaagaagaagaggaagaagaagaagaagaagaagaagaagaagaagaagaagaagaataagaagaagaagatgttcgccgacatgggctttagcttctccgcctactcttcttcgccatcggactactcctactcatactcccctgtcttctcccacccccactcagactactcctccgtcttctctccctcttcctccgctgctctggcacaaccatcatcgctatctctgcctctcctgcatcaacaacatcaagccactgttgttgctgcgcccaacgangtcntcgccgcccgccatgtaccaccacctcgggagacatgggggcaagccatccctgatatcaagagtatgaccttggangcaaaaaggcgacctgttcaaaggctccggggagccn

SEQ ID NO: 98142 - DNA, 432 bp, Triticum aestivum
  unsure (1)..(432): unsure at all n locations
  Clone ID: PAT_TA_98142
ccgaggtgcgacgatgccggcgcgcggagggaggtcgacttcggcgccagccatgtcatgcaggagcggaagagaagggagaagctcaacgagcggttcatcgtcctgcggtccctggtgcccttcgtcaccaagatggacaaggcctcgatcctcggcgacacgatcgagtacgtgaagcaagctgacgaaacgcatccaggaccttgaatcatcgacggtcagggggccggcgatgtcgaaagagaagcgtgcgctgccgacgggcatggaaggggccagcagcagcagcggcagcacccctgtggccacgggacgtgcaggtctccatcatcgagagcnacgcgttgctggagctccggtgccccgacacgcacggcctgctggtgaccatcatgcaanacgctccaggagcaagctccggctcgangt

SEQ ID NO: 98143 - DNA, 396 bp, Triticum aestivum
  unsure (1)..(396): unsure at all n locations
  Clone ID: PAT_TA_98143
agtaaacagtatactgttaacaggatcaatttgcgaaccccgggaaagaaggggattattgcaaaaattggcctggacactgtttccggctgctttgctaatccgtgcaaatacagggatttgagtgcaaaatagcgaaggataaggttccttatccaccatctactttctctcccgagcggttcctcatgggattaaccgccgccggccttgctgtccccgcgagggcttcctcgccggtgnagaggaccgccgccgcgtgccgttggtggcctcgggtgctaccacgccacgcgaggtctgtggtctagggcacggccgccacgcctatgtgacaagttccgccgggaggcgtcgccncggaaacggncgaggcgcgggtggccataggcttnn

SEQ ID NO: 98144 - DNA, 417 bp, Triticum aestivum
  unsure (1)..(417): unsure at all n locations
  Clone ID: PAT_TA_98144
gccgcctcctctcggttccttctccttcctcggagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaaagttcgagaccancaagtactactgcaccgtcattgatgctccctggtcaacgttgacttcatcaaagaaaaatgattactggtacctcccaagctggactggtgctgtgctcaacaattgactccancactgggggttttgag

SEQ ID NO: 98145 - DNA, 463 bp, Triticum aestivum
  unsure (1)..(463): unsure at all n locations
  Clone ID: PAT_TA_98145
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcaacaaggttgggttcatcttccgtggagcacaacgcatctccctgggtactaacgaatgggccgggtatttgggacaaattgtgggaagcctgcctatgtttcgggggtgcactggacnnccaacaacaagggtgattnaacgaaggtggggg

SEQ ID NO: 98146 - DNA, 406 bp, Triticum aestivum
  unsure (1)..(406): unsure at all n locations
  Clone ID: PAT_TA_98146
cccccgctctctctttctcgtcacacacgttcccctcccccttgacatccacaccaactgcgctagaaccgccccacagttgagtggtggatgatgcgttgagataaccgcgtgggctactaatgtgtttccatccagatctggaatcctaggtgcgggcgaccagtcgcatccagatctggaatcctaggtgcgggcgaccagtcacatccagatctggagtcaccgcggtcgaaggcgtccgttttccccagatctggagcanacatgatgattggcgatggacgaaagcagcatactgaatccgatggnctcgtcttaccacgactggcatcggagaatgtagttgttgcctccacttcgtcctccgctgtcancaccaaagaagaatttggngctgatatca

SEQ ID NO: 98147 - DNA, 450 bp, Triticum aestivum
  unsure (1)..(450): unsure at all n locations
  Clone ID: PAT_TA_98147
ccacagagtcacacaagcactagcttcagctagccagcctcagccactccgggcattttcttgcatccacgacggcaatggccaccgctgatgtccagaacccgacggccgcgctgacggaggaggcgcccgcggtggagacgccggtggccgccgaggaggccccgaagacggaggaggtccccgcgccggcggaggccgaggtcgaggngtcttgcccccgtcgaggttgaggcgaccaagggaggaaggcggccgggcgcccgctgagacggagggaggccaaaggagaccgagccaagcaagcttgcggccgagccggaggccgaggcgcccaaagagccaagaggcgccangccgtgggtcgagacaagagaccaaagggagggccttggnaanaaggccgaagcccgggcggttggtccaaggangtgnaagggaggaagnccn

SEQ ID NO: 98148 - DNA, 398 bp, Triticum aestivum
  unsure (1)..(398): unsure at all n locations
  Clone ID: PAT_TA_98148
ccaagacgtcgcgccgcctcctcccccaagatgncgcgtcgcctgactcgacgacggcgatctcctcangcctactggtgtttctnaccnntgcctgncgctcngntgcttgttggggtgcacgaattacctccgtattgggatccaagttgtcacgcctaatttccgttctcaagcaccagaangaagcaaacaataaaacnaagctggaggggaaaactttctctcaagattcctcaaaagatagattatcaatgacnaccaaaaaggatggggtattatcttggtnttgcggaaantttntancttgatnnttggagctnattnccaannaaaggaaccntgggggttgnggggtaaaaaatttgnccggaaaaantttttnttttggggnttgt

SEQ ID NO: 98149 - DNA, 441 bp, Triticum aestivum
  unsure (1)..(441): unsure at all n locations
  Clone ID: PAT_TA_98149
gcacccggcagtgggatgcttcgtgacgcactgcgggtggaactcggcgctggagagcatcgcgtgcggcgtgcctgtcgcggccgtgccgcagtggacggaccanaccgacggtggcgtggctggtggaggagtgcgcgggcgtcggggttcgcgcgcaggcggacggcgaggcggtggcggagcgaggcgagctccaaaggtgcgtggagacggtcatgggcgacggcgaagcagcagtggagatccgaagcatgcgcggcaaaatggatggagcgggccagggaggcgctcgccgccggcgggacgccttggagaagaaanctccggancttcctgtcctggtttctgaaagaagggacatacgccgtnantctttgtatnaacaangaagattttgcaacttggatntcctaaanaaanttcaaaattggngntntc

SEQ ID NO: 98150 - DNA, 467 bp, Triticum aestivum
  unsure (1)..(467): unsure at all n locations
  Clone ID: PAT_TA_98150
gcatcattaaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacaagccatatccgcaagccgcaaccatttccatcacaacaaccatatctgcaagctgcaaccatttccgcaagccggcaaccatttccgccaacaactaccaatatcccgcaagccggcaaatcaattttccaaccaacaacaaacccaatnttccacaaacaagcaaccaacagttttcttacaaaccnacaacnaccaattttcccaagnaacaaaggcacaacaaccaacnaccaacaacc

SEQ ID NO: 98151 - DNA, 424 bp, Triticum aestivum
  unsure (1)..(424): unsure at all n locations
  Clone ID: PAT_TA_98151
gcagaacgccacgacgcgggccagggtggcggccttcgcgcagagccaggacagcttcttcagcagctgggccggctcgttcgcccggctcaccagcctcggcgtcaagaccggctccgccggcgaggtccggcggctctgctccagcgtcaacggctgatcggtcgacctcgggcatgggcatgggcatgtgcatggacatgagcatgtaatgatgtaacacagaatacatagggggatcgaacgtgttgaagtagcgagagctgaggatgaggttgattcgttttgtagctgatgatggtcgggccttctttgcttaggctgcatgtnatagatgacggcaccgcgttttatctgcgaccacaaatatcnaaacgaggcacgantgatgaattnaaaannaaaanaaaggggggggcccngg

SEQ ID NO: 98152 - DNA, 433 bp, Triticum aestivum
  unsure (1)..(433): unsure at all n locations
  Clone ID: PAT_TA_98152
gcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatgggaaagaagcttgaggatatcgttccttcatcccacaactgtgacgtcccccatgttgaccgccnagattatcaaacngattgacataaacttatgattgatatgtcagccttctcacttangagtgggaacaattaaggatgaccttgaaaccttccc

SEQ ID NO: 98153 - DNA, 428 bp, Triticum aestivum
  Clone ID: PAT_TA_98153
tgtaaagtttgatctttcagtatggtgagaagtattttgtcctccgaagatttccatacatgcctctttttatctaggttttctttcctatttttttggaccttctgatcatccatatttatctacaagaaaataaaaaatttaaatgagttgtattgcattcatgataataatatttcaactgcattcatgtgatctcttggcgtgtattcttctgattgcagtagacaaatgggggtctaggactgagctaatgtttactgttttacccatgacaacagttactactaattgtttgatttctacgtgtattcctatgttcttttcacaatgcaggtcggcaaaggaactgatggcttgtatttcaagtgatcctactgtttggcttaacaattggtttttaatagaaggggcctgcaaacttgatt

SEQ ID NO: 98154 - DNA, 449 bp, Triticum aestivum
  unsure (1)..(449): unsure at all n locations
  Clone ID: PAT_TA_98154
aaacaaccaggacaaggacaacaagggtactacccaacttctccgcaacagtcaggacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggggtacttcccaacttctcggcagcagtcaggacaagggcaagcagccaggacaaggacaacagtcggggacaanggcaacaaaggtcaagcaaccaaggacaagggacaacaaagcgtactacccaacttcttccgcaacagtcaaagacaaaggncaacagggcaaggacaattggcaacgaccggggaacaagggcaaccaagggtncttacccaacctctccacaagcaagc

SEQ ID NO: 98155 - DNA, 317 bp, Triticum aestivum
  unsure (1)..(317): unsure at all n locations
  Clone ID: PAT_TA_98155
gagagagagatngacacagatngatacatntttcgcaattncatatttccttccccatggctccgatcaagatcggcatcaatggtttcngcnggatcggcangcttgttggccagggttgcgctccanatcncctatgtcgnnctcgtcgccntcaatcatcncttcatcaccaaccgtactanatgattttacatncttcaangttttacacnnncccacttnncaagtttcagtnnctcctaacnnttntcttgaagggactncaaagaacccttcctctctcgggccataaaggnanggtatcttnttctttg

SEQ ID NO: 98156 - DNA, 397 bp, Triticum aestivum
  unsure (1)..(397): unsure at all n locations
  Clone ID: PAT_TA_98156
gtccattccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccagtgccgatnagatttgctgtttgctgctcagcaaagcaggatacagtggagaaggtttgtgaaattgttaagaaacagcttgctgttcctgaaggcactgaagtttgcggtaccaaccaagttttctgaaccttgggagctnaatcaatgggacaangggccaagatttgtgtttgggcccttgagggaaggagtttcaaaatnaancnttggaagggaa

SEQ ID NO: 98157 - DNA, 431 bp, Triticum aestivum
  unsure (1)..(431): unsure at all n locations
  Clone ID: PAT_TA_98157
gaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcaaccatttccgcaagccgcaactaccaaatccgcaagccgcaactaccatatccgcagccgcaactaccatatccgcagncgcaaccatttcgaccaaaacaaccatatccacaatcgcaaccacagttttcgcaaccacaacaaccaatttcgcancancagcaagca

SEQ ID NO: 98158 - DNA, 431 bp, Triticum aestivum
  unsure (1)..(431): unsure at all n locations
  Clone ID: PAT_TA_98158
gcggccactcctttggatacgagggctgggcatttgttgttctgccaaatcccagatagcagctgaagatcgacgaacttcgtttgttcatagggcggcggcacacagcagatctaaaggatggatgggtacaggatccccgcttcgggcccgagcgcacgccgacagatcgacgatacatccttggaatcagcaagaagaagaagaggggattggtttccctgctggaggtgccgttgcggagtcagagtcaagatgaagaagatcaagaaccaagcacaatggaaaagcgcctgcgatcagctccaagtgtagcgttaaagaagcttcatgatttgatcgcctcgcttgacgaggaaaaatacagtatgtcntccaagatggattttggtggcctgctggagctgaatactttgatgggtgggacgccc

SEQ ID NO: 98159 - DNA, 414 bp, Triticum aestivum
  unsure (1)..(414): unsure at all n locations
  Clone ID: PAT_TA_98159
agaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtctgttgagatgcaccacgangtccctcctggaggcgcttcctggtgacaatgtcggcttcaacgtgaagaacgttgctgtcaaggatctgaagcgtgggtttgttgcatccaactccaaggatgaccctgccaaggaggcagccaacttcacctctcaggtcatcatcatgaaccaccctggtcagatnggggaaccgctaacgccccaatgcttgggactgcccacacctcccacattgctttcaagtttgctngag

SEQ ID NO: 98160 - DNA, 403 bp, Triticum aestivum
  unsure (1)..(403): unsure at all n locations
  Clone ID: PAT_TA_98160
cccgtgtcttgtagaaactacagaaatctcaaatgaaatggcttcccttgtatttgttcatcacaatgcattcctgtggctgttggttgcgcaagtgaccagatgaatagctgaagcagattgcattggtgtaagacaaatgcttggcatccaacatagtaagagattgtgccacgtggaagctcatgccaaggctggcaaaatagcttgcctggtttttcaaatgcgtcgggtcaggtcgggaaggtaaataggagatggaggttggaataggcttagactcgggtatctgtatctccagcaatttgatgtgggtggaattttatcagtgggcgacttgataanaatgatccacggtttatagaaaaagtgtgggagagagtagaggtgtaactaagtgtgt

SEQ ID NO: 98161 - DNA, 411 bp, Triticum aestivum
  unsure (1)..(411): unsure at all n locations
  Clone ID: PAT_TA_98161
ctcgctgccgctggctctacttcacagcatcgtcaccttcatttgtgagcgccctgcttcgcctgcatcgccactcaccagttcctttgaggtgaaagcgctccggctggtggctagcgagatggccgggggaagaggcggtgcaaggcgaggcgccgtcgccgtcgccgccgcggcgctcgccgtcgcgtgctgctgcgtgggcgtcgccagcgcggccacctactacgtcggcgacgtcggcggctggtccctcagcaagcgggagctggcccaacgggaagcagttccgcgccggcgacgtcctcngtgttcaagtacaanccgctgatgnacaacgtggtggcngtnggctangacgntacaacgnggttcnaccacgcccgggcgggggtcgagggacctaacnan

SEQ ID NO: 98162 - DNA, 317 bp, Triticum aestivum
  Clone ID: PAT_TA_98162
gcgctacagacactacctgcaatttgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtggcatgcactatcatgtaagaacccaaactatactagttcaaacttgggaataaaagacaaacacaggtcttgtctacaaaaaaaaaaaaagaaaaaaaaaaaaaaaaaaaaaaaaaaaaaaaaaaaaaaaaaaaaaaaaaaaaa

SEQ ID NO: 98163 - DNA, 435 bp, Triticum aestivum
  Clone ID: PAT_TA_98163
gagagaactagtctcgagttttttttttttttttttatttgtatggagcttgttattttagggcgaatatagtagcaaggttgctgaaacagcaaatgccatccgactcgataaccatgatagcgacggttaatcacttgtgacagacgtagaggcagcaagtgccaagccaattcgcatgcaaagttgtttcctacattacgaatttgggaagcagctaaacaacattaatccgagctcgctcctctcctccctacgaagctcttcacctgctggctgctgctgctgcagtgtgacccccttggtgtctcaaccaagacgcacaggtgggcttggcgagggggaagctgggggatgagggagttctctgaagaagcaagcaggaaaaaaatagcatcaagttgacctgactgacaatatccgtttaagctgggg

SEQ ID NO: 98164 - DNA, 307 bp, Triticum aestivum
  unsure (1)..(307): unsure at all n locations
  Clone ID: PAT_TA_98164
ctatagttcctccatcccctcctctcccgggcgcctccaccccccgcctagcggcgcnaagcgaccatgacgttcaagcggnggaacggggggcgcaacaagcacggccgcggnnatgtcaagtacatccgctgctccaactgcgcnaagtgctgccncanggacanggctatcaagcgtttcttggtganngaacatcgtgntcgcaacgctgctgtganagatgtgcagggaggcttgtgngcatgatgngatatgttcttcccaaagctgtntggctatatngngcacnaattggnggtttcct

SEQ ID NO: 98165 - DNA, 428 bp, Triticum aestivum
  unsure (1)..(428): unsure at all n locations
  Clone ID: PAT_TA_98165
gagccccggtggtcgtcgttgtttctcaactcgccgttccatgctacctcgccttgtccgagcacgcacacgggcttgtggtgcgtcttctctggtccgctcgctgcagccttcaagcacgtcccggcgtctgcagcaggaggccgaggccgagcccctcaaggtgccagcacgcacgggcaccggaagcccgggtccgagctcgcgggcacgctgcccgccgccgcccttgccccagctggccgccaccggatcgacctccaccgccccccgccctgcagcatggccgactggccgcggccggcgtggctgcagcccgcggccgccaaggctgctgctcgcgcccatccgcggccaccgcgggttgatgctcangcccgttcgcggccaccgcgggcttgctgctcggtgtcaccttccccaagcaa

SEQ ID NO: 98166 - DNA, 444 bp, Triticum aestivum
  unsure (1)..(444): unsure at all n locations
  Clone ID: PAT_TA_98166
gctgaggataatgaaccccagcacaactccatcagatcagagtgcaacatacatgaattcataatttaaagtgagaagatgtcacagcagcacatactaataatttgataaaagtggggcgctgacaatgagacgacagacacaccgattaccgatctcggatcctccttagtttctactaagtaagtaagtagtatacgaagtaccacattgaatgcatctggggtatgtattttantccgggcntctaccaatcacaagggaaataaacacgccangggagtatgacgaagtanagttgttatnttttgggcgcgtgtatattnttccnncaaagaagntttatcaaccntatcctgttccnggggccttaaaaccgggaaccggnccggatttaatgggcgggcaaccggttaccaaccggggaccggggggnnggggggg

SEQ ID NO: 98167 - DNA, 330 bp, Triticum aestivum
  unsure (1)..(330): unsure at all n locations
  Clone ID: PAT_TA_98167
gcggtttggcccaccaagcaagctagcttccgctccggctctgatggctcgtccaatgcctccagcggntctccaagccaccaagctccacgggaagtattttgggaacaggccttctttctcatataatgtaagtcncacatgccaatgcctaacctgcctactggtcaagcantttcaacttgacactnaggacaaaacaaggctntccaagtccctatnttttggtncaacaannaatnctttgaaacctncctnntccctgggggaattngctcccccaaaggtnnaacaaattcccttgggaccttatngggaaacaaaattcct

SEQ ID NO: 98168 - DNA, 428 bp, Triticum aestivum
  Clone ID: PAT_TA_98168
cctcctccttgcgtggccgcctcctcgatgcgccggcgccggccacagcccctcctcgcgctgccgcccgtagcctcctcgcgacgccgtctgcagcctcctcgcgatgccgtctgcagcctcctcgacgtgctgccaccggccgcagcctcttgacgcgtagccgccgcctgaaaagctggatttaaccccggcaggttaagaagtggaacgagcagagggagaatgggagatttgcagggcccctctaaatcatccatttgagattctcctcaagttgcttttgtgtcagtgttattgctgtcttatgtttgaatttgtgctcctgtaatgtactcttttccaagcaatcgttggagaacatatgtgatgtttttctgttgcacaaataactcggcatgcttatgtattttggtatccaagtataa

SEQ ID NO: 98169 - DNA, 404 bp, Triticum aestivum
  unsure (1)..(404): unsure at all n locations
  Clone ID: PAT_TA_98169
cccacctcttcttctagctgaaaacctagcccacaattcgttcgttgtgctaacctcgatgctaccaaccataccactcaagtcagcctcctctccagtattgccgccgcgtcttcttccacaactcatcatttttcctcctattgatcggatctagtgtcaaactctccggagaagtcgtcaaaccccttacagacacatctccccctaaattgctgatctgtcgggctaagaagaggtcgccggtcggcgaaccctaaagatcggccgatgcgttgacattcatggttctatcaaatcgggcagaggtatgcatgaaatcccctttctattcttgacaataggacaaccgatcttattttatttgctaattttgacatangtggtgagtgggtgacntgatn

SEQ ID NO: 98170 - DNA, 429 bp, Triticum aestivum
  unsure (1)..(429): unsure at all n locations
  Clone ID: PAT_TA_98170
gcggccgccgccgtccaagtcggacaacctcttcatgcagatcgccgtccacccggacggtgccgtcacgcggcccgtcgtccccaccatcccggcttccgacgccggcagcggggcggccgtcttcagcagggacgtgcccctcgacacctctcttggcacgtacatccggctatacctccccaaccccgtcccgtcgtcgacgaagctccccgtcatcctctacttccacggcggcggcttcgttgtcttcaacgccgacaccgccttctaccacgcctcctgcgaggccatggcggcgggcgtaccgggcatcgtcgcctccctcgaataacgcctcgcaaccgaagcaacgcctggccgccgcctatgacgaccccctcgcgggcgttatttggctccgttgaacgttgggngcccaagaacccc

SEQ ID NO: 98171 - DNA, 433 bp, Triticum aestivum
  unsure (1)..(433): unsure at all n locations
  Clone ID: PAT_TA_98171
ggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataaaagcaaaaatacttaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaaagaagatactttggggcnggctcaacattccttccttgaaagcatctagggtcaatcccccttcaagcttgggaaaagaaggttcttgat

SEQ ID NO: 98172 - DNA, 442 bp, Triticum aestivum
  Clone ID: PAT_TA_98172
cgcatctctggcacacctaactgttgaacatattgccttttagttggccaacactcagcgccatacaacattgtgggtcgaaccgccgttctatagaacttcccttttagcttttgtggcactctcttgtcacagagaatgctagaagctttgtgccacttcatccatccggctttgattcgatgattgacatcttcatcgatatccccatccttctgcaacatagaccccaaatatctaaagatgtccttctgaggcaccacctgctcatcaaggcaaacctcctcctccttgtgcctattagtactgaaaccacacatcatgtactcggagacctttggatttcaaggtttgtctccatagctctaacttcctattaacccccgtccgactatcatcaaactagcgccacatcaatccgcaaaggagcatacaaccaatg

SEQ ID NO: 98173 - DNA, 419 bp, Triticum aestivum
  unsure (1)..(419): unsure at all n locations
  Clone ID: PAT_TA_98173
tgagggtgcatcatactatgggtatgcttctggatcaagccacaggaatagcttcacgtgcgagagtggccatgtacaaggccttgtgggatgaaggagattacgcatctgatataatagctgcaattgatagtgctatatcaaacggggttgatgttctttccttgtcatttggttttgatgatgtacccttgtacgaagaccctgttgctataagccaccgttttcaagcaaatgggagaaagggaatttttgtgtccaacgtcaagcaaggaaaacgaaggggctttccttgggaagacttcacaatggggataacaatgggtnaaaacccgtggctggctgggaacttgggcccgtnaatttcaagggnactccttaaacctggnaatggggtccaaatnactgggaaggtcccc

SEQ ID NO: 98174 - DNA, 416 bp, Triticum aestivum
  unsure (1)..(416): unsure at all n locations
  Clone ID: PAT_TA_98174
agcaacactagttaacaccaattcaccatgaagaccttcctcatctttgccctccttgccgttgcagcgacaagtgccattgcacaaatggagactagccacatccctggcttggagaaaccatcgcaacaacaaccattaccactacaacaaatattatggtaccaccaacagcaaccgatccaacaacaaccacaaccatttccacaacagccaccatgttcaacagcaacaacaanccaccattatcgcaagcaacaacaaccaccattttcacaagcaacaaaccaccattctcgcaagcaaggaactaccaattctaccgcaacaaccaaccattttcgccagcaacaacaaccacaattttcggcaagcaacaacaaccattcccgcagcaacaacaaccacttncnact

SEQ ID NO: 98175 - DNA, 404 bp, Triticum aestivum
  unsure (1)..(404): unsure at all n locations
  Clone ID: PAT_TA_98175
cccccttctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgcccccggaaagaccancatcctctacaagctcaagctcggggagatcgtnaccancatncccaccatcggggttcaatgttgaaactgtgggagtncaagaacatcancttcactgtntgggatgtcngggggtcaagacaaaattaaggccactgtnggaggcattacttccagaacacacanngn

SEQ ID NO: 98176 - DNA, 414 bp, Triticum aestivum
  unsure (1)..(414): unsure at all n locations
  Clone ID: PAT_TA_98176
ccggtggaaggnctgcgtcccctcgaggntggtacgtattctggnaaggacagaggttcttanccatttttcantgngtgtgtattctttanattcgcgtaaaattcttcantaatgctcccaaatctctgctcactccanaagtccanatacagtgcatcacgtaattttcttgtttagttgccattagccaacttcacanaattcaagttggntttatttgaacggcaatgtctcgagcttttggggagcaacagtaattacaagcttanctagcgccataccaacactttgccattgngaggatttgcatcccacctctaccccaatgtcacaagtaaaattattgngattatccatctgatgacatgagtaatttaacttttgntcngtgtttcangttgtctggagcaa

SEQ ID NO: 98177 - DNA, 453 bp, Triticum aestivum
  unsure (1)..(453): unsure at all n locations
  Clone ID: PAT_TA_98177
gccaagcaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcaagccgcaaccatttccatcacaaacaaccatatctgcagctgcaaaccatttccggcaagccggcanactaccaatatcccgcaggccggcaacctaccaattatcccggccagncccgcaanccaatttccggaccaacaancaacccaattattccaacaaatcngcaaatcccacaaggtntttcgcnaacccnacaaacaaaaccaattttccggnagcaang

SEQ ID NO: 98178 - DNA, 449 bp, Triticum aestivum
  unsure (1)..(449): unsure at all n locations
  Clone ID: PAT_TA_98178
gccaagcaagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacaatttctagggcagcaacaaccatttccaccacaacaaccatatccacaggcgcaaccatttccatcacaacaaccatatctgcaggctggcaaacattttcggcaagccgcaactnaccaatattcggcaagccaacaacccatttccgacccaacaaccaacccaatattccaacaaacccggcaaaccaacnaattatttcggcaacccaacaancattccaaattttcaacaagnaagccagnaaagccagncaancaancnaaccan

SEQ ID NO: 98179 - DNA, 414 bp, Triticum aestivum
  unsure (1)..(414): unsure at all n locations
  Clone ID: PAT_TA_98179
ggtcgtcgcggctacagctagggtttctcgcccccgccctcccgcctcaccgtcggccccgtacgccatgtcgaagcaaggagggaaggccaagccgctcaagcaggccaaggtccccgagaaggactacgacgagaatgacctggcatacctccagaagaagaaagatgagcaaaaggccctgaaggagctgaaggccaaggcaggccanaaagggtgcgctgggaggatccggtctcaaagaagagtggggaaagaaatgaggctgcccacccattcgtaatgcccaagaaaatgataatctaactatctncctttctgtgtcgcgcttcactatctgtgggttgtaaaaagactaccttcaattggtgtttgagcattaaagcatcgtcccaantccggttgctgaaacct

SEQ ID NO: 98180 - DNA, 404 bp, Triticum aestivum
  unsure (1)..(404): unsure at all n locations
  Clone ID: PAT_TA_98180
gaaaggctctgctgccgtgccgctggccggtgtgcttgacgggttggttcctctcgccgtgttcggtagtgacggcgaaattcctctgcgtccatggagacgtgtattcaaggatcagagaggatataagtgtgcccggcgggataccggactgggaagaattagtgatcaagctgctttggatacagtctccatacagataaataaaggatgcaacatcttgttccatacggatgatgtggagtcgggccagtataaaggaagaggaatagttgcaaggaattcggcacgaatcaaagaaaaaataaagactgangaagagattgcatgtgcggacaaggtgagtgtgattggtaaaaccatttgatccaaccaacgagaaagcgtggcttgcgggcacaatt

SEQ ID NO: 98181 - DNA, 205 bp, Triticum aestivum
  Clone ID: PAT_TA_98181
tttttttttttttttagagtggaactgaacgtgccatagcgcctagctcatttcagagcatacatttcatccggtaatcagtagtcttaccgtgtaacccctgattgtatgaccatatcatggtgtactgtttctcgtctcgacacgagaaaatcactgatggcgagatatggtgcatgtgactgtacatggggactggggagga

SEQ ID NO: 98182 - DNA, 280 bp, Triticum aestivum
  unsure (1)..(280): unsure at all n locations
  Clone ID: PAT_TA_98182
gctctttttttttgccggagaaacgcagtttattgcatgtcacaaacattgtccactggtacaaaacggacagacagctacagctccaagaaatgtcacaaatcggcaccgatacatggctgagtacattccaaagggcaacaatacatcacaaaattgtggtacaaggggccgccagccgtgagcagagaaatggaggagatcatttatgacgaaagaacacttttatctagctagcttcctccacacggtacggncacggntgatttcccngtccctt

SEQ ID NO: 98183 - DNA, 398 bp, Triticum aestivum
  unsure (1)..(398): unsure at all n locations
  Clone ID: PAT_TA_98183
agaacaaacattatctaacacaaatcaaccatgaagaaattcctcgtccttgccctcattgttgtcgcggcgaccaccacggccgccgaaccctttactgcattccgtagtgcttgggagccgcaacatccatcaactccggagcatcaaccaactccgcattcacangnttatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaatt

SEQ ID NO: 98184 - DNA, 434 bp, Triticum aestivum
  unsure (1)..(434): unsure at all n locations
  Clone ID: PAT_TA_98184
gccagccccagcccgtgtccctccccagcccccaatcctcagatccgcctccgctccccgagcaagtccacccccaccccccccccctccccaccgcggggcgcacgcacgcacccggccaccgcccacccggatccaagatccgcgcggcggcgggggcgcaggcgaaggcgaaggcgaaggatgnagcnatggncnagcggnggnggngccggcggcttgtcggantcngtgatgcggaangngctgctctcctactgntacggtgggcgggtggtggantcttcctctcctttcgccgtcatcgtctnacaanaaagntacattctnttaaccccaagggatngnacaatttgggnctttccccaatcttgctcaaccatnggtgggaaanttaactttnttgatccttcggtttncaccntnggaacttn

SEQ ID NO: 98185 - DNA, 453 bp, Triticum aestivum
  unsure (1)..(453): unsure at all n locations
  Clone ID: PAT_TA_98185
tttttttagaatcatgcacctctcaggctcaatctgaacatcagcatttaaaaatgtcacaaatttcgcttgctacatagccaaatcagtcaacgaccgaaaacagtgtcatgtaaacatacgtaaccaccgcacacacactagaattcgctacctcagattccagtctaccctacatgatccccacgagaagaaaaaaaaaaagatcggactacatatgatgaaaacagcagcagagatcgaatgctaaagcaatgaaccattgttgagtgtaccaagatgaccagatgtcttgtccttgcacgcgggggcaaatgaagccaacangaatcgttctgctgctcgggcgggtgccaaaaatgctgggnaccttgtggttgcaccaacacacatacngggatttggagcacgccaaaccatcttggacagggtcccaaccctaactnggaccgg

SEQ ID NO: 98186 - DNA, 447 bp, Triticum aestivum
  unsure (1)..(447): unsure at all n locations
  Clone ID: PAT_TA_98186
attcactcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccaagttccacatcaaaagttgaacccatgcagggatgccctcctacaacagtgtagcccagttgctgatatgtcattcctccggtcacaggtggtgcaacatagcagctgcttggtaatgtgggangcagtgctgtcagcaactaaaagcgatccccaagcagtcaagatgcgaggccatccacaacgtttgtgcacgccatttattttgcaaacaacaacaacaatttgggnacaagcctacnttcaacccaaccct

SEQ ID NO: 98187 - DNA, 497 bp, Triticum aestivum
  unsure (1)..(497): unsure at all n locations
  Clone ID: PAT_TA_98187
aacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcaacaacttaacccaagcaagggtattcctccangaagcaatggcagncctggtgggaatggcaacaaaagtccttggctaanggccgcaaaatggtttgcannnagaggcaantttgccaatgttgattgcaaacaaacaatntttgcccangcaagtttggccnnaaaattccccccaagcaattccccgcttttgangggnaaatnccgtggtaatcaatcctaactcccaatcaatnccttgnnaaggaanaaanaaanaagggttcaagggggttccattccaaaactccctccaagnaagcaa

SEQ ID NO: 98188 - DNA, 454 bp, Triticum aestivum
  unsure (1)..(454): unsure at all n locations
  Clone ID: PAT_TA_98188
gcaacactagttaacaccaatccacantgaagaccttcctcgtctttgccctcctcgctcttgcggcggcaagtgccgttgcgcanntttcacagcaacaacaagcaccgccattttcgcagnaacaacaaccaccattttcacagcangcaacaaccaccattttcgcagcancaacantcaccattttcgcaacaacaacaacactccaccatttgcgcatgcaancaacaaccaccgttttcacaacaaccancattttcacagcancaatacccaccattttcacagcaccaacanccacaanttttcacagcatcancaaccaccatattcgcagcancaancaggccancatattcgcagggancancaanccaccattttncgcaggcaagcaaacaaccaccattttcgcangcancaancaacantccaccatttacacagcaag

SEQ ID NO: 98189 - DNA, 446 bp, Triticum aestivum
  unsure (1)..(446): unsure at all n locations
  Clone ID: PAT_TA_98189
ctagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacatacccccatcaaccacaacaacaatttccccagacccagcaaccacaacaaccatttccccaagccccaacaaacattcccccaacaaccccaactaccatttccccaacaanccccaacaaccattcccccagcctcaaaaaccccancaacaatttcccccagttcacaaggancaacaancaacctttttccccaggccccaaaaaacaatttcctgg

SEQ ID NO: 98190 - DNA, 441 bp, Triticum aestivum
  unsure (1)..(441): unsure at all n locations
  Clone ID: PAT_TA_98190
atcattttgtctttctgccatgttctccagcgaatatcaaccaaaacaacaccatttcgtagcaacaagcacaacaacaacaacaacaacaacaacaacaaatccttcaacaaattctgcaacaacaacaactgattccatgcagggatgtcatcgtcttgcaacaacacaacatagcgcatgaaagctcacaagtattgcagcaaagtagttaccaagtgttgcaacaattatgttgtcagcagctgcggcagatccccgaagcagtcgcggtgccaagccatcaacaatgtcgttcatgctattattctgcatcaacaacaacaacancangggacaacatcancagtcgagccaggtctcctaccagcagcctcagcaacnatntccatcaggccaggggctccttcangccatctcangcaaaatccacagggcccc

SEQ ID NO: 98191 - DNA, 446 bp, Triticum aestivum
  unsure (1)..(446): unsure at all n locations
  Clone ID: PAT_TA_98191
atctaacacaaatcaaccatgaagaaattcctcgtccttgccctcattgtcatcgcggcgaccaccacggccgccgaaccctttactgcattccgtattgcttcgtagccgcaacatccatcatctccagagcagcaaccaactctgcagccacaagaacatccagttccacatcaaaagttgaacccttgcagggatgccctcctacaccagtgtagcccaagtagctgatatgtcgttcctccggtcacaagtggtgcaacatagcaagctgcttggtaatgtgggaagcagtgttgtcagcaactaaaagcgatccccaagcaagtcaagatgtgaggccatccacaacgtcgtgcacgccattattttgcaacaagcaaaaacaattggnacaagggtattcaaaccaacctcagnaagcaagcaacaacaaggncaaacaa

SEQ ID NO: 98192 - DNA, 430 bp, Triticum aestivum
  Clone ID: PAT_TA_98192
aacaagttgactggaggaataccaacatcagttagtaagttgtgcaacttggttcaaatcaaattgtccgggaacatcttgtcaggagatattgcaaaagtagcaaagagcctgtttccctgtatgaagcggctgcaggtccttgaactttctggtaacaagttaactggaaacctatctggttggcttgagggcatgtcaggattaagaatccttgacctcagtgcgaactcactgtctggagttgtgccacatggtattggtaacctatcaagcttgacatacttggatatttcctttaatagatttaaaggcacactatcggaactccaccttgccaatttatcaagattggatactttaaatctagcatcaaattcgttcgagattgtcatcaaacaaagctggctgccaccttttcagctcataa

SEQ ID NO: 98193 - DNA, 154 bp, Triticum aestivum
  Clone ID: PAT_TA_98193
cgaagcactcgtgtgcattctactgtaatctctatgttcaagtgtagttatcaactcctaatcaccatacatgtatgcaaccaaacatcaggtgaaatttgttttcatgatgacaagacctcatatgcaggcaaccaaaaaaaaaaaaaaaaaa

SEQ ID NO: 98194 - DNA, 452 bp, Triticum aestivum
  unsure (1)..(452): unsure at all n locations
  Clone ID: PAT_TA_98194
gtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagangaaggagaaggccaatatctcctactacaggagaaagcaactggcgaatgctccgcgtcaaggccgagaatgcanccgagggagaagttgggaactcaagctggagatccttggcccctatcanatcctaangagatatcaagatcntttcgtgcgccatcatttttggggaaacctcctgtncgttatttttaangtagttttgggtnaacnctgantactacnattctgggtttggttaaaacctttgnttntgcattgcantttnntgcgacaattcaantttgnaaatttttctnacatgg

SEQ ID NO: 98195 - DNA, 370 bp, Triticum aestivum
  unsure (1)..(370): unsure at all n locations
  Clone ID: PAT_TA_98195
atggcggaccgcgggggctacgtgcaggtgcancacgggcagtacngcggcgggcaccacggcgggcagcagcagcacgggcgccagatgggggagcagatnaagggcatgctccanganaaggcgccgtcggcgtcgcaggcgctgacggtggcgacgctgttcccngctggtacgtggctgctgctggatgnctgtcggtcgctgcncgctggtcnggcatcngtggtggnggctggnncgtgggcgcacgcccngtggttcctgctcttcangccccgttgnctgtntcccnggtcngcgcctcaccattcnggctggcccgttcaccggtttnctcacctnccgngccacgcctgggggnttggga

SEQ ID NO: 98196 - DNA, 485 bp, Triticum aestivum
  unsure (1)..(485): unsure at all n locations
  Clone ID: PAT_TA_98196
cccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattggccaagtgatgcggcaacaaatgctgccaacnaacttagcaacaagattccttaaacaagctcccaggttgcgcaaagccattccaatanccgttnntggcaattccaatcaatccatngcanggaagnaagcaagcaaacnaacnaaccaancaaacaaagggnaatggcaataatctttttctggccaactnatcctcaancaaanaaacaangntggggttcaaagggttttnntaagtcccaaangggccaaggggcaatcant

SEQ ID NO: 98197 - DNA, 431 bp, Triticum aestivum
  unsure (1)..(431): unsure at all n locations
  Clone ID: PAT_TA_98197
ccgcatcctaggggttactacaagtgtagcacgcgtgaggggctgcccggccaggaagcatgtcgagaggtgcgtcgacgaccccgcgatgttgatcgttacctacgagggcgatcacaaccacaaccacaaccaagctgcggcagcccngccaggaagcatgtcgagaggtgcgtcgacgaccccgcgatgttgatcgttacctacgagggcgatcacaaccacaaccacaaccaagctgcggcagcccaaccaagcctgacctttcgggtctccatcgtccgtcgcagaccgctttcgatagcctccgttttctagaagaaagacatgaaaanaagaagatgaaaaaagaagaanaagaaagaagaagactagcctgtacatactcttctgttcctaactngctgggggaagggggtgggccnantcct

SEQ ID NO: 98198 - DNA, 214 bp, Triticum aestivum
  unsure (1)..(214): unsure at all n locations
  Clone ID: PAT_TA_98198
aaaagccacaagccaagaaccaatacttgatctgttgtttcctttagctcccggaagacttttagctgcaccgatcgatctcgatcatggaggatgagaggagcacccagtcgtaccagggaggtgaggccgccgagcaggtggaggtgacggacaggggcctcctcggcaacctcctcggcaagaagaaggctgaggaggacaaggaganggg

SEQ ID NO: 98199 - DNA, 443 bp, Triticum aestivum
  unsure (1)..(443): unsure at all n locations
  Clone ID: PAT_TA_98199
ggcaaccagggtactacccaacttcgcagcagtcggaacaagggcagcagccaggacaaggaaaacaaccaggacaaggacaacaagggtactacccaacttctccgcaacagtcaggacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggggtacttcccaacttctcggcagcagtcaggacaagggcagcagccaggacaaggacancagtcgggacaagggcaacanggtcagcaaccaggacaaaggacaaacaagcgttctacccaaacttcttcgccacaatccaanacaaagggaancagggcangggnt

SEQ ID NO: 98200 - DNA, 284 bp, Triticum aestivum
  unsure (1)..(284): unsure at all n locations
  Clone ID: PAT_TA_98200
cccggacgcccccaggaccaccggcagcagtagccatgacgccctccgccgtcgccaacctatccggcgcctccccgctgcccgccttcgcgccgaggcccaggtccaggcccaactcggnnagcccgggcncgttcgggcccgcgccgcgccggntcgccgtcgncgccccgcngcgggccttcttctcctcgggntccctacnanccgcnggangccggnagggttactcctccgtccgagattacgggcctnctgctccatggtctcganaccacctcccg

SEQ ID NO: 98201 - DNA, 438 bp, Triticum aestivum
  unsure (1)..(438): unsure at all n locations
  Clone ID: PAT_TA_98201
gccaatcaaggagtggtcaatacaaatccaccatgaagacctttatcatccttgccctccttgctattgtggcgaccaccgccacaactgcagttacagttccagtgccacaattgcagccacaaaatccatctcagcaacaaccacaaaagcaagttccattggtgcaacaacaacaatttctagggcagcaacaaccatttccaccacaacagccatatccgcagccgcaaccatttccatcacaacaaccatatccacagccacaaccatttctgccacaactaccatatccgcgtccgcaaccatttctaccacaancanncatatccacanccggaaccacaagtatccgcaaaccacaacaacccaatttcgccacaggangcaancagcaaccatccaacnaacanccaccaantccnttcaacaaaantt

SEQ ID NO: 98202 - DNA, 347 bp, Triticum aestivum
  unsure (1)..(347): unsure at all n locations
  Clone ID: PAT_TA_98202
actggttaacaccaatccaccatgaagaccttcctcatctttgctctcctcgccattgtggcgacaagtgccattgcacanntggngaatagccacatccctggtttggngagaccatcgcagcancaaccattaccaccacancanacattatcgcaccaccancaanaacaacccatccaacaacaaccacaaccattttcacancaggcanccatgttcacagcaacaacancaaccattatcgcagcaancaccaagccaccattttcacaacantgantcaccattttcgcanncaacaancaacaaccattatcgcngcatcancaaccaccattttcaca

SEQ ID NO: 98203 - DNA, 372 bp, Triticum aestivum
  unsure (1)..(372): unsure at all n locations
  Clone ID: PAT_TA_98203
gccaagcaagctgtggtcaatacaaatccaccatgaagacctttctcatccttgccctccttgctatcgtggcgaccaccgccacaactgcagttagagttccagtgccacanttgcagccacaanatccatctcaagcatcagccaaaaagagcaagttccaattgggtacaacaaacaacanntttctaggggcagnaacnaaccaatttccaaccaacaacaaccaatatccacaagcccgccaaccatttccatcacaacaaccatatcctgcagctggcaaaccatttccggaagccgcaattaccatattccgcagcncacaaaccattttncgancaacaacntcccaatntnccnacaatcccg

SEQ ID NO: 98204 - DNA, 444 bp, Triticum aestivum
  unsure (1)..(444): unsure at all n locations
  Clone ID: PAT_TA_98204
actggatccacgccgaagaccgtagcctcctccttgcgcggccgcctcctcgatgcgccggcgccggccacagccccctccttgcgctgccgcccgtagcctcctcgcaacgccatctgcagcctcctcgcgatgccgtatgcagcctcctcgacgtgtcgccaccggccacagcctcttgatgcgtagccgccgcctgaaaagctggatttcaccccggcaggttaagaagtggaacgaagcagagggaaaatgggagatttgcagggcccttctaaatcatccgtttgagattctcctcagttgcttttgtgtcagcgctattgctgtcttatgttcaaatttggtgcctcctgtaatggtactcttttccaagcantcattgcaacanacatatgtgatgttttttcctgttgcacaatatnaactncangcaatgcnttn

SEQ ID NO: 98205 - DNA, 470 bp, Triticum aestivum
  unsure (1)..(470): unsure at all n locations
  Clone ID: PAT_TA_98205
gttcagtcccctccagctctcgagttcgacagatcttggctcacttcaccgccggcggacgcagcgaagcgagggaggagcaatggcggaccgcgggggctacgtgcaggtgcagcacgggcagtacggcggcgggcaccacggcgggcagcagcagcacgggcgccagatgggcgaagcagatgaagggcatgttccaaggagaaggcgctgacgtgggcgacctnttcccgctgggcgggctgcttgctggtgctgtccgggcctggcgctggcgggcaaccggtggtgggggctgggccgttgggccaacgcccgtgttccctgctcttcaagccccaatgnctggtccccgggccgcggctcaacaatcggggccttgggccgttcanccgggggtttcctcnacctnccgggggncgncttggggggcttggggcngggcctctcccttgnctcaaacggtnctt

SEQ ID NO: 98206 - DNA, 445 bp, Triticum aestivum
  unsure (1)..(445): unsure at all n locations
  Clone ID: PAT_TA_98206
gccacttctcctccggccgcaaccgccgtggcctccacgacgagctcagtaacgaccccgttccccgccgccttctcgccccacgacctccaggcgttagcagccgccccgccctgcctagttctattgtctttcggctgtgccagtcgtatggtagtgtatgccagtggatggattcttgattttatcctcgcgcatcgcagaaactgattaccggcggatctcatcgccaccgcgtatgagacgatgccacagcgatccgccccgccgtcgccgttctctacgggctcgcttctgcggtccagtaggcgatggcggtgtatattgcgcantagatttataccaagggattttgaaagnaacaagctcaacacaagnaggtgggcaatgtttaagtttgcttaancggtggtttgtttancccttttgttcttgaatttctgnn

SEQ ID NO: 98207 - DNA, 440 bp, Triticum aestivum
  unsure (1)..(440): unsure at all n locations
  Clone ID: PAT_TA_98207
agaacaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgntgcacgccatcgttttgcancaagcaacaaacaatttggtacaaggtatttccacccaaacctcaagcagcaaac

SEQ ID NO: 98208 - DNA, 441 bp, Triticum aestivum
  Clone ID: PAT_TA_98208
gaactagtctctgaatttttttgtctccgtcaggggatgctcatcatgacatcatcaacggcgcttccgtggctcctgcctcgttcttccgacgagagcagcggtgtccatcgcgccgccgtctacctggggctctaccttgtcgccctcggcaccggcggcatcaagccctgcgccacggccttgggcgccgaccaattcgacgttgccgtcccggcggagcgggtggccaagggttccttcttcaactggtactacttctcgatcaacattggctcgcttctgtcggcgacgtttctcgtctgggtgcaggacaacatcgggtgggaccgtcgggctcgcgattcccacagtgctcatcgggttcggcctcgcccgtaatccttggccgggggaagatataaaagggtacaagccaatgggaagtgggaaggtaacccg

SEQ ID NO: 98209 - DNA, 443 bp, Triticum aestivum
  unsure (1)..(443): unsure at all n locations
  Clone ID: PAT_TA_98209
gctcgtctcccctccgcctcctccccgtgtctcctcccgcgatccccttccccttccccgccggccgccgcgccgcctcccgcagcagcatgccgctaccccagaccaccggcgcgatgcttcccccatccccagtgccgcctccctcatccgctcttcagctcccagtcgtcgagccgcacgccgcaggtaaccgccggtcagctcgatcatggcaaccgccgaacgtgcagcaagtcggggtggttatctcctccaccactacaaagaggtactgcgaactcctgcctcacgtcctcctcacttgccttattttttcacatcttgcctccctccctccccgtcaaagcgaacgggagcccgctgaggcgctgaactgccttaaccttggcgtgggccaagtacccgcaagctccgtngggactgggattcgcaaaataact

SEQ ID NO: 98210 - DNA, 468 bp, Triticum aestivum
  unsure (1)..(468): unsure at all n locations
  Clone ID: PAT_TA_98210
gggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacataacaagctgcttggtaatgtgggagcagtgctgtcagcaactaaaagcgatccccaagcagtcaagatgcgagggccatccacaaacgtttgtgcacgcaatttttttgcaacaaanaacaacaattgggtanaagctactttcaacccaacctcangnagcangcaaaaaacaagggtcaacaaacaacaacanggtctggggttctagccagccacaacaacaaacacaactggattaagggttgggtttgcggtgatangggacatgggtgattcagaccatcccgggaattgtngcgacgttg

SEQ ID NO: 98211 - DNA, 458 bp, Triticum aestivum
  unsure (1)..(458): unsure at all n locations
  Clone ID: PAT_TA_98211
cccgctccgaccaccactcccaccacgccggcgccagtcaaggccccggccacccccgcgccgaccaccactcccaccacacaggcaccggtgaatgccccggccgtccccgcgccaaccaccacccccgccgcaccagcgccagtcgtcaaggccccggccacccctgctcctgcggccgcgccgcccaccactccagttgccaccaccgcgccggtcaaggccccagccacccctgcgcccgcggccgcgccgatcaccgctcccgtcactcccgcccccgtcactgcccccgccgcaagctccaccaactcccgctcccaagcccaaggccaaggcccctgctgcaagcaccaaccgccaagggnaccgcccccgctccagcagcgctccctcccaacgtcgaagcacccgcgggagccgcggcaaacgctcgttccccaaggtgcctgccgccn

SEQ ID NO: 98212 - DNA, 480 bp, Triticum aestivum
  unsure (1)..(480): unsure at all n locations
  Clone ID: PAT_TA_98212
cccagagctcgttagggttttctcttttttcgggggagaaatctcaagaggcggcaccatgctcgtgtaccaggacaagctttccggcgacgaagcttctgtcggattcgttcccttacagggagctggagaacggcgtgctctgggaagtcgatggccattgggtcgttcaaggagcagttgatgtggacattggagccaatccctctgctgagggtgggtggtgatgattaagggtgttgataaccangcctgtnaangggggttgncaattnnttgacaccctttcccgtcttcaaggagcaanccctgcttttgaacaanaaacnnttttatcctcctcaacattgaaancggcttncatccaanaannctcctcttnccaaagctntntnaagggggaatgacccttaaaatnntttttccaanaaaaaaattttgnnttcccgccaacnaaantnatcttccttaacnaaacnt

SEQ ID NO: 98213 - DNA, 437 bp, Triticum aestivum
  unsure (1)..(437): unsure at all n locations
  Clone ID: PAT_TA_98213
gacgccggacacgcacgagtcttcttgaagcaatggcgaccaccgcgatggcgctctccccctcgtccttcgccgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggaaaccgcggggctgtcggncgaaccccaaaacttcgccaagaaacgggagcttgangtatcaatgccggtgggccatgcgggcgcgctccggtgntcctccccgaactggtcnnccgcaaacgggtncaattccggccangncctntgggtcaaaggccgggcn

SEQ ID NO: 98214 - DNA, 468 bp, Triticum aestivum
  unsure (1)..(468): unsure at all n locations
  Clone ID: PAT_TA_98214
gagacacagagcagagcggataaactcnagggcagtagatcatcaccaaccatgtcgtgctgcggaggcaactgcgggtgcggatccggctgcaagtgcggcaacggctgcngagggtgcaagatgtnccctnagatggacnagggggtgaccancanctcccanaccctcatcatgggcgtcnccccctccaagggcaccccgtcgttncagggcgccncccanaacggagccnacaaccgggggtncaagttgcggctccaacttgcaccttcaaaccngtgcancttcaagtgattcaatcaaaatcaaggacaaaggagattggcaatgggcaattggattggacctaatgaaaggagnnactaagtaantaatttntgcannggggtggtgccgtttggggttccccctttttaaattgccgcccgagaaataaanaacgaagattctatccttatccgttat

SEQ ID NO: 98215 - DNA, 452 bp, Triticum aestivum
  unsure (1)..(452): unsure at all n locations
  Clone ID: PAT_TA_98215
tccccttcctccgccgccgcgactagagtttcctcgctagggtttcgtctcccggtccggatccagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaaggccaagcccgccgatggggctgccgccggagccggagccggagcctcggacgccgcccccgccgcccccgccgangacctcaagaactgggacccnagttcgtcaaaggtcgaccangccaacctnttcgaactcatcctgggctgccaaactactn

SEQ ID NO: 98216 - DNA, 459 bp, Triticum aestivum
  unsure (1)..(459): unsure at all n locations
  Clone ID: PAT_TA_98216
tttccccctacaaccccaacaaccattttcccagccccaactacaattcccccagcaaccagaacaaataattccccagcaaccccaacaaccattcctcctggaatcgcaacaaccattcccccagcaaccccaacaaccattttcccagccccaacaactgatccccatgcaaccacaacaaccattcccccagcaatcccaacaatcacaacanccttttcccgggccccaacaattatttcctgaactccaacaaccaattccccagcaaccacaacaaccattccccctgcaaccgcancaaccattcccccagcaatcgcaacaaccattcccccagcanccacaacanccattccccctgcaanccgcaanaancattcccccaacaanccacaccanncattccccccaanaaccaagaagcatcctttcccccctanaaggcacangnat

SEQ ID NO: 98217 - DNA, 449 bp, Triticum aestivum
  unsure (1)..(449): unsure at all n locations
  Clone ID: PAT_TA_98217
acttttatctagctagctagataaaagtggttccctagagttgatgagctagaaatcgagattgcagcaggtacattcctgaaacagagtcaagttcggataatgggtgctgggggcagtattcaagatccagataagactacggtcaccatcgatttggtgccactaggtcagaagtttgataggacttcagccttgctgattagcaacagatttttgcgaaagaaggttcctataaagtcatctatttttgggtgattatgatgtaacatatgttcattatcctggccttccttcttcaggtacctaatatcccaggatccttggggtccaataagcagcaatgagtatccctttggtgcaaatgtacacaatggaagccaatccgaagattagctccaaaattgtcgnccataanttgctccgtcangctgttgtgtttgntttgg

SEQ ID NO: 98218 - DNA, 296 bp, Triticum aestivum
  unsure (1)..(296): unsure at all n locations
  Clone ID: PAT_TA_98218
gcggcgcccgctgccggcggggcggcggcgaggaggaggaaggcgaggcaggagcaggaggaggagctccggactgtcatgtacctcagtaactggggaccaaacaactanctagctgatttgtcatcagtcctctcttcttcctagatagctaaaacggtgcactggctgcaccagttcgtttggctggatctggatgtgaattgtgaacacagcattatgctccttgtcgagcttgcgtaaaacacggtgcgctgcaagtacatgcctccatccgggagaaattcangtacaaa

SEQ ID NO: 98219 - DNA, 504 bp, Triticum aestivum
  unsure (1)..(504): unsure at all n locations
  Clone ID: PAT_TA_98219
cccacccccaccccgcagcaatggctcgcacgaagcagacggcgaggaagtcgaccggcgggaaggcgccgaggaagcagctggcgaccaaggcggcgcgcaagtcggccccggccactggcggggtgaagaagccccaccgcttccgccccggcaccgtcgcgctccgtgagatccgcaagntaccagaagagcacggagcttgctgattccgcaagcttgccgtttcaagcgcctgggtggngggaagattcgccgcaaaggacttnaaagaaccgaaccttccggctttccaagaagctccggccgttttccgcngcttgcaagggagggccgnccgaagtcctaactncgtccgggctncttcccaaggaaancaaacctcnngggccaatncaaagccnaaggggggttnacnatcaatngccaaagggaaatcaannttcnccggcngaantccngcggggaaagggccttaagttancggtnaccccgtttggtttt

SEQ ID NO: 98220 - DNA, 460 bp, Triticum aestivum
  unsure (1)..(460): unsure at all n locations
  Clone ID: PAT_TA_98220
cccgacctcaccgggaaacctcccatcgaagcgaagccaaggctctctcctcctcctcctcaagatgcagatcttcgtgaagacccttaccggcaagaccatcacacttgaggtcgagtcctctggacaccatcgacaatgtcaaggcaaagatccaggacaaggagggcattcccccggaccaagcagcgtctcatctttgctggcaagcagctcgaggatggccgcacccttgcagactacaacatccanaaggagtccaccctccacttggtgcttangctccgtggtggtatgcanattttcgtcaagaccctgaccggcaagaccatcaccctggaggttgagtcctcggacaccatcgacaacntcaaggncaagatncaagacaaggngggnattcccccggggcanaaacgtcttatcttcnccgggaaagcaacttgagggatggccgccc

SEQ ID NO: 98221 - DNA, 208 bp, Triticum aestivum
  unsure (1)..(208): unsure at all n locations
  Clone ID: PAT_TA_98221
gggacaaataaaatggcccattcatagttcaccgaggcatcatcttactgttgatactagcaggaaattgcatgccacacatgaatattgccatatacttagggttcattccgtttacaggatttcgaaatcaaagaaatagaaaaggtaaaggattaaaaaaaaaaaaaaaanaaaaaaaaaaaaaaanaaaaaaaaaaaaaaaaaa

SEQ ID NO: 98222 - DNA, 228 bp, Triticum aestivum
  unsure (1)..(228): unsure at all n locations
  Clone ID: PAT_TA_98222
aagagctacaatcacctcaacaatcattttcccatcaacaacaancatttccacagcaaccatatccacaacaaccatatccatcacancaaccatatccatcgcaacaaccatttcccacacnccaaccacaatttccccagcanctcacaacanccagtttcnccagccccaacatccgatccccctacaaccacaananccattcccccaggtatccccangcaa

SEQ ID NO: 98223 - DNA, 457 bp, Triticum aestivum
  unsure (1)..(457): unsure at all n locations
  Clone ID: PAT_TA_98223
ccaagccataaacccaagtcggactcgccttcctcctccccaactactcctcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttgtaaatgtgacagctggagcggatggtgttgctaacatcaatgttactggactggcaanaatccccttnactggaccaaattcaanttgtttggccgttgctng

SEQ ID NO: 98224 - DNA, 449 bp, Triticum aestivum
  unsure (1)..(449): unsure at all n locations
  Clone ID: PAT_TA_98224
cacaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacaaacatttccccaaccccaacaagcattcccccatcaaccacaacaacaatttccccaagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcncagcaaccacaacaaccttttccccaggcccaacaaccgcaacaatnat

SEQ ID NO: 98225 - DNA, 473 bp, Triticum aestivum
  unsure (1)..(473): unsure at all n locations
  Clone ID: PAT_TA_98225
atgaatcagagcctctttttcatactctattgtttgtgaatcatgctggtttaacatagcttggtcaactaattttacaactcaaaatcttgaagttcttgattcatattctagttcttccagtttcagcttggttacgtcttgaaaatttgcactgacttgtttttgtgcaattaacccaagcgacctttggatgcgtgaaataccatatatcatgtcctgattgttttatgttgtttgcacatgcctgcatttgtttaaagtatcttgctgctgcccttgggtgaagatatgctgtcaccatnttcccacgaaatcaagctcaaaagaatcttcctcaatcttcctggcaaggcaattttgggcaatccttggaagccccaaacaagctaagcaaaattgggaaaggcgggcaagaatttgcaacaatgcngaacccctcaaagggggcccgaacggtgggtgaaaaggan

SEQ ID NO: 98226 - DNA, 276 bp, Triticum aestivum
  unsure (1)..(276): unsure at all n locations
  Clone ID: PAT_TA_98226
aganagaganaganntccctttttctgtagcacctttgagctttatgctctgctcccattactttatcaataaatctcaggacaaatcctgcgggaccttagttagagagagaccgatggcggnggcnagcgtcggcggcggagcggtgccgttcgtgtggaagacgtaccgnntggtggaggaccccggnacggacggggtcatcgggtgggggaattgngannaacagtttcttcttntctgnccccttctncttcttcgcatacnatgtctgc

SEQ ID NO: 98227 - DNA, 485 bp, Triticum aestivum
  unsure (1)..(485): unsure at all n locations
  Clone ID: PAT_TA_98227
gtgaagacccttaccggcaagaccatcacacttgaggtcgagtcctctgacaccatcgacaatgtcaaggcaaagatccaggacaaggagggcattcccccggaccagcagcgtctcatctttgctggcaagcagctcgaggatggccgcacccttgcagactacaacatccagaaggagtccaccctccacttggtgcttaggctccgtggtggtatgcagattttcgtcaagaccctnaccggcaaagaacatcaaccttggaggtttgagtcctcggacaacatccacaacntcaaaggcaagattcaaggacaaggaggggnattcccccggaacaancancggtcttatctnccccgggcaancaantttgaaggaatgggccgccaccctttccgggtttanaaacnatccagaaagggatcccnnccccccnacctngggtaacccaagggcttccgtggggggggaaggcaaaantt

SEQ ID NO: 98228 - DNA, 472 bp, Triticum aestivum
  unsure (1)..(472): unsure at all n locations
  Clone ID: PAT_TA_98228
ctgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggccccgccctcaagggtatccaagtttgaaaagaagattaagtttgaacaaagtatgggncntccctttaatggggaagttactaatttaaacccaaaaattggggaatttatcccccaaaaaa

SEQ ID NO: 98229 - DNA, 427 bp, Triticum aestivum
  unsure (1)..(427): unsure at all n locations
  Clone ID: PAT_TA_98229
gcaagcagtgctcaatacaaatccaccatgaagacctttctcatccttgcactccttgctattgtagcaaccaccgccacaattgcagttagagttccagtgccacaattgcagccacaaaatccatctcagcaacaaccacaagagcaagttccattggtacaacaacaacaatttccagggcaagcaacaaccatttccaccacaacagccatatccgcaagccgcaaccatttccatcacaacaaccatatctgcagctgcagccatttccgcagccgcaactaccatatccgcagccgcatctaccaaatccgcaagccgcaaccatttccgaccacaacaaccaatatccacaancggcnancacagttatttcgcaaaccaacaacaaaccaaattttcgcagcagcnagcagccaacaac

SEQ ID NO: 98230 - DNA, 436 bp, Triticum aestivum
  unsure (1)..(436): unsure at all n locations
  Clone ID: PAT_TA_98230
gaagatcgcgtacgaccagaagctctgccagctgctcgaggagtacaccaaggtgctcatcgccgtcgccgacaatgtcggctccaagcagctccaggagatccgcaagggtctccgcggcgactccatcgtgctcatgggcaagaacaccctcatccgccgctgcatcaaggtgcactcggagaaaaccggcaacaaggacttccttgagctcaacaacctcctcgtccgttacgtttggctcatcttcaacaagggtgacctcaaggaggttcnccaaggaggtncccaagtaaaaaggtggggctcctgctcntgttgggctaattncanctgttgatgtggtgggtccccctngnaacactggnctgggttccncccaaangttcttcttccaagtgctttnanaatcccaacaaaganttaaaaaggggtt

SEQ ID NO: 98231 - DNA, 429 bp, Triticum aestivum
  unsure (1)..(429): unsure at all n locations
  Clone ID: PAT_TA_98231
ttcaattcaatctgcctcgatcatggagaggaaaacatttgggtttttgttcttgctcctccttgtcttagcttctgatgtgacggtgaagagagcagaggcgaaagattgcttgacaaggaggcacgggttccagggtagatgcttattcgacaggcaatgtgcacatgtgtgcaggagcgatggtttcatcggtggtcagtgccgaggccctcttcgcaaatgcttttgcagcaggccatgttgatcgaaattactactgccaaagaggccatgaaataaacaaacaaacaaataaataaatagctttaaccgacacatatgtacttagtgtcggtaggtacgtgtgtcttttgttatcgatnctagtttggtggagcaagtatggcatcaatgatctagttatatatatgtcgtgatcatcttgct

SEQ ID NO: 98232 - DNA, 346 bp, Triticum aestivum
  unsure (1)..(346): unsure at all n locations
  Clone ID: PAT_TA_98232
gcggtgccaagccatccacaatgttgttcatgctattattctgcatcaacaacaacaacaacaacaacaacaacaacaacaaccgttgagccaggtctccttccaacagcctcaacaacaatatccatcaggccagggctccttccagccatctcagcaaaaacccacaaggccaagggctctgtcaagcctcaacaactggccccaagtttganggaaataaggaactagcgctagaanacgctacctgcaatgttgnatgtcatatcccnccaaatttgcaccaattgctccnantggnttcctcggtncctaatggagaaagagaaanaactcctagtantta

SEQ ID NO: 98233 - DNA, 438 bp, Triticum aestivum
  unsure (1)..(438): unsure at all n locations
  Clone ID: PAT_TA_98233
gtgccaagccatccacaatgttgttcatgctattattctgcatcaacaacaccaccaccaccaacaacaacaacaacaactagtcccccagctccaacagccattatcccagcaaccacaacaaacatttccccaacctcaacaaacattcccccatcaaccacaacaacaagttccccacgcctcagcaaccacaacaaccatttctccagccccaacaaccattcccccaacanccacaacaaccattcccccagactcancaaccacaacaaccatttccccagcaaccacancaaccatttccccagactcaacannccacaacaaccatntccccaagcanccacaacaatcgttccctcagactcancaaccccatcaancatttccccagtccaagcanccacancaaccttttcccaagccccancaatc

SEQ ID NO: 98234 - DNA, 446 bp, Triticum aestivum
  unsure (1)..(446): unsure at all n locations
  Clone ID: PAT_TA_98234
ctcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctnagggtggtggtgatgattaagggtgtcgattaccaagccgtnaaaggtgggttgacatttgttgaanactttccgtccttcaaggagnaaacctgcntttnganaaaaacaatttaacccctnaaataagcgcttnaanaaaaaactnccctccnaagctttgaangggatgaacctaaattttttcaaaaaanaatgtttaattctgccannaaagtnac

SEQ ID NO: 98235 - DNA, 448 bp, Triticum aestivum
  unsure (1)..(448): unsure at all n locations
  Clone ID: PAT_TA_98235
gaattcctcgcgattcctctcccctcgcctcctcgtcctccccctcctaggggatcgccggagaggaatcgcgacgagggcttcctcctatcagttaaatcaaagccatggagcacaaggagaccggctgccantctcgggagggccccatcctttgcgtcaataattgtggnttcttcggcagcgcggngaacatgaacatgttctccaaagttgcaaaagggagaatggcgaataaacaaggagcanggaaagctgggcgcctcctctttcgaaaagcaatccgtcaaacggtgggcgaatncccgccaaaagaacatctttgctgcttggcaacaagggcggtggcanttgctcaacgtttagggngaaaaaccttaataacgcanancccgctgatatcgctgggccaaagcgaaggggngaagggcaaacccaaagggccaag

SEQ ID NO: 98236 - DNA, 465 bp, Triticum aestivum
  unsure (1)..(465): unsure at all n locations
  Clone ID: PAT_TA_98236
acccgccccgtttatcaaaaaaaaaaaaattcaccgaagccccgatccagatcccctccaccggggcctccttcgacctcctctcctctcccaatccactgcagccggccggccttcccctcccccctccgaccgctagctgctcacccccctccctcctccgaccgctagctgctcgccccactccctccccgtgagaagcttggtccagcaccgagcggcgccgagagctgtccgcgtcgggcgctgttggcatggagagcagcgcggcggcgcggatggatcctgaggcggcgacggagctggcgcggaagggggtcaccctcctgctcctaaacgtgccccancaaaacctcctcgggctcgaaaaccangtgttctcgggtgaagccccaangttcaaaaggggattnaagatgggggccccaaggcccanaatttcctncnactaatggntcccccaag

SEQ ID NO: 98237 - DNA, 465 bp, Triticum aestivum
  unsure (1)..(465): unsure at all n locations
  Clone ID: PAT_TA_98237
gcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatccgggttcaatgttgaaactgtggagtacaagaacatcagcttcactgtctgggatgtcgggggtcangacannattnaggccactntnggaggcattactttcaanaanaaaaangggtcncatnctttgttttttgnanancaaccaatangggaaccgtttttnttttaaancaangggaattagctcccan

SEQ ID NO: 98238 - DNA, 479 bp, Triticum aestivum
  unsure (1)..(479): unsure at all n locations
  Clone ID: PAT_TA_98238
attcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttggactgatggacttaccantcttgatcgttacaaangacgatgcctancacatcgagcctgtttgctggggaaagacagccaatgggatntgttatggtagcctnatccattaagacctattttgaaagaagggntcccgtttcctaacatgtttaacttccaattgtanggtaaccgntatttggtttnaaaaagccctnacgttgcctcntacntttnggggggatttaaccaattccccccc

SEQ ID NO: 98239 - DNA, 475 bp, Triticum aestivum
  unsure (1)..(475): unsure at all n locations
  Clone ID: PAT_TA_98239
accattttcgcaacaacaacaacaaccaccatttgcgcagcaacaacaaccaccgttttcacaacaaccaccaatttcacagcagcaacaaccaccattttcacagcaacaacaaccacaattttcacagcaacaacaaccaccatattcgcagcaacaacagccaccatattcgcagcaacaacaaccaccattttcgcagcaacaacagnccaccattttcgcagcaacaacaacagccaccatttacacagcagcagcagcagcaacaacaacaacaaccatttacacagcaacagcaaccaccgttttcacaacagccaccaantttcacagcaagcaacaaccaacattttttgcaagcaaccaacgaccaccattttccacgggcaancaacaaaatnncaagtttattcatccatnctggttttgcaaccaagctnaaccccatggcnagggnantcctcccancnng

SEQ ID NO: 98240 - DNA, 459 bp, Triticum aestivum
  unsure (1)..(459): unsure at all n locations
  Clone ID: PAT_TA_98240
agaacaaataatttcccagcaatcccaacaaccattctctctgcagccacaacaaccattttcccagccccaacaaccattatcccagcaaccaggacaaataattccccagcaatcccaacaaccatgccccctccaaccacaacaaccatttccccaaccccaacaagcattcccagaacaagcagaacagataattccccagcaaccctaacaaccattccctctgcagccacaccaacctcagcaaccttatccacaacaacaaccatctggagtagcggtataggcatcaggggccaattgaaacgaagagctatagtactagaccggtgggatcatccgcgtttagtcaatggngtgttcangtggtacgaatgatnaattaanagntgatgnggtaccattcatgtgttaacaaccgcccctatattattttcaanaccttgnggaatttca

SEQ ID NO: 98241 - DNA, 215 bp, Triticum aestivum
  unsure (1)..(215): unsure at all n locations
  Clone ID: PAT_TA_98241
gccgngtctcccttctctctctcgctcgcatctctccatcgctcctccttctcttcgcgcagccgccgctcctctcngcctccctcctcctccanaggattgcggccttccntcccttgtgntatcctctcacggcnatgaacggtggcgagctcgccgttgccttcatcgggagganagcggaccgacggncctgnagcatcnccatcgacggc

SEQ ID NO: 98242 - DNA, 466 bp, Triticum aestivum
  unsure (1)..(466): unsure at all n locations
  Clone ID: PAT_TA_98242
cctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaagaagccggccggcaaangcgaagcacgaaggattnaggaggacaaagcaaagcaaagcaacatcaacaaccaagttcaacaacaaccagccgttntcatcaacangccgccgcaatgcgctncccggggcgcgccgccctt

SEQ ID NO: 98243 - DNA, 461 bp, Triticum aestivum
  Clone ID: PAT_TA_98243
tgaaagtggacctgcttataactcctgaatttgtgtggaaggatcgtcaccatggcatgtcacaacgatggttgattattgtggaggattctgaaaatgatactatttatcattcggagctcttcacactgacaaagaagatggcaagaggtacacctacaaaaatgtcttttaatataccgatcttcgagcctcatccgccgcagtactatatccgagctgtatcagactcctggttgcatgcggagtcaatctttaccgtctcttttcataatcttaccttgcctcagacacaaataacacacactgaacttttggacttgaagcctcttccactgagcgctcttggcaacaaagcatacgaagatttgtatagattacccatttcaatcccatacaaacacaaggctttccaatgttccttaacacactgaaactaaagtgctcttgggaagcaacca

SEQ ID NO: 98244 - DNA, 478 bp, Triticum aestivum
  unsure (1)..(478): unsure at all n locations
  Clone ID: PAT_TA_98244
agcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccaagtttttaccctccacancaaatcaacttttttccaacaaacaaacnaccaaacaccaacngggtgggtgcaacaaaccaaaancccctggttgttcaagccatcccatttttggcngcaa

SEQ ID NO: 98245 - DNA, 463 bp, Triticum aestivum
  unsure (1)..(463): unsure at all n locations
  Clone ID: PAT_TA_98245
tttttttagtaacaagaaatgatttgagtcaaggagattgtattttaatagttatgtacaacaaaactaattaaggtttgtttcatgcctagattttcatttcgtgcttcaggagattaattaacatggccaagatgaacccatgtgtttgcagtggcctggcaagagccctccctccacaaccaaacaaccaaatcgttagcgcttgcactttttgcagtaatggttttccgctgacaacttggatgcacatcggtagcagaaactgtttccacacctgcatttcatgtaattgcagccctccgatttctccacgaacatccggcacttggggcaacgctgccaccccttcctgcccacgaggcgccggagcaagagctcgttcccggccgcgctcgtcctggcccgagncttctggaactcctcgcaacccaaagcccgtcgtgccaacgggaacgcccga

SEQ ID NO: 98246 - DNA, 382 bp, Triticum aestivum
  unsure (1)..(382): unsure at all n locations
  Clone ID: PAT_TA_98246
gcaacaactgggacaagggcaaccagggtactacccaacttcgcagcagtctgaacaagggcagcagccaggacaaggaaaacaaccaggacaaggacaacaagggtactacccaacttctccgcaacantnaggacaagggcaaaaactgggacaagggcaaccagggtnctacccaacttctccacaacaatnangacaaggacaacaattangacaaggncaacaanggttctnaccaacttntccncaacaatcaagggacaaggggcaacaaaccgggaaaaagggcaatncgggggtactttcccaacttctcggcagcaantcangggacnaaggggcanccaanccanggacaaagggacaaacaantccggga

SEQ ID NO: 98247 - DNA, 395 bp, Triticum aestivum
  unsure (1)..(395): unsure at all n locations
  Clone ID: PAT_TA_98247
ctcccttccgccgccggatcgttgctctcgcgactccgcggccgcaaccatgggcggcaccatggtgcttccgcctgctctgctcccgcgccgtagcgccgccgccgccgatctgcacgcctgctcctcccgcgtgcgcgtgaaccccgccttgatggngaaccccgcggctgccaagaggccaaagngtcccggatccgtgcacgacgtgcagccgccggcgaagcgcgtacgcggtgcctgctcggggggcgagctccatgccgtggtcccccgccaacatcaagaacaagcaagcttccgtgtcccancancggcnaggatctgaanaagtccgacntgncctccaccgttcnggggatcannaaccaagtcgccgaannccccaggcgaag

SEQ ID NO: 98248 - DNA, 263 bp, Triticum aestivum
  unsure (1)..(263): unsure at all n locations
  Clone ID: PAT_TA_98248
atagcacgccgcggccccttccatctccacacgcattccgatctcctctcccctcctcgtggcttcgtcgtgcgcgcgcgcgggattccctctcctagatctcggaggaggagcgcgatgagggcgacgcggctcctggcggcggcggcgctcctcgccgcgctgctcgcggtgtccgcggcggcggcgaagctcgatctggacgaggtggacgactcggaggtgctggaggcgctgctggccgtgggacgaggangacgatg

SEQ ID NO: 98249 - DNA, 475 bp, Triticum aestivum
  unsure (1)..(475): unsure at all n locations
  Clone ID: PAT_TA_98249
agacactgctgtggaacaaccaccaaaattaaaacgtcaaaagaccggatctaacgaggataagagaaacagggcatcgcctgcaaggcttttcaagctgaataaacttcttgtacctgttcaacaaggccaagctcaagtcactttcagtcaatttctgacaccaagaataaacagacatcctcaacttgacaagcaagcaactacagagctcanagttaagatntgtagctgcacacactacaaacacatcaaggtntccaaataaacgctgttctggattgaaaaaaaancnttgatgaaactgaaaattcaagccaagtagtgtacaatataanaaccctgaactgnaaggngggccccccttggggtgtggggngtgcgnccaaaaaaactnctgaaccnctgnaactggaaccaannnagaaatttnttaatccaaaaagccaatttnnggctnatttgggaaaanatt

SEQ ID NO: 98250 - DNA, 459 bp, Triticum aestivum
  unsure (1)..(459): unsure at all n locations
  Clone ID: PAT_TA_98250
attttagctataaataggcatgtagcatgatgatcatccttcctcatccatcattctcataagtagagtgcatcattcaagccaagcaagcagtggtcaatacaaatccaccatgaagacctttctcatccttgccctccttgctatcgtggcaaccaccgccacaactgcagttagagttccaatgccacaattgcagccacaaaatccatctcagcaacaatcacaagagcaagttccattggtgcaacaacaacaatttctagggcaacaacaacaacaatttcctgggcagcaacaaccatttccaccacaacagccatatccgcagccgcaattatttccacagccgcaacaatttccgccacaactaccatatcccgcagcccgcaaccattttccaccanaancaatcnatatncacaatcgcaaaccaaaagtntcccgnaaacnnaaaaa

SEQ ID NO: 98251 - DNA, 455 bp, Triticum aestivum
  unsure (1)..(455): unsure at all n locations
  Clone ID: PAT_TA_98251
taaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggacccgcaagatagcgtgcaggtgcctcaagagcctcgccaccaacatcaagtccatcaacattggcaangtctccggcgttgcccggaaattgcggngtcagcgtgcctttcccaatcancatgtccaacaactggaaaaaatgtcaactattttaatntnn

SEQ ID NO: 98252 - DNA, 476 bp, Triticum aestivum
  unsure (1)..(476): unsure at all n locations
  Clone ID: PAT_TA_98252
ctcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcaacctgatggccagatgcccggtgacaagaccgttgggggaggtgatgatgctttcaacaccttcttcancgaaactggtgctgggaaacacgtcccccgtgctgtcttcgtaaatttccaacccaatgtngattgatgaagtgaggactgggcgcttaaccgccaagctcnttcaanccttgaaacaaacttaatcaattggcaaanggagggattcaaaccaaaaaaanttcccccgttgggcaattaaaaccaattggnaaaggganaattgttgatttccggcccttggattc

SEQ ID NO: 98253 - DNA, 429 bp, Triticum aestivum
  unsure (1)..(429): unsure at all n locations
  Clone ID: PAT_TA_98253
gcccactgtaccactcactcactgtccatctacctcactagatctgtccatcgccgtcgatcgccacctccatatcactccaccatttccatcccactgccactccaacggtccagcccatcccatcccggcagcgtcagaaatggcggctccgaccaccgtgctcctcctcctcctgctgctgctctgcgccgtcgtcgggccgcactcggcctacgcggacgcgctgccggagccggtgaacgaggaggtgctggggctggtggtgttccgctccgccctcaaggacccctccggngccctcgccgcgtggggcgagtccgacgccacgccctgcgggtgggcccaagtggagtgcgaaccangcancgnccgcgtggtccgcctcgcgctngaagggctcgccctctcctccggctccgggctggc

SEQ ID NO: 98254 - DNA, 435 bp, Triticum aestivum
  unsure (1)..(435): unsure at all n locations
  Clone ID: PAT_TA_98254
tctcttcctccttcctctccgaccggccggcaccaccgacgccgtttccctccgcgcagctccacgctgcctgcgcctcctccccctcccccacagttcctctccctccccagcgccggcgccctctcccttgcgcgcgttaccggcgctctcttcctctcgcatgtccctccgcatcggtaaaaatccgattttccccctccgggtcttcgatntgcagcggtcgtgctcantctgcggnggagagtaccaatacggggcgacagaagctacttctgccggtcgcctgcaaggggctgctgctgcttgtcgtcaggtctgactacgaagtggctacgggccangcaacaacggnggcgggaatgtggcggggaaactccnaanatgtttctccaaccgctctaagactccancggcaaagcanaacaaacctca

SEQ ID NO: 98255 - DNA, 171 bp, Triticum aestivum
  unsure (1)..(171): unsure at all n locations
  Clone ID: PAT_TA_98255
gcgggnaccacggcggtgctcttcctcatcgccacctgcgccgccgcctccgcgctcgacgcnttccacgtcccctccgtcgaagcctaggcccacgttacnaangataactcgnttccacanaccagatcatttnggaattgncaanggtgaccttgagccttcagtcta

SEQ ID NO: 98256 - DNA, 432 bp, Triticum aestivum
  unsure (1)..(432): unsure at all n locations
  Clone ID: PAT_TA_98256
atgaacccctgcaagaattacctcttgcagcaatgcaaccctgtgtcattggtgtcatccctcgtgtcaatgatcttgccacgaagtgattgcaaggtgatgcggcaacaatgttgccaacaactagcacagattcctcagcagctccagtgcgcagccatccatggcgtcgtgcattccatcatcatgcagcaagaacaacaacaacaacaacaacaacaacaaggcatacagatnatgcggccactatttcaagctcgtccagggtcagggcatcatccaacctcaacaaccaagctcaattggaggtgatcaggtcattggtattgggaactcttccaaccatgtgcaacgtgtttgttccacctgagtgctccaacaccaangnaccatttgccaacatagtcnccgacattgtgggcaatgaaaaat

SEQ ID NO: 98257 - DNA, 467 bp, Triticum aestivum
  unsure (1)..(467): unsure at all n locations
  Clone ID: PAT_TA_98257
ctgcgcagcgcacccatccccgccgcccatacctgccgtcccctgcgccacccatccccacctcgctccgcccgccgcctccccttcacgccggcgcccactcgcctcgcctgcaccggtcgccacgcgctcgccccgcaaggcaaggagctcccttccccagcccgatctgatggaaagaggtccaagccttaacggtccggtgttcgtttgtgggccatatccggctgtgggagccaccgtagagcctccatgtcggtggagcagagcaagcccgacagaggtgggtgcctgatctcgtcccgcaagattacctccactangttgcccccgggcggntccggaccccaacctggcccctcccctcgaaaccaagcgaagcctccgttcccggcctannttccggcgcgangtccgncctccggcctccctcctggggggaacggccgcccccaaacaatcttggg

SEQ ID NO: 98258 - DNA, 441 bp, Triticum aestivum
  unsure (1)..(441): unsure at all n locations
  Clone ID: PAT_TA_98258
gnagccagcccgacccggtgcagtgcatatgaactgantctggtgctcgtggctcccttgcgcancgtctcctccaccggatcaccgccatggcnacggcgcgcgctgttgccgcgtccatgaggctcacctgcgcgctcagcaccttanccatcctcgccaccatcctcttcangctcctcctgctgatcgctggtgccttgcacctgcgtgtcccnaccgggntacgtggtggtcgactgcgccccgcccccgccctcggacgccgccgctgctgccttcctcgaaagcctcctgccgctcctggccgcgntgcccgctgtcgccgcgccnaaagggtttcgcgttcctnntattcnagaggggggggcgttancccggggggtctgtnttggggcggntcccacccttnaaggantngcctccccgtngcctcgcccg

SEQ ID NO: 98259 - DNA, 211 bp, Triticum aestivum
  unsure (1)..(211): unsure at all n locations
  Clone ID: PAT_TA_98259
gccgccacagcctccagctccaaaccctcatctcccccatccaanctcactgcccccaaccccccacccccacccagccatggtggaccgcggcggtgagcgtggtgtcctgcgancgcggcggcgaccgcggnggnttcgggcgtggcttctgcncncggcgggccgcggngancgtggcgggcnncntttgttcttntctnnttctccc

SEQ ID NO: 98260 - DNA, 446 bp, Triticum aestivum
  unsure (1)..(446): unsure at all n locations
  Clone ID: PAT_TA_98260
gcgaaattatgctacaagactagagcaaaaatgacacgaaagaaccaagaattccgaggaggaagaagaagaagaagaactggcctatacatatgctatatctatgttactggcacgcatagatgtatgagcaagcaggcaggcgtcgatcgatcgatcctccattgtaagtcctttccggccgggcantcnagcgggtgcgccgccncggaaagcaggaacanaagaggacgatngatcctttcctcgctgaagaacccaatcgggccgcctgccggtnaatccgtcccaagaaaccaanaattgaccccnccgtcctccgccgggccgccctcaattgttcannccggttttggggccccgttggggggacccnccccctttggnanactccgntancgcaaanntcaacctncctcccccggcccggggcgggggggcaantg

SEQ ID NO: 98261 - DNA, 480 bp, Triticum aestivum
  unsure (1)..(480): unsure at all n locations
  Clone ID: PAT_TA_98261
agtacagccatggcccccaccgtgatggcctcgtcggccacctccgtcgctcctttccaggggctcaagtccaccgccggcctccccgtcagccgccgctccaacggngctagcctcggcagcgtcagcaacggtggaaggatnaagtgcatgcaagtgtggnccaaccagggnaatcaanaaattngagaacctntcttaacttccaacgctnaacaacggngggcctcctcaaagcaagtgggactaccttaatnccgctccaagttgggttgccttgccctttgaagtttaancaaagggtccggggtttcaatccttcccgttgaagcaacaaaatgccgtcctccccggggttactnacnaacgggccgcttactgggacaattttgggaagcttgcctattgttcgggttgcaacccgacccccacaaaaaggttaatnaaaccaanggtggnngggaaggtcaaaaaaangan

SEQ ID NO: 98262 - DNA, 423 bp, Triticum aestivum
  unsure (1)..(423): unsure at all n locations
  Clone ID: PAT_TA_98262
aatgaaagtagaaacacatcaagagatgacttgtaaaacagagtcgatacgcacatggtcgaaatcttacatagcagatcgatacaacaataggtcaacatcttacatagctgatcaaatacttgaacagacaaaatactacttgcaaaccagagaaatagatagatataacaggtatacttcataacattcacgcccgagcactgtcaaacatatatccctctcaaanaataaccttgttggttcgaagaataggtgaccaagcaatggtnatcttcaccgtaaagccggcaaggacacattcatgttcacttaagccgcaatactgaggnttgaccatgaaatcaactttcncanaaactttaagaggagagtcctggagggaaagtctgagttaggcttctattaaaaacaatcaaaggt

SEQ ID NO: 98263 - DNA, 439 bp, Triticum aestivum
  unsure (1)..(439): unsure at all n locations
  Clone ID: PAT_TA_98263
ggtacctgactcattatggagttgaaatcggtaggaagaagaaagctgctgcagctgccaagaaggaagctgctgagggacaagaggctgaggttgctgctgctgccacagaggaagcaaagaagagcaacaatgtccaagaggaagcttgagaagcgccagcagggacgtacactgggactcgcacattgaggagcagttcagtggtggaaggctgctggcctgcatttcgtctccgcccttggacaagtgtggcaagagcttgatgggtaaaatcctgggagggcaagggagcttgggagttcctacattgaggaaagctccaaaaaaaaaangggcaagggtgccacancttaaaggccaaaancttctncatgttactcngtggnttttccttaaattttgcgtccatntnatntttgcanacattntgaacaac

SEQ ID NO: 98264 - DNA, 441 bp, Triticum aestivum
  unsure (1)..(441): unsure at all n locations
  Clone ID: PAT_TA_98264
ctcctactggagtaacttgctagcgatggcctcctcctcctcctctgtcgccgtcgcggcggccctgctgctctgcatcctcgccgcgcacggccacggctgctgcgccaagcgcagcagcaacagcggcggtaagaagtcccactcccaccacgcgcccccgcacgcccacggggcgccgcctccttcttccccgccgggccatcgggtccaccgtcctacgggctacggattccctcctcccccgggctgccatccccgcctcctcctgcgggcaaccccgtcccctncccgngggccaattccaagctccaanaagcaacaaatgttcnacgccgggcgggctgggctccaacgccaagggccaactgggtanggggcgcccaaaggggcgccgggcccgaacgaaaaaggggggggcctggnggttnaagaacgtan

SEQ ID NO: 98265 - DNA, 407 bp, Triticum aestivum
  Clone ID: PAT_TA_98265
gccgccgccggcccctcccgatcctgtcctccgcctcaccccctcctctcccctcaaccaaggacgacggagatccagtcctcaccccacgcggcaacccttcctcccacccaccgccgacctcgccgtcctcctcacccaccgcccacctcgtccctccctcccctcaccatctctccctaccctctgcctgcttcccctgcctcatccccagatccaatcgacacaaccccgctgcccccgcaccccgtactgtccaccatggccgcctcctcctcctccccgcaccaacccatcaccccgtcgtgggggcgcgtccgtggcggctacccttccacgccgtctccgtccgcccctgccgctccacagtctcctccgaatccgcatcctccccgcagcaggcgccg

SEQ ID NO: 98266 - DNA, 428 bp, Triticum aestivum
  unsure (1)..(428): unsure at all n locations
  Clone ID: PAT_TA_98266
agcacatccatggccggcgctggcaagcaggccatccgcgcgggcggggagcagggcggccgcgcttggcggatgcgcgggcggtgagcagggagaccccacgggcggggagcagggcggccgcgcttggcggatgcgcaggcggtgagcagggagaccccgcaggcgtggagcagggcggccgcgctggcagcgagcttgccggacgcgcagacgacgaagcttgccggacgcgcgggcaacgagcatggcgcgcggcggcggctcactccaccgtcgactgctcagcgcaggggcgcggcggcttcttccctcgggcgcgcggcggcctcttccctcgagcatggcacgtgacgggcaacaaagaggaactcctccctccggcgtccggccaaccngacgcttcactggcgcccgggcggtncccc

SEQ ID NO: 98267 - DNA, 360 bp, Triticum aestivum
  unsure (1)..(360): unsure at all n locations
  Clone ID: PAT_TA_98267
gccgtacactccagcttgaccccaccggtcaatcgcctcaccacccacctcctcgatgcagcccgccgcctcccacgtgacctccactctccgccgccgcctcctctccgcctcccggcggcctccctgcctcccccctccgacctccccgcccgtctcccgcggagccgtgacggaggagagggacccatggagctcgccggcgaccacctcgagctgctcccccancgccccgccgccgggtgctgctcccgccccccgccccctctccgctcccgtntncgggaactggncgcancancaggtctancgcctcaangtnccccancaccaagtttatnctntgaggggtagggactc

SEQ ID NO: 98268 - DNA, 420 bp, Triticum aestivum
  unsure (1)..(420): unsure at all n locations
  Clone ID: PAT_TA_98268
gtcgccgcccggagacggccgcaccgtgcgccgccgcgcgctgggtaccacgtgcgcaagcgccgcgcgtgggaaggccgcgccatggccgccgtttcgggctgccactgctccaggtggttgcgccgccagcgttgccttgctttgctgacacgcatggagcaagtcaccgacgccggagggacgagccgccgcggcgcgcgcgcttcaggcgtcgccggccggaagccgacacaattccctcggcaggcgaggccatcgaaaaagtcgctccgcgtcggatgcggtgtccgcgtcgtgcgacaggaggcttcaacgcggnggccacaagccgttgggcactgctaccttcgaccgccacaacctgctgccgcgttggcgccaacgccgcaattaccgacaagccaaatgggttccccg

SEQ ID NO: 98269 - DNA, 425 bp, Triticum aestivum
  unsure (1)..(425): unsure at all n locations
  Clone ID: PAT_TA_98269
gccacacgaaccccccacccaacccgagcgagcaccggccgaggaggaagaggaaggtgagatggctcgcggcacggcggcgacggcggcggcggctgccaagggcaagaanaaggggtccgtctccttcgtgatcgactgcaccaagcccgtggaggacaagatcatggagatngcgtccctngagaagttnctccangagcgcatcaaggtccccggcggcaaggccgggaatctcggcgactccgtcaccgtcacgcgcgacaagagcaaggtcancgtcacctncgaagggggccttctncaanaggtncctcaagtnctttacaaanaagttctttaagaancacaacntncnggaatggctttntntgattncnaccaacaaagaacgcaacctnttccaactnccgttattnaaaatt

SEQ ID NO: 98270 - DNA, 426 bp, Triticum aestivum
  unsure (1)..(426): unsure at all n locations
  Clone ID: PAT_TA_98270
gcgagagcatggcggccacgagctccgcggcgctcttctccgtcctccccctccccacagccaccccggtctccgcccgggcaggcagcagcctttgcaggccgacgcgctcanccgcggccgtctcccccatcanatgctccgcagcctcgcccgacctgtcgcccggcgctccggcgccggcgccgcccaagccccaaatcgagctcgagttcgtcgggcctaagccgggcgccgacgggtcgtacccggtggacanggcgggggcggttaacggcgaaaagctcctccgggacgtcatgcttgagaacaagctcnagctctaagcggcatacgggaagctgatgaactgcngggggcgggggcaacttcggganctgcctcntccaaataatccaccggaaagaacttctngagcccaaagan

SEQ ID NO: 98271 - DNA, 428 bp, Triticum aestivum
  unsure (1)..(428): unsure at all n locations
  Clone ID: PAT_TA_98271
cggnggccgccccggccccgtcggcccccctctcggcaccgcgcgtccctcgtcgctcaccaccgcagccccccgcttgcaggttcagagtggagaatgggggtcgtcgacgcgcgcacacccccatggctgcgacggcggccgacccgctgctcgccgccccggntccccctgccggngctggctccgttcagcatctgaagccctcggcaactagcccctcgggcctcccatccctactcccagccatggcagatctggcccccgcctcccgctgcatctgccgcctccgacgggccagatccccttgcctggcgttcaggtanaggatggggaagttcgccgcgccgtcgccgccggcgggccttgtctccggagatgctttgcttcagcctattgtcgtggtgggtgatgaatctacctgcagt

SEQ ID NO: 98272 - DNA, 405 bp, Triticum aestivum
  unsure (1)..(405): unsure at all n locations
  Clone ID: PAT_TA_98272
gctgcccacgacggccacgacctcaccaggatcctctgcgctgcgctacccacatttcgcacccacaccgcaacaaactcgtcgtcgccgtcgtcgccaggaaacgcatgtgacccgctgcggtttgaggcgaattctctgctggtgtccgtgtccgtttgatgctnaaggaggacaggtggggagggacggaggggatcatggacttcacgancagcaacggcgggtcgtcctcggngcgcncgccggcggagggggccncgctggccantgcangggnccatccactcccctnacgttcgatgagnttccagtgctancgctccgntngggggccgcctgtatttgnaaggcnnccnaacctccnggtaanngcttttcannnctccatttaaaaatnggacg

SEQ ID NO: 98273 - DNA, 425 bp, Triticum aestivum
  unsure (1)..(425): unsure at all n locations
  Clone ID: PAT_TA_98273
aacaaagacagcaaccaggacaagggcagcaactaagacaaggacaancatttccacagcagccatatccacaacaaccatatccatcacagcatccatatccatcgcaacaaccatttcccacaccccaacaacaatttcccgagcaatcacancaaccatttacccagccccaacaaccgacccccatacaaccacaacaaccattcccccancaaccccaacanncacaacaaccttttccacaaccccaacaaccatttccctggcatgcacaacaaccatttccccaagaccgcaacaatcatttccccangcanccacaacaatnattcccccagcatccgnancaaccattccccctgcaactgcaacaatccattcccccanncaaccacattcanccattcccctcaaacaaannt

SEQ ID NO: 98274 - DNA, 422 bp, Triticum aestivum
  unsure (1)..(422): unsure at all n locations
  Clone ID: PAT_TA_98274
atgaagaccttactcatcctaacaatccttgcgatggnaacaaccatcgccaccgccaatatgcaagtcgaccccagcggccaagtacaatggccacaacaacaaccattcccccagccccaacaaccattctgccagcaaccacaacaaantattccccaaccccatcaaacattccaccatcaaccacaacaaacatttccccaaccccaacaatcatacccccatcaaccacaacaacaatttccccagacccaacaaccacaacaaccatttccccagccccaacanacattcccccaaacanccccnactaccattttccccnaacaaccccaananccattcccccaggcctcatcannccccaacaancattttccccagntcaaananaancacaacaaanctttttccccang

SEQ ID NO: 98275 - DNA, 395 bp, Triticum aestivum
  unsure (1)..(395): unsure at all n locations
  Clone ID: PAT_TA_98275
gtaacaactagagaagaagggggccaaaaatccaaaaaggcattaggcttgcagccactccgccgacatgacagtcttagtacgcggcaccgcgtaaacacccattgtggcggcgaccactgacactgacaacaacgtggcttttcaccgagcggcggccctgacggtggcagcacccatcacataaggcaacgctccgcaccagatctctgttgtgcacacccatccgatcacacccgacggtgttccctgagccatggtgtgtgccttctcctcccctagatcatctcaccaattacttgcacaccatcgccgcatgatccaccngnaggaatgtacannaatagatcancctacnaaagatactgccttacnttctgattgctccatcaatc

SEQ ID NO: 98276 - DNA, 277 bp, Triticum aestivum
  unsure (1)..(277): unsure at all n locations
  Clone ID: PAT_TA_98276
atcaaaaccaagcattactagttaacaccaatccaccatgaagaccttcctcatctttgctctccttgccattgcggcgacaagtgccattgcacaaatggagactagccgcgtccctggtttggagaaaccatggcatgcaacanccattaccaccacaacaacaaccaccatgttcacagcanncaacaancatttccacaggnaacaacanccanattattatactgcaacangtcaccattttcgcanncaacaacantcaagttctgccgca

SEQ ID NO: 98277 - DNA, 423 bp, Triticum aestivum
  unsure (1)..(423): unsure at all n locations
  Clone ID: PAT_TA_98277
ttttttttaagttaccacatacattatacttactagagtaattaatctcttgatacaaggtaattcaaaaaacaccccatcaagaacaggagcatacgcgcgcacgcaggcacgtaacgtacagtacgtaaaccctagatatatatctagtaggaccacacaattaaagcttaatcaacatcatcttcttcacctgaatcggtcgacggctggaccccatctcgcaccgcgtccatcgatctgacggccacatcacggtcacgccaccgaccatcgctccagcatcacacaactcttcttcctttgtcttctagtagtggtacgtattttcccagccaggaaatantagtattggagggaaataattaacagtagcaacggcacgccgggatcacgtacntgcgtacgcggcgcggtggggtt

SEQ ID NO: 98278 - DNA, 452 bp, Triticum aestivum
  unsure (1)..(452): unsure at all n locations
  Clone ID: PAT_TA_98278
gaagcgttctgtggccgcatcgaccgagaaatctgagcgtgatacgagaagtacagtgaaggctagaagaaaaagttctttgccttcttcagccgaggaacctgaggacccagaccgtgataaaaatgatgcaatgaagactagagggaagcgttctttgcctgcatcagctgagaaacctcaggatcctgaccgcggcacaaagggtacagcgaagactaggggtaaacgctctctgcctgaatcaactgaggatcctgaccgtgttacaaagggttcatcaaangactaaggggaaaggttctctgcctgaatcaactgaggaaccagagggtcctgatgaccgtgatatgaaggattcaatgcacaccangaaacgaaagaagctcgacacattgggggattttgtcttcccaagccacaagcctgtttctcccnaagggttccaccan

SEQ ID NO: 98279 - DNA, 367 bp, Triticum aestivum
  unsure (1)..(367): unsure at all n locations
  Clone ID: PAT_TA_98279
gcaacactagttaacaccaatccacaatgaagaccttcctcgtctttgccctcctcgctcttgcggcggcaagtgccgttgcgcaantttcacagcaacancaagcaccgccattttcgcagcaacaacanccaccattttcacagcaacancaacnaccattttcncagcancaacantcaccattttcncaacacncancaacanccactatttgcgcagcaacaacatncaccgttttcacaacantcaccatgtttcacangcagccaacatccaccattttcacancaacaacatcccacanttttcacagcaacnncaaccaccactattccgcagcacgcancagncatnacnttcgcag

SEQ ID NO: 98280 - DNA, 447 bp, Triticum aestivum
  unsure (1)..(447): unsure at all n locations
  Clone ID: PAT_TA_98280
agcatcagaaccaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacanccatcattttcgcagcaacanccaccattttggcagcaacaaccaccattttctcaagcaacanccaattctaccacagcanccaccattttcgcaagcaacaacaactaagttctaccgcaacaaccaccatttttcacagcaacancaagcagttttacctccacaacaatccaccttnttccacaancaacaacaaacacccagcagctggggtggcancancn

SEQ ID NO: 98281 - DNA, 454 bp, Triticum aestivum
  unsure (1)..(454): unsure at all n locations
  Clone ID: PAT_TA_98281
gnncangggtttnaccaanccaccacgggngagccttcctcgnctttgccctcctcgccgttgcggngacaagtgcaattgcgcagatggngactagatgcatccctggtttggagagaccatggcagcagcaaccattaccaccacaacagacatttccacaacaaccactattttcacaacaacaacaactatttcctcaacanccatcattttcgcagcaacaaccaccattttggcagcaacaaccaccattttctcagcancanccaattctaccacagcanccaccattttcgcagcancaacaactagttctaccggcaacaaccaccattttcanangcaacaacaaccangttttanctccacaacaatcaaccttttccacaacaagcancancaccancaggttggtgnaacaacaaaatccctggttgtttcagccatccan

SEQ ID NO: 98282 - DNA, 412 bp, Triticum aestivum
  unsure (1)..(412): unsure at all n locations
  Clone ID: PAT_TA_98282
gtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaaggacgatgctntcacatcgagcctgttgctgggggaagacagccaatgggntctgttntgtagctnatccatttagacctatttnaanagggggttcccgtttacctaacatgtttaaccttccatttggancggtancgttantttggtttcaanancccctaacngtg

SEQ ID NO: 98283 - DNA, 445 bp, Triticum aestivum
  unsure (1)..(445): unsure at all n locations
  Clone ID: PAT_TA_98283
ctggttnacaccaatccaccatgaagaccttcctcatctttgctctcctcgccattgtggcgacaagtgccattgcacaaatggngaatagccacatccctggnttggagagaccatcgcagcaacaaccattaccaccacancaaacattatcgcaccaccaacaacaacaacccatccaacaacaaccacaaccattttcacaanagcanccatgttcacagnaacaacaacanccattatcgcagnancancaaccaccattttcacangcancaaccaccattttcgcagcancaacaactaccaccattttcacagcaacantcaccgttctcgcaataacaacaaatagtactacnacaacaaccaccatttttgcaacaacaagcaaccaaagttctaccggcancaaccaccattttcgcagcaacaacaacaaccc

SEQ ID NO: 98284 - DNA, 481 bp, Triticum aestivum
  unsure (1)..(481): unsure at all n locations
  Clone ID: PAT_TA_98284
acaacaaccagttctaccgcaacaaccatcattttcacagcaacaactaccaccattttcacagcaacaatcaccgttttcgcaacaacancaaatagtactacagcaacaaccaccatttttgcancaacaacanccaagtctaccgcaacanccaccattttcgcagcaacaacaacaactagttctaccgcancaacaaataccatttgttcatccatctancttgcagcagctaaacccatgcaaggtattcctccagcagcaatgcagccctgtgggaatgccacaaagtcntgctnggtcgcaaatgtttgcantcagaggcangntggncatgtgagtgcaaccaccaatggttgcccngcnagtttgcccgcaattccccccaagcaaatccccgcctatgnaggcaagnccngtgctnatcatcttnctcccaatcattcctggcaaaggancaaacaaccangggtcangg

SEQ ID NO: 98285 - DNA, 335 bp, Triticum aestivum
  Clone ID: PAT_TA_98285
gtccaacctcaacgtctgccccagctcaaggaaataaggaacctagcgctgcagacgctaccagcaatgtgcaatgtctacatccctccatattgctcgaccaccattgcgccatttggcatcttcggtactaactgagaagagaagaactctagtactagatatatgaaacaccgtgttcttagtccatggtttggtcgttgtaccgttgaaaatataaggtgacatgcactatcatgtaagaacccgaactatactagttcaaacttgggaataaaagacaaacacatgtcttgtctgcaaaaaaaaaaaaaaaaaaaaaaaaaaaaaaaaaa

SEQ ID NO: 98286 - DNA, 441 bp, Triticum aestivum
  unsure (1)..(441): unsure at all n locations
  Clone ID: PAT_TA_98286
caaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacanggcatacaagatctccgggcactgtttcagctcgtccaaggtcaggggcatcatccaacctcaaacaaaccagcttaatttnagggtgng

SEQ ID NO: 98287 - DNA, 437 bp, Triticum aestivum
  unsure (1)..(437): unsure at all n locations
  Clone ID: PAT_TA_98287
gtgcatccggtcgggatacacttcactgggcgtgactcggagtttgagaacatggcctgtgaaaaagacccccttgggcgtgtgtatgcaaccatgagaatcatcaaccataggcgtggcatggcggagagcgtccatgttaacgtgaaagaagatagcctctatgatggcatggatgggcacaagagtaagtatgacatcgatacgggttccttgagcatgaaggaatacgtgttattgataccagcttgtggctatttataaggtgttgtggcattggaaaatactgtgatcgtgcaagacaatttcagtttagcaagctttcaacttgtactattagaatatcctatgatgtgtgttagtaaacggtatttgaatgtgggagctgattgtgttattgcagtttactcctaagactctagaccaaatttgggatn

SEQ ID NO: 98288 - DNA, 434 bp, Triticum aestivum
  unsure (1)..(434): unsure at all n locations
  Clone ID: PAT_TA_98288
gatattgccaataatagtctagcccaattccaggttatgcgggcaagagggcggtggccttggtattctctctctgtcaaaattcagcgcccaattatggaagatggagaccgattctgatggtgttgcttcatggatgctgcaaagaactatcaatctagataaactactttccaccaattcanatattgagaagaggggcgcccccaataatactanggtttgctgagtacaaaaatgtgggtattcctatgggacacatattggngtcttcacgatncaacttgaagtccctgacgttcaaagaaaagtttccaaaaccctcaaggggtcgctattttccaatcnaaagtgggtatgctgcaagaggcaaacgtattgggggggggacaatatggagctgaacttttacataatacataaagatgattcat

SEQ ID NO: 98289 - DNA, 474 bp, Triticum aestivum
  unsure (1)..(474): unsure at all n locations
  Clone ID: PAT_TA_98289
gttccgcttcctcctccgccgtgtcgaagcaaaccacggngatggacgaaaacctcgccaacgtcctctcctaactcccgcctccctcggtctccaacaacgcatccccgtcctcctcgtncaacgcctccgatgacgatgancgcatcaaatggctcccgggncgtgctcctcccgcaanaatatctccccgcctccccaacaanggaagggggggcggaacaanaatcctcttcctccccgctgggggcaaanctctgggggttncaacccaatcccggggtncaangaaagcttnggattntttctaaacggcngtnaaacggcggggctngaaantcccaaccgggggccgggtaaatttntggcccggcctttnctncggaggnaactncgctttacaaaggaaaccggacgtccctccgactcccttggtttcgcctccctccgcaangcaaaagaaaacgtcgaang

SEQ ID NO: 98290 - DNA, 443 bp, Triticum aestivum
  unsure (1)..(443): unsure at all n locations
  Clone ID: PAT_TA_98290
tttccccagttccagcaaccacaccaaccttttccccagccccaacaacaattcccacagccccaacaaccgcaacaatcattcccccagcaacaacgaccgttcattcagccatctctacaacaacgtttgaacccatgcaagaatatcctcttgcaacaatgcaaacctgcgtcattggtgtcatccctctggtcgataatctgggccacaaagcgattgccaagtgatgcaagcaacaatggctgccaaagaactaagcacagattcctcaagcaagtccaagtggcggcaaccaatncataggcgtccgtggcattctatcaatcgtncaagcaagcangcaacaacaacaacaaacaacaacaacaacaacaacaacaaggnatgcntatcctgctggcactttctcaacaacaacagttgggtcaanggtatcccct

SEQ ID NO: 98291 - DNA, 435 bp, Triticum aestivum
  unsure (1)..(435): unsure at all n locations
  Clone ID: PAT_TA_98291
angccaagcaagcagtggtcaatacaaatccaccatgaagacctttctcatccttgccatccttgctatcgtggngaccaccgccacaactgcagttagagttccagtgccacaattgcaaccacaaaatccatctcagcaacaaccacaagagcaagtcccattggtgcaacaacaacaatttccagggcaacaacaacaatttccaccacaacagccatatccgcagccgcaaccgtttccatcacaacaaccatatccgcagccgcaatcatttccactagccacatccctagcttggggaaaccattgcaacaacaaccattnncactacaacaaatattatggnaccaacaacaacaacccatccaaacaacaaccacaaacattttcacaacagccaccatgttcacaagcaacaacaaccaccatttt

SEQ ID NO: 98292 - DNA, 436 bp, Triticum aestivum
  unsure (1)..(436): unsure at all n locations
  Clone ID: PAT_TA_98292
aagagttatagggagggacttatgtcaccacaaacagaaactaaagcaggtgttggcctttaaagctggtgttanccgattataanttgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcgagcctgttgctggggaagacagccaatggatctgttaagtagcttatccattanacctatttgaagaaggttccgttaccaacatgtttacttccaattgtaggtaacgtatttggtttcaaagccctaacgtgctccnacgtttggagg

SEQ ID NO: 98293 - DNA, 437 bp, Triticum aestivum
  unsure (1)..(437): unsure at all n locations
  Clone ID: PAT_TA_98293
ntcactccnnacagtcncancatcctctcagtcctcaccttcntcncctcgcaatcanccaccanggaaaggaggatgtcttgctgcggcggcaactgcggatgcggcgccggctgcangtgcggtaacggctgcggcgggtgcanaatgttccccaacgttgaggccaccgncggcgccnccgncatggtcatgcacancgcctcccacaaggggagctccngcgggttcgagacggacggcgnggagaccggnggctgcaacngcaccacctgcaagtgcancacgggctgccgnttgctcctgctgcaacttgcaaacttgagcccggcgcccaaantntggccgggccggnnaanggcaaccactnanggantgaggnnggncaactnggncaagcaaacanccaccnacnanggaccaaccnatnactaagc

SEQ ID NO: 98294 - DNA, 478 bp, Triticum aestivum
  unsure (1)..(478): unsure at all n locations
  Clone ID: PAT_TA_98294
agctcactcctcacagtcgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaangggaactccggcggggttccagaacgggccggggggggaagaccggggggnntgcgactgcaaccacctgcaanttgcggnaacgggcctggcggggtgcctccctgcttgcaaactgncaaactgaancccgggngccccaaagaaaggccgggccgggcgaaggcgaaacaacnaaggatnaagggagggncaactggggcaaagnaaaccaaccaacaaacaaccaaccaacattcaactancccgnttgcnatgncgnc

SEQ ID NO: 98295 - DNA, 468 bp, Triticum aestivum
  unsure (1)..(468): unsure at all n locations
  Clone ID: PAT_TA_98295
gcaaatcccacaattatcagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaaagaactgaagggccttggagctttgctaaagaagatactttgggggaagactcaacaattcttccttgaaaaacatctaagtcaatcccccttcaaagcttggnaagagaggttcctttgatgttagccgcttcaaggttagaagaataaaactggcntcctttgtcnaaaagcaaaggttgctccctgaagaacgggaaggggtcaacaaan

SEQ ID NO: 98296 - DNA, 429 bp, Triticum aestivum
  unsure (1)..(429): unsure at all n locations
  Clone ID: PAT_TA_98296
agaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgtaaggagcttggaattactgctctgcacattaagctccgtgctactggggggaaacaagacaaaaactccaagtcctggtgctcaaagctgcgcttaaagctcttgcaacgttctggnaataaaattggncgcattgaggatgttaccccggtccccantgaacaacaacccccggaanggtggtaaa

SEQ ID NO: 98297 - DNA, 446 bp, Triticum aestivum
  unsure (1)..(446): unsure at all n locations
  Clone ID: PAT_TA_98297
ctcttcctctgcccacaaaaccctagccgtcgcctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtacgcgtgacgccgatgcgcacggagatcatcatcagggccacgcggacgcaaaacgtgcttggtgagaaaggccgcaagatnaagggagctcaactccgttcgtccaagaaagcgcttcaacttccccgggagaaaggggttgagctttacgccgagaaggtcgtcaaccgtgggctctgcgccatcgcccaagctgagtcaatcccgctacaagctcctcggtgggcttgccgtccgcaaggcaatn

SEQ ID NO: 98298 - DNA, 291 bp, Triticum aestivum
  unsure (1)..(291): unsure at all n locations
  Clone ID: PAT_TA_98298
gaaaggtcaaaggaaaagggcgatcgatggcggcgctatggcgacaggacgacggcgaaccccggtcaccgtgagtgccctccgcgcagtatttgcggtcggtatggtttggcgccccgccgtacccggacgagccancaccgcgggcnccgcccctccccggtgtcctaagcggctgtggtccgcggctaaatgtccccgccgttcgtgttcccctcctaattttcnggatttggaccgggtcccccnattggggaaggactaaggngaanacgtccccggaattccccc

SEQ ID NO: 98299 - DNA, 380 bp, Triticum aestivum
  unsure (1)..(380): unsure at all n locations
  Clone ID: PAT_TA_98299
gtccagggccgtggccgtcctcgccgtcctgtcggtcgccgccctctccgtcgtctccgcgcaggaggccccggcgccganccccgtgtcggccgccggcgcaacggngccgtccctcgccgnagngctcgtcgcctccggcgccgncttcctcttcgccgccgtcngccactgaancggncgcctccgtcctcgccnaccgtccgtccgttcatnnatggntcctcctctacatctacatagtaccggcgcgtatatccgtttaacgncgctgctgttaccactaacgatttgttggntgttcntntccgcttggnctgatctgcctgctactgtccgtcgctcggtgaacgatgatgattnatgagtantnacatcct

SEQ ID NO: 98300 - DNA, 385 bp, Triticum aestivum
  unsure (1)..(385): unsure at all n locations
  Clone ID: PAT_TA_98300
gcccctcccacccacccaagaatcctccaccataatccccggcaacccacgcccggctccgatggcccgcacgaagcagacggcgcgcaagtcgacgggcggcaaggcgccgaggaagcagctggcgaccaaggcggcgcgcaagtcggcgccggccaccggcggcgtgaagaagccgcaccgcttccgcccgggcaccgtggtgctgcgcgagatccgcangtaccaagaagagcacggagctgctcatccgcacgctccccttccagcgcctgggtgcggggagatcgcgcaggacttcaagacggtctccggttccaagagctccgccgtgttcngccntgcagggagntcccccgaggnaaaacctggtgggnnctgttcg

SEQ ID NO: 98301 - DNA, 155 bp, Triticum aestivum
  unsure (1)..(155): unsure at all n locations
  Clone ID: PAT_TA_98301
cctacanatctcatctcattcccccacctcccgtcccgataaggcggacagcgaccgcgcgngcgagagataatctcccggctcgcctcntcctcnctccnntgtctcctctcccggctccatccatccagcgggaggagagggcangcggtgga

SEQ ID NO: 98302 - DNA, 310 bp, Triticum aestivum
  unsure (1)..(310): unsure at all n locations
  Clone ID: PAT_TA_98302
cagcaacaacaacaaccattatcgcagcaacaacaaccaccattttcacancaacaagccaccattttcgcagcaacancaaccaccattttcacaacaacaaccaccattttcgcagcaacaacaacaacttnttctnccgcaacaanaanttccatttgttcatccatctatcttgnngcagctaaacccatggnnngtattcctccancaagcnatgcanccctgtggcaatgccannttntcttgctaggtcncaaatgttgcaggcaggngcanttgctnatntgatgcancaccactgtttgcc

SEQ ID NO: 98303 - DNA, 422 bp, Triticum aestivum
  unsure (1)..(422): unsure at all n locations
  Clone ID: PAT_TA_98303
gcaacttaagcttgaagatgtttcgctagaatcttacagctatctatacaaaatttaattcaatataagcatgttgtatgagcttgaaaagcagaccacaatagattaatagccaaaggaaggaccgaatgatacataattaatcagactctaatctaatcgcctcgaggtcggaaacaggggcacccagctctggttggcccatggtagccactccatggcaagatccagacgccgagcggtatcaaccatggcctgaattagaagaaaatccattcactacgcctaccaaaggaagggcatcttcactcctgagttgcaaaaatnactgtcaataactcacagcaaaacacaaatattcaagttcttgagtatactgggatnaagtgngaaaacaaaagagtccattgggtcaacatgtt

SEQ ID NO: 98304 - DNA, 429 bp, Triticum aestivum
  unsure (1)..(429): unsure at all n locations
  Clone ID: PAT_TA_98304
gtttgctgctccgcgctcactgcttaacttgttagtctgttacatggttttcaaatttgtttttcttgttacaaggatgcaatgaaaaggttgtttcttcctcctcctcctcgtctggcttccgccccatctggtcagcgagcagcccaagcaagtcccatatctcgaagcgcctcggatgcgcctggtcgtcagcgacgaacgagcttagctcgccatcgatctcgaccgcgctatatgccgggaccttcttgagcccccgatttccgatcagctttcgcaccctccgcgcatcaatcctttgcggttggcgtccaaaanaatgtttggacaagctnggcgtacangccctcgtncgcgcccaagcctaagctttctcaaagctcccttgggtggcaacctcctgggcaaactcgaacaattgccgtt

SEQ ID NO: 98305 - DNA, 230 bp, Triticum aestivum
  unsure (1)..(230): unsure at all n locations
  Clone ID: PAT_TA_98305
cctacctccagctcttgagttcgacagatcttggttcacttcaccgccggcggacgnagcgnttcgagggaggaagcactggcggctcgcgggggctacgtgcaggtgcancacgggcagtacngtggcgggcancacggcgggcatcatcatgcacggtcgtcangntgggggancacnatgnagggcatgctccagganaaggagnngtcngcgtcgcangcccttga

SEQ ID NO: 98306 - DNA, 340 bp, Triticum aestivum
  unsure (1)..(340): unsure at all n locations
  Clone ID: PAT_TA_98306
cacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccaagcaaccacaacaaacatttccccaacctcaacaaacattcccccatcaaccacancancaangttccccagcctnaggaaccacannaaccatttctccangccccaaacanncattcccccaacatccancagcaaccatttccccangnctcaac

SEQ ID NO: 98307 - DNA, 479 bp, Triticum aestivum
  unsure (1)..(479): unsure at all n locations
  Clone ID: PAT_TA_98307
ggcgacggcactgtcgtgcgggcaggtggactcnaagctcgcgccgtgcgtgtcgtacgtgacggggaaggcgccctcgatcagnaaggagtgctgctccggtgtgcaggggctgaacggcctgncccgcagnagcccggaccgcaagatagcgtgcaggtgcntcaagagcctcgccaccagcatcaantccatcaacatggacanggtctccggngtgcccgggnaantgcggcgtcaagcgtgcccttccccatcangaatgtccnacnaaactgcaaacaatgtcaacctagttcantnttntaaccctttcccaacgngnaattgtaagggacnccgctttgttttgggangcttaaatgtcctacntttgnntgggaagtgnctcaatacnnantactggaagcttacctaaantaaatnaaantgaaagtttgccttggngttggtggttantttcagttncnggngtcact

SEQ ID NO: 98308 - DNA, 433 bp, Triticum aestivum
  unsure (1)..(433): unsure at all n locations
  Clone ID: PAT_TA_98308
gccgccgcctcctcctcctcctctcggctccttctccttccttccagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtccttcaagtacgcctgggtgcttgacaagctgaaggccgagcgcgagaggggtatcaccattgatattgccctgtggaaagtttgagaccaccangtactactgcaccgtcaattnatgcccctggggcaaccgttnacttcatcaaagaaaatgattnacgggtacctcccanggnttgactgntgctggngcttcaatcaaccactccancaactngtg

SEQ ID NO: 98309 - DNA, 294 bp, Triticum aestivum
  unsure (1)..(294): unsure at all n locations
  Clone ID: PAT_TA_98309
ctntcagcanagntatcaattccaattnnntagtagccaanacaantccaccatgaagaccttattcatcctaacaatccttgcgatggcaacaactatcgccaccgttaatatgcaggtcgnccccagcggccaantacaatggggacaacagcaaccattccgccagccccaacanccattctaccagcaaccataacaaanatttccccaaccccaacangcattcccccatcaaccacaacancantttccccagccccaagcanccacaacaacantttccgcagcccc

SEQ ID NO: 98310 - DNA, 450 bp, Triticum aestivum
  unsure (1)..(450): unsure at all n locations
  Clone ID: PAT_TA_98310
cctcactcctcacagtcgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaaccgcctcccacaagggggagctccggcgggttcgagaaggtcggcggggangaccggcggnctgcganctgcaccaacctgcaaagtgcgggcacggccctgccggcttgnttcctggnttgcaagctgcaaactggagcccggcnccccaanggtaggnnccggcccgggcganggctgaancaactanggantnaagggagggacaaacttgggncnangcaaaccaaccanccaaccaaccaacca

SEQ ID NO: 98311 - DNA, 446 bp, Triticum aestivum
  unsure (1)..(446): unsure at all n locations
  Clone ID: PAT_TA_98311
agacggtcaggtcttcgctaccacaggatacgggtgttcgacacagtggcagagacgtcacggcagatgactccgccacctgtgaacccccgccatgttatgcacttgcttgacctgggtggaaagcttgctgcgtccaccagcaaggatggcatgactgagatgtccatctttgtgcttcaggaccctgagcatgatgtctgggcattccagtaccggatcaaactgccggcgatggaaatcaggcgcttccagaagcaaggtgattggtgggcaaaggttgtctccgaggagggggacgtgcttgtcagctgctatggncatctcctgcagtatgacaagaagggtanatttgtagcctaagttcaagtattgatgatgacatgccgggtgggtcattcctcaacaggttcaaagangaagtccttatncagcaatacattttt

SEQ ID NO: 98312 - DNA, 465 bp, Triticum aestivum
  unsure (1)..(465): unsure at all n locations
  Clone ID: PAT_TA_98312
gcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccaagcaacaacaaccgttgattcagccatatctacaacaacagatgaacccttgcangaattacctcttacaagcaantgcaaccctgtgtcattggtgtcatccctccgtgtcaatgatncttgccacgangtgattgccaaggtgatgcaagcaacaatggttgccaacaactaggcacaggatttcctcggccangctccaagtggtgcaaccaatccaatagcgggcgtggcattncatccggtcnatggcagnnaagnaaaatg

SEQ ID NO: 98313 - DNA, 442 bp, Triticum aestivum
  unsure (1)..(442): unsure at all n locations
  Clone ID: PAT_TA_98313
gatgaccgtctctcgctgccccatccttctgctcccgctcctcttcctctgcaccctcccgccgctcgcctccgcctgcgaccgctgcgtgcaccgcaccagagccgcctactacgcctcctctctcaccctcgccgccggntcctgccggtacggcgcggnggncgcgtccctcaacggcgacntgctcgccggggcgggcccggtcctgtacaagacaaggagtccggcttgcggtagngtgcttccaagnngccgctgcaaangacnaggtagntcttgcgctaccgccggncgtgaaangtttttctntacacncgatcgcggccaagnaagcaaatnncgaanaggataaccgnacctctgngncgtgaagcantccnnggcgttttggccancccaatgggtnccggccccggggtatgggttggggnggggatct

SEQ ID NO: 98314 - DNA, 446 bp, Triticum aestivum
  unsure (1)..(446): unsure at all n locations
  Clone ID: PAT_TA_98314
caacaacaatttccccagccccagcaaccacaacaaccatttccccagcaaccacaacaacantttccccagccccaacanccacaacanccatttccccagcanccacaacancaatttccccagccccaacaaccacaacaaccatttccccanccccaacaaccccanntaccatttccgcaacaaccacancanccattcccccagcctcancanccccaacaaccatttccccagttacagcanccacaacaatcttttccccangccccaacaaccggnagcaagccattcccccanggaacanaanccattggnttcaagccatacctacanacancagatngnaccccngganggnttncctcttggagcanntggaaaccctgtgtcattgggtggtcattccctcngtgtccaatggatcttngccaagnaaggtg

SEQ ID NO: 98315 - DNA, 334 bp, Triticum aestivum
  unsure (1)..(334): unsure at all n locations
  Clone ID: PAT_TA_98315
ccgaagcgaaaggtaatcccaatccccacagaaatccccatctcaaaaccctagccctcatccccgatcccggcgagcgagatggccaacccgagggtgttcttcnacatgaccgtcggcggcgcgccggncgggcgcatnntnatggagctgtacaaggacgcggtgccgcggacggtggaaaacttccgcgcgctgtgcaccggnganaaanggcgtctncaanagctggnaatgccgctgnactaaaaaggggaagcgccttcnancgncgtgattccccgacttcatgttncaagggcggggnttttaanccggggcannngggaactgg

SEQ ID NO: 98316 - DNA, 451 bp, Triticum aestivum
  unsure (1)..(451): unsure at all n locations
  Clone ID: PAT_TA_98316
ncgatntcggtgatgccgcctctcacgacccccaagnccggngatnccctcttcgccancgtcgagcgcatactcttcacgctcactnangggaccatcgngcggaagctgctcacngatntcganaaggtcgaggaggtcaanaagnagctcgatcagatgggttacatnattggcactcngttggncgatgnattcttatgcangtcaaatgtctcanactgtgctgacttcanggaggactgctgatactatancaaaggtttcgtgaacgacggnggttacatgggtcngtgnnatgcttcgcggtgannntgcctaccatatgcgngtnangctcagcaatncangtccccgggggngaataccccttacaaagggattgatgactaggtttcatctcaanggggtagctcttccncaacnggtggncnctttgntttcgcttngt

SEQ ID NO: 98317 - DNA, 416 bp, Triticum aestivum
  unsure (1)..(416): unsure at all n locations
  Clone ID: PAT_TA_98317
cctcccccatggtgtcgctcgccgccccggccttccactcgctggcctcgcaagtctccanggcctgcaccacgagggcgtcttcgaaatgcgagagcgcgcccggccgccgtggagcgaaggcgcggcctcgggcggcggggactgcncaagcggcggcggtggaggcggangaaaccccgaggttnangtgggatgagctcgggtccgacctttccgagccccangancangcgatgcncnggctgtccccgaagctgnccaaccgattcanggcgctnatnccgcncgttctntcnctttcccccggggaataaaatctccggggtggtccttncnttntgggtnaaagncaatnaaanccccaaaaagggcggatttgggttgctgggtcctncaaaggggcttcaaagggt

SEQ ID NO: 98318 - DNA, 428 bp, Triticum aestivum
  unsure (1)..(428): unsure at all n locations
  Clone ID: PAT_TA_98318
atcaaatccaagtaagtattagttaacgcaaatccaccatgaagaccttactcatcctaacaatccttgcgatggcaacaaccatcgccaccgccaatatgcaagtcgaccccagcggccaagtacaatggtcacaacaacaaccattcccccagccccaacaaccattctgccagcanccacaacaaactattccccaaccccatcaaacattccaccatcaaccagancanacatttccccaaccccaacaaanatacccccatcaaccacaacantantttccccagacccaacacccacaacanccatttccccagccccattatncattcccccancagccccanctancatttccccantnancccccatnanccattccctcaagtcttaggcangccccanccaanncatntccccnagt

SEQ ID NO: 98319 - DNA, 312 bp, Triticum aestivum
  unsure (1)..(312): unsure at all n locations
  Clone ID: PAT_TA_98319
gagaggtggaaggcggcctactccgagcttcctcccggtgncantcccaagctcgccgaacttcangagcgtgacttggcggattccgaagcccgtgaagctcttcctgatgccgacaactctcaactgaaggtgtccatggttgtttttgtatcaatgctttactggnngactantcaanangcgcnaggaagcttaccaatgggganaccaatcaaaaaaagcgcaccnanggcttaacaatnggganggggcccttaaaggcttaccaaatngngaangcatncttcnaccgggtgnncccgnatgnaa

SEQ ID NO: 98320 - DNA, 464 bp, Triticum aestivum
  unsure (1)..(464): unsure at all n locations
  Clone ID: PAT_TA_98320
tcgggttctaccgcgccgccgccggcagcaccggcgaagccagcaagctcttcattgactgcaagcagcggccgagcaccaacagccccgcccccgcagaccccgtggaccagtcgccggctcccgtgcacaaggccgtgagaatcttcggcgtcgaccttctgacggcgccggcgtcgccggggtgcaagagggccangatacatggtgaagccgccggctccgacaagcggcgttgaagaagcaatgcatagagctggcgctagcgtagggttggaaccattagctcgatcgatgccttgtctccagctaagcagcggnggtttttgctcgcgtaattcaggtggtagagcttancttnattaantccctttgttggtnagtaccctatcatcaaactttggtttgtttaattttggcatgttggttgncatgccccttgatggtnaantcttatcccnccc

SEQ ID NO: 98321 - DNA, 421 bp, Triticum aestivum
  unsure (1)..(421): unsure at all n locations
  Clone ID: PAT_TA_98321
catcatttaagccaagcaagttgtggtcaatacaaatccaccatgaagacctttctcatccttgccctccttgctatcgtggcgaccaccgccacaactgcagttagagttccagtgccacaattgcagccacaaaatccatctcagcaacagccacaggagcaagttccagtggtacaacaacaacaatttctagggcagcaacaaccatttccaccacaacaaccatatccacagccgcanccatttccatcacaacaaccatatctgcagctgcaaccatttccgcagccgcaactaccatattcgcagccacaaccatttcaaccacancaaccatatccacaaccggcaaccacagtattcgcaaccacancaaccantttcacaagcagcaagcagcaggaagcaggcagcagga

SEQ ID NO: 98322 - DNA, 411 bp, Triticum aestivum
  unsure (1)..(411): unsure at all n locations
  Clone ID: PAT_TA_98322
ataagtagagcgcatcatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccaagggcagcaacaaccatttccaccacaacaagccatatccgcaggncgcaancatttccatcacaacaaccatatctgcagctgcaaacatttccacaagccgcaactatcatatccggagncggcaaccatttccgaccacaacaaccatatccacagncggcaaccacagttttcgcaaccacaacaaccaatttccccaca

SEQ ID NO: 98323 - DNA, 450 bp, Triticum aestivum
  unsure (1)..(450): unsure at all n locations
  Clone ID: PAT_TA_98323
ctcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggnccgcagcaagctcggaccgcaagatagcgtgcaggtgcctcaagagcctcgccaccagcatcangtccatcaacatgggcaaggtctccgggcgtgncccggcaaagtgcggcgtcagtgtgnccttccccaatcagcatgtccnaccaaatngcgaannctgtncacttnnttcnaatt

SEQ ID NO: 98324 - DNA, 454 bp, Triticum aestivum
  unsure (1)..(454): unsure at all n locations
  Clone ID: PAT_TA_98324
gttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaaccagttttacctccacaancantcaccttttccacaagcancaacaancaccaaccggctggggngcaaacaacaaatcccctggttggttcannccatccnaattttg

SEQ ID NO: 98325 - DNA, 159 bp, Triticum aestivum
  unsure (1)..(159): unsure at all n locations
  Clone ID: PAT_TA_98325
gagagagatanagagatctnactatccttctantctcgctcctcttcctctgcancctccngccgctcgcctccgcctgnnaccgctncgtncaccgcacnagagccgcctantacgcctcctctctcaccctcgccgccggttncatgccgntacggc

SEQ ID NO: 98326 - DNA, 430 bp, Triticum aestivum
  unsure (1)..(430): unsure at all n locations
  Clone ID: PAT_TA_98326
atnaacccttgaaagaattacctcttacaccaatgcacacctgtgtcattgggngtcatcnctcgtgtcangtgntcttgccacggaacgtgattgccaggtgatgcagcaacaatgttgccaacaactagcacagattcctcgccagctccagtgtgcagccatccatagcgtcgtgcattccatcgtcatgcagcaagaacaacaacanggcatacagatcctccggccactgtttcagctcgtccaaggtcagggcatcatccaacctcaacaaccatctcaatatgaggtgatcagatcattggtattganannccttccaaacatgtgcaangttgtatgtccgacctggactgctcctaccatcatcgaaccatttgccnagcaatnatcgcctggcaatcagttggacaattgaancttntct

SEQ ID NO: 98327 - DNA, 458 bp, Triticum aestivum
  unsure (1)..(458): unsure at all n locations
  Clone ID: PAT_TA_98327
ctgacgcctccgccggcggcggttccctggatgaatacccaaccatcgacccaacctctttcgacgtggtcctctgcggcaccggcctcccggagtccatcctcgccgctgcctgcgcggccgccgggaagaccgtcctccacgtcgaccccgaccccttctacggctccttctactcctccatcccgctcccttccgtcccttccttcctctccgccgactcctccancccctgcccgtcctccccaaaccacaacctcctccgccaccgctgaatacaccgccgtcgatntcgagcgccgcagtctgtactcggaggtttgagacctcggggacggttcccgaacccgtccaagggggcttcaacgggtcgacctgggtgggtccaagggtgnttttacttgcgccgaacgaaggccgttggacctttccttctganggccaggaagggaagccca

SEQ ID NO: 98328 - DNA, 336 bp, Triticum aestivum
  unsure (1)..(336): unsure at all n locations
  Clone ID: PAT_TA_98328
atttccccagttccangcanccacaccaaccttttccccagccccaacaacaattcccacagccccaacaaccgcaacaatcattcccccagcaacaacgaccgttcattcaggccatctctacaacaacgtttgaacccatgcaagaatatcctcttgcaacaatgcaaacctgcgtcattggtgtcatccctctggtcgataatctggccacaangcgattgccaangtgatgcagcaacaatgctggcaangaactagcacaagattcctcaggagctccagnngcgcantcatccaanagggtccntggaattnctttcancntggagggaa

SEQ ID NO: 98329 - DNA, 314 bp, Triticum aestivum
  unsure (1)..(314): unsure at all n locations
  Clone ID: PAT_TA_98329
ccccctcttgccccgtggtccccaaccgccgtccgccgccgcagaggggagaggcggccgccgcccaccgccgcaagcaccgccggccccgtcgcccccgccggtcgggtttgatcccatggcgtccaanaggatcctcaaggagctcaaggacctgcagaaggacctcccanctcatgcangcgcaggtcctgtnggtgaggacatgtttccactgggnanggcnaactatcaatggganccctccnggacagcccgttcaaccggtggggcctattttttggggtggaaaaattcaattttcccaaccgggt

SEQ ID NO: 98330 - DNA, 436 bp, Triticum aestivum
  unsure (1)..(436): unsure at all n locations
  Clone ID: PAT_TA_98330
cgccgccaccgcgagatccanccctcctctcccgccgccgccggaggaagctgcaaggngaagccgctgcaacaaacggtgacggngggggcattgctcccgtcgtgggatggncctggtcaagggcaatgcctccctccatnaacgcggngggggatttggnaagggtgctcggattccgntcctccgggttccggtgggcttgctcaacctcnaatttaaaggtggttgcttgctccaaacgccggnccgttggtcctgctaaggttggtggaaaggggcccctcccgggggttgncnggggnttggcncttggnngccccaaaaattcaaaccttcgttcctttcttnaaaggtggcgtnccgggggggcttgggccctgctncctttttcctttcgggggctttcncnaattcgggccttgccttcctgttg

SEQ ID NO: 98331 - DNA, 457 bp, Triticum aestivum
  unsure (1)..(457): unsure at all n locations
  Clone ID: PAT_TA_98331
agaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtaaaaacaacaacaatttccagggcagcaacaaccatttccaccacancaagccatatccgcagccgcaaccatttccatcacaacaaccatatctgcagctgcaaccatttccggcagncgcaactaccatatcccgcangcccgcaacttaccatttccggcaggccgcaanctaacatatnccggcaagccgcaaaccaatttcngaccacaacaaccaatatccacaatccgcaancaaagttatttcncanccacaacaaaccaantttcncangcagcaggcagcaacat

SEQ ID NO: 98332 - DNA, 400 bp, Triticum aestivum
  Clone ID: PAT_TA_98332
gtcacgactcctgaattgtttggttcaacttgtgcagccgattagcatggacgcaatatacatctttcaaaatagcctaaaaaggaaaaaaaatacaaagtttggtagtgttattgggcccaatttacaactcagtttgaattagcaactattcataatctgatttattttcctttgttcctttgatgttggtcacatttgaaacacgcccagcttttgtggtgcaacggatgcactctaactcgctaaaacttcttaagagctcgtaaatcaaaattacacccaaccctttatcgttcaggcggtgcgctctaaaactcgctaaaacctattaagaaagacgtagaaaaaaaataatcctgaatttagcaattgatgaaatatgcaacctatccgttat

SEQ ID NO: 98333 - DNA, 411 bp, Triticum aestivum
  unsure (1)..(411): unsure at all n locations
  Clone ID: PAT_TA_98333
cccctcccggcgccgcctccagcctagggtttcctcccgccgcccgtccgccccacccgccgccatggcccgccgcagcggaggaggaaggtcttcccgccctgctccacgtgctgctccagtgaagaaacccancaacgccaagcccgtccaagctcctccaccttgctaacanccaagagcaacggtggtggtatcattgagcgggatttgggtccaacatttgctcaagggcatgggtttcggtactggaaagtgccatggcgcaacaanggctgttgatgctgttgatgggtccccgtaccattcaacatganactgtttgttngttaaggntgctgcatctatgactccaaatggncaatgctgcttaatgaanaantgtgggaaaccctttcaaaggctttccaa

SEQ ID NO: 98334 - DNA, 280 bp, Triticum aestivum
  unsure (1)..(280): unsure at all n locations
  Clone ID: PAT_TA_98334
gtcgcccacaacccctccggagagccggtgaccgcggggcggacccgacaaccgcggcgccccaccccaccaccaccaccacccacccctgcccctcctccgccccacatgcctcncctgacccgccttcctatcccgcccaccgccgccgcacagggccatggccctcgcccagccaantacctccggnggncatgccctgcccggnanncatcggntccggtgggatcccgctccacctcccctcatctatcgcctttcaacatgtcgtcttgccgga

SEQ ID NO: 98335 - DNA, 462 bp, Triticum aestivum
  unsure (1)..(462): unsure at all n locations
  Clone ID: PAT_TA_98335
cacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccaagcaaccacaacanacatttccccaacctcancanacattcccccatcaaccacaacancangttccccaagcctcagcaaccacaanaanccatttctccaagccccaaacanncattcccccaacaatccacaaacaanccatttccccccaagactcancanccancanccaatccatttnccccangcanccaacancaanccatttcccccaaganctcaaacaaccccancaanncatttcccccaancatnccaacaaanaanccattccccc

SEQ ID NO: 98336 - DNA, 466 bp, Triticum aestivum
  unsure (1)..(466): unsure at all n locations
  Clone ID: PAT_TA_98336
ctccactcctattctaatcaacccctcgccgccgccgccgccgcagatcgcaccaccgaccgaccgaagcgatggccgcctccaccgtcgcgtccagggccgtggccgtcctcgccgtcctgtcggtcgccgccctctccgtcgtctccgcgcaggaggccccggcgccgagccccgtgtcggccgccggcgcagcggngccgtccctcgccggnagtgctccgtcgcctccggnggcgncttcctcttcgccgncgtcngccaatngaagcgnccggctccgttcctcgcccgaccggtccgtnccgttnaatcgantggnctcctcctctacatcnancatagtanccgncgcggtngatccngtttangcgcccgctggntgnttaccactaagnaganttngttgggntgttccgnggtccggctntgggcctngaattttggcntgganactggncccgtt

SEQ ID NO: 98337 - DNA, 403 bp, Triticum aestivum
  unsure (1)..(403): unsure at all n locations
  Clone ID: PAT_TA_98337
caacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccaagcaagcctcaggaacaatatccatcaggccaaggctccttccaagtcatctcaagcaaaacccacaggcccaagggctctgtccaacctcaacaactgccccaagttccaaggaaataagggactttagcgcn

SEQ ID NO: 98338 - DNA, 405 bp, Triticum aestivum
  unsure (1)..(405): unsure at all n locations
  Clone ID: PAT_TA_98338
cacgcgacccttattgtgttgtatgttgtattgcaatgactcagccaaggcaacaaaattggacgtgatgactactctgtgtatctatctacacttggcaattgccatgcttgctaatctcaaacttgtgcatccgttctcattgtccatctggtctggttagttggtgggtaggctcccacatatgcctcggtcatccatcctctcatagaaaagcatgtacgcctcgcacccgagaacttcttccagggggacttccttgatgccgcgatcgcttgcgcaaacccatgaggaagaaccactgctctgctgcttgcgacctgccctcacataagcaacatagtgccctatactcaangcgtgggccacggtgctcaatgncacaactanaacgatnactggagt

SEQ ID NO: 98339 - DNA, 437 bp, Triticum aestivum
  unsure (1)..(437): unsure at all n locations
  Clone ID: PAT_TA_98339
ggataancnanttattcttctantaaagccagtntnaacancanaaaagttaaaacttatcaagttcaacaaacaaaatacangagcggngggagcangagtgaataccacgagtagcatattctacccatgcatgcagcaaanaccaatgtctactccctggatttcaaagggaaatctcaaatgaagctggtgctgggtggcaagcacggntnaatttttgggcaacccgagtaaaaaatgcttgggtaaaagccaaaagcgggccgaacttgattaactggcaacttgggggtggctttcaaaaancctggcggggttcaaacgccctgtttggggccntgtttgggncctaatccctggcaaaancgattnttggggcttgccaacaacaancccttantngnaaattaacnaaaggtccaancctgttttcn

SEQ ID NO: 98340 - DNA, 456 bp, Triticum aestivum
  unsure (1)..(456): unsure at all n locations
  Clone ID: PAT_TA_98340
atggactcnngcttctcctccggctccggggacgtgaggtcggggagctcgctgacggtgggggagnggctctgcgccgccttcttgcccttcgttgcagtcgccgaggccgtctttttcgtcntcgccgacngcctcgccgacatctgcccttcctcgncctcntcctcgcgccngcgcanagaatcntctgcttcgnccttcctcacgggcaanaagaanagccatcacctgttccgccnccgcgtcgggccaggctgcacctccctcngacttccgcanccttgcccgcctccgccgagggagtcccgttgcttctcggtgaaacgaagtgggatnggggctgttcgatgctctanaaagaaagatnnagctgctccaatcatccnaacgaagggnctcaatctacnattggaagnaantgcaatcctancaatttaattcaagggactcctt

SEQ ID NO: 98341 - DNA, 396 bp, Triticum aestivum
  Clone ID: PAT_TA_98341
ccaaagctgcggcggcgcgcaggcgaatcagcagcggagccaagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagaccctttgtcaaagaatgccattgtgcaagtttgatgcagcccctttcaaaaa

SEQ ID NO: 98342 - DNA, 393 bp, Triticum aestivum
  unsure (1)..(393): unsure at all n locations
  Clone ID: PAT_TA_98342
tgagcacttgtgtctgtactgatgctaaataaaaatcctcccgcgaaagtcacgaagctctgccctctccctcgaaagggaaagagtagctcgaccgagcaaaccgattcatggcgacggnggngtgtcctctccctcancggtgtctgctcctcctccatctggccctcctcgctttcctgctggcggcggncccggnggccgangcgtggacgggggaaattcgcgggcgcgtcgtctgcgaacgtctgcgcccgactctgccatcgggccccgagggacangtcctccaaaggcgctgaaggnttgctggtttttgtgcaatcaacgaaatctgggtgaggtcatcaaactaaccaaggcggtttcanaaaactaaaaaagggcgtctaa

SEQ ID NO: 98343 - DNA, 158 bp, Triticum aestivum
  unsure (1)..(158): unsure at all n locations
  Clone ID: PAT_TA_98343
atatcttccccctcctctcggcgttgcgttgctccttgctcgatcgcgtcccangaaattaagccctcgatnggncggcacctgatcgactctggacatggnggggcgcggngacgacgtggccgtgatgaacgtggcggagtatgaggnaaggagga

SEQ ID NO: 98344 - DNA, 393 bp, Triticum aestivum
  unsure (1)..(393): unsure at all n locations
  Clone ID: PAT_TA_98344
attccccttccctcctctcccgcgtcccgacgagcaccggccgccagacatggacgcctcaaccaccggagccggagcgaangcgaanaanggcgcggccgggcgcaaggccggcgggcccangaagaagtcggtgacgcggtcggtcaaggncgggctccaattccccgtcnggcgcatcggncgctacctcaaagaacgggcggtaagcnaaacgcgtcgggacggggggccccgtctaactcgccgccgtcctccaatactccccgcggagcttgctggagctcgcccgggaaccccgccaaggacaaacaagaagtctcgcatcgtgccaagcacctgctgctggccgtccggaacgacaagaagtcgggangctgcttggccggctta

SEQ ID NO: 98345 - DNA, 434 bp, Triticum aestivum
  unsure (1)..(434): unsure at all n locations
  Clone ID: PAT_TA_98345
caagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacantttctagggcagcaacaaccatttccaccacaacanccatatccacaagccgcaaccatttccatcacaacaaccatatctgcagctgcaaccatttccgcagccgcaactaccatnttcgcagccanaagccatttccgaccaaaacaaccattntccaacatccgccaacccacaaatnttncncaaaccaacaancatccaanttttcacaagcaggcagncnagcaggcnatcaatcaacanncaancaagcaaggg

SEQ ID NO: 98346 - DNA, 396 bp, Triticum aestivum
  unsure (1)..(396): unsure at all n locations
  Clone ID: PAT_TA_98346
cggagcggataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgtggccccctccaagggcaccccgtcgttcgaggccgccgccgagaacggagggtgcaagtgcgggcccaactgcacctgcaacccgtgcacctgcaagtgattcatgaggcctcaatcaaatcaaatcaaggagatggcatggatggacctgaatgaagggagcgaagtaataattatgcatgaatcncaagcgtgttgtttcgttttaaatttgccaaccaanaataag

SEQ ID NO: 98347 - DNA, 413 bp, Triticum aestivum
  unsure (1)..(413): unsure at all n locations
  Clone ID: PAT_TA_98347
cgccactccgccgctgccgccgccgagatgggtcgcgtgatccgcgctcagcgtaagggtgcgggctccgtcttcaagtcccacacccaccaccgcaagggccccgcccgcttcaggtcgctcgacttcggcgagcgcaacgggtacctcaagggcgtcgtcaccgatgtcatccacgacccggggcgtggtgcgccgctggccaaggtgaccttccgccanccgttcaaggtacaagcaacaagaaggagctcttcgtcgccgccgagggtatgtacaaccgggcaattcgtctaactgggggacgccggcgccaaccctctccggttggtaaagtccttcccgctccgctccgttgcctgaagggaaggcgtcaatttggcaaaggtcgagcaacaacttcggcnaaccgt

SEQ ID NO: 98348 - DNA, 337 bp, Triticum aestivum
  Clone ID: PAT_TA_98348
gtccgaccctgcctcctgaagagattgggcgtggttagctcgtggcccgcccagacggtgtcgaagaagtcgccgtgcttgcaggaggcagggtcggactggacgcggcggcgaggtagtggaggtagctccggggccgccagtcctcgttcgtcttctccgccagtgcgggctctccccacccaacccccgcttccccatccaagctcatggcgacacaagaacctgctgcggctgcctgccgcttgactttggggtcaaatccgagacgaaagtggaggaggacggagacaagtcaggtgagaggtgacacatctaagcggcgaccggcggttga

SEQ ID NO: 98349 - DNA, 443 bp, Triticum aestivum
  unsure (1)..(443): unsure at all n locations
  Clone ID: PAT_TA_98349
tcaaaaccaagcaaaactagttagcaccaatccatcatgaagaccttcctcgtctttgcccttctagccgttgtggcgacatctgccattgcacagatggagactagctgcatccctggtttggagagaccatggcaagcaacaaccattacaacaaaaagagacatttccacaacaaccaccattttcacaacaccaacaaccaagttctaccgcaacancaaataccatctgttcagccatctatcttgcagcaagctaaacccatgcaaggtattcctccaacaagcaatgcaaccctggtggcaatgccacaaaagtcttgctaggtcgcaaaatgttgtgggcaaagtaagttgccatgtgatgcaagcaacaatgttgcccggnaagctggccgcaaatccccggaacaatcaacgcctnacgattgcaaatccgtt

SEQ ID NO: 98350 - DNA, 416 bp, Triticum aestivum
  unsure (1)..(416): unsure at all n locations
  Clone ID: PAT_TA_98350
agagagcagtatatttttcccacctcccccctctctccctcgcgtcgccctctcgggcgactcgagggccgaaaacctagcccgtcgccgccgtctcctcccccgccacccctctcctcgccgccgcctgaggcagccgccggcttcgcccggggcgctgctgaggatggtggcggcggggcctctcctgctgctctgcatctctcgcggggggccttgcgacccggggcggcggccccggcgggattggcgccaccggaccctcggcgcatggtggcgcaagtgcgggccggttgcccctcggccgtgtggacggcnaggcaaccggtggatgcgcgccaaggcgttggcggcggcggctttcggctnccgcgggtccaaaatttgggcgcccttcaaccctcntcggggggatt

SEQ ID NO: 98351 - DNA, 361 bp, Triticum aestivum
  unsure (1)..(361): unsure at all n locations
  Clone ID: PAT_TA_98351
nannaaccagttctaccacagcaaccaccattttcacancaacancanccaccattttcgcagcagtancaancatcttcacaacaaccaccttttccacaacaacaccaacagtttccacaacaacaaatccctgttgttcaaccatccgttttgcagcagctaaacccatgcaaggtgttcctccaacaagcagtgtanncatgtggcaattgtcgcaacgtcttgctagggtcacaantgttggcaacaagaagntagttgccatgttgntgcnaanaacaaatgtttgccnaacagntgcccggcaaatnccccgaaaccantncccggctccngagggcaantccgtggccatcgt

SEQ ID NO: 98352 - DNA, 432 bp, Triticum aestivum
  unsure (1)..(432): unsure at all n locations
  Clone ID: PAT_TA_98352
catcggcgcgcgcgcgttcggcagcgcggcggtgaacgacacggccccgcccgtcgacgacgccggccacggcacgcacacggccagcacggcggccggcaatttcgtggagaacgctgacgtccgcggcaatgcgcacggcacggcgtccgggatggcgccgcacgcgcacctggccatttacaaggtgtgctcccgcaaccggtgctccatcatggacgtcatcgccggggctcgacgccgccgtcaaaggacggggtggacgttatctccatgttcaatcgaacgtctccgaacgggngcgnaattnaactaacnaacctcctccgccgtccgcaacggtaacaaaggncaatccangcgttggcatcttcnttaatggccgcccgccggcaatncggggggccgggcgcccgggaagcgttctccaaa

SEQ ID NO: 98353 - DNA, 186 bp, Triticum aestivum
  unsure (1)..(186): unsure at all n locations
  Clone ID: PAT_TA_98353
ctgancgcaggcgggtggaggcggacggacgcnacgatgagggcggtggcgatcgctagccccggcgggccggaggcgctgcaggtgcncgaggtggacgacctcccggngccgggggagggcgaaggtnttcatccacagtnntccatcttaggaatnaaccancaccntcacttccatntggta

SEQ ID NO: 98354 - DNA, 262 bp, Triticum aestivum
  unsure (1)..(262): unsure at all n locations
  Clone ID: PAT_TA_98354
cccatgcctcaacaaccccaacaaccatttccccagttacagcaaccacaanaacctttaccccagccccaacaaccgcaacaaccattcccccagcaacaacaaccattgattcagccatacctacaacaacagatgancccctgcaagaattacctcttgcagcaatgcaaccctgngtnantggtgncatccctcgcntcaatgntnttggcacgaaagtgatttgcaagggggatgcgggcaaacaattgtttgccaa

SEQ ID NO: 98355 - DNA, 434 bp, Triticum aestivum
  unsure (1)..(434): unsure at all n locations
  Clone ID: PAT_TA_98355
gcgcacgcgagatggcagcctccatgatcacctcgccgattgtggcgccgacgagcgtgccgtccctctcccgccggggctcctccttcgccgtcgtctgcancggtggnaagaagatnaaggtcgataagcccctcggactccggaggnggnttgacaatccacatcgacgccaacggnaaggaaagtccggcaaagaaaggcgtgtaacaatttgttgacaaataaggtggccaaacgtccgacggntaacaagccaatctaaaacccaaaaaggaatggtcctgagtctgggtgaaccgctaacgccgggngggnaacgaaccgggcnttcttatctggggccgttcaacccttccccngggnctcccttncgganggggggggggtccctcccnccgntctnanaaaaaaanaaaagggtttttcgcccn

SEQ ID NO: 98356 - DNA, 291 bp, Triticum aestivum
  unsure (1)..(291): unsure at all n locations
  Clone ID: PAT_TA_98356
gaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcaggcacaaagaacatccaagttccacatcaaaaagttgaacccatgcaagggatgcccctcctacaacaagtgttancccaatttgctgatatgtcaattcctccgggtcaacagggtgggtgcaaacataa

SEQ ID NO: 98357 - DNA, 435 bp, Triticum aestivum
  unsure (1)..(435): unsure at all n locations
  Clone ID: PAT_TA_98357
ctccaatcccaccttcggaacagcagccagcaagcgtcgccagccatgtcgggccgcggcaagggaggcaagggcctgggaaagggcggggcgaagcggcacaggaaggtgctgcgcgacaacatccaaggggatcacgaagccggcgatccggcggctggcgcggcggggcggcgtgaagcgcatctccgggctcatctacaaggaaaccgcggggtgctcaagatcttcctcgaaaacgtcatccgcgacgccgtcacctacaacggagcaacgcccgccgnaagancgtcaaccgccatggacgtcgtctacgcgctcaaagccgcnaangggcgcaaccctctaccggctttcnggggggcttgaaccccgggttccggccctccncggtggggaatttanattgtgggttaaggcgggggtcntnccttt

SEQ ID NO: 98358 - DNA, 433 bp, Triticum aestivum
  unsure (1)..(433): unsure at all n locations
  Clone ID: PAT_TA_98358
ganattccagcgtgccgccancgttcgttcacacccctctcccctgcagccagccgccagaggagcaggggaaagtggntngaacgatgatctggggggtcgcanccgccgtcgcgtccgcggccgccgtcgccgtggcctccggcgcccgaagctcctccgcgtgcgactggcgccccgacggcgccnaccgccgccgnccgccgtcgtcgtcggnaaatgccgacgggttcctcttccgacaagcggctttcgcaggaatcctcgtcgtcgagcggncgggacgaaaagtttcgcgcccgaaggttcgaccgggcctgcggttcatccanacgctcgtcacggggcaacggctgaaagtncccggaaagctcnaacccattcggccgggcgggcttccantcgacccctntttcctcaaggggaattcctt

SEQ ID NO: 98359 - DNA, 414 bp, Triticum aestivum
  unsure (1)..(414): unsure at all n locations
  Clone ID: PAT_TA_98359
atccaanaagtactctccatccaaaagacccaaggaatctacatccaagaaaatggttaagaagaatgacttaaaagacattaatgtgcagcatgnnccgatcactgagtatgtttcaagctccaagggaacaagctgcttgatcgtctgggtgagttcaccctgctgagantacttgacctggaaagactgcaagggcgtagaaaacaagcatatgggtgacatctgtcggatgtaccttctgaggtatttgtccctgagaggtacaaatatcaatgtgctgcctccgaaagtctgtgacctggagcatttgcaagacacttgatgtacgtgccaccggccttgctaaacttccaaaaactctgatnaaactaaaaaaacttnagcgcttgttnctcccccaaaaaggatgtn

SEQ ID NO: 98360 - DNA, 187 bp, Triticum aestivum
  unsure (1)..(187): unsure at all n locations
  Clone ID: PAT_TA_98360
cccanccctgctgcngtgntgctggctgctgagcaaaaacaaatccccacatccccttcccttcccttttccccaaatcaatcaatccctccctccctcattcacgcgggcagggcaggcatcccctccaagatttgattttgcttctaaatctttaggggaggggaggggaantgnnccttgaaac

SEQ ID NO: 98361 - DNA, 428 bp, Triticum aestivum
  unsure (1)..(428): unsure at all n locations
  Clone ID: PAT_TA_98361
cggcaaccaagccgccgtccgcgtcctcaccgtccagccaccaacccacaacacctccccccgggtacgcccctccggccctcacgccgccgaccgcgcccacgccatcctcgccactgccgctgccggcccctggtccctggacaccaccccctccaccaagcggcgagggcggaacgccatcctctccaccaagcggcgaaggcggagcgccatcctctccaccaagcggggaaggcgggacgacgccggttcacggcatgccatactcgtccccgccaccaccaccaacgacagtgccgttgcccccggtccacggcgtgtcctactcgtcgccgccgcccccgctcctcccgccggtctacggggtgtcctactcgtcgccgccgncgccaatgncgccgggtccaagggggtctnctacgggg

SEQ ID NO: 98362 - DNA, 415 bp, Triticum aestivum
  unsure (1)..(415): unsure at all n locations
  Clone ID: PAT_TA_98362
ccacccctcctcgcctccgaagtccaaactcgccaccgcccccgggaacggaaccaacaaatccccaaccaatctcgtctccgatcgactccaggctcgtcgaatccccaccgcctcaagatgcagatctttgtgaaaacactgacgggcaagaccatcacccttgaggtggagtcgtctgacaccatcgacaatgtcaaggccaagatccaggacaaggagggcattcctccggaccaagcagcgtctcatcttcgctggcaagcaactggaggatggccgtaccctcgctgactacaacatccaagaaggagtccaccctccaccttgtcctgcgtctgcgtgggggcatgcaaatatttgtgaaagaacctcaccgggaagnacatcaaccttgaggttgaagaagctcccn

SEQ ID NO: 98363 - DNA, 220 bp, Triticum aestivum
  unsure (1)..(220): unsure at all n locations
  Clone ID: PAT_TA_98363
gttgtcctgtttgttgcccttgtcctggttgttgcttttgtcctggctgtcctgtttgttgcccttgtcctagctgctgtagagaanttgggtaatgcccttgttgcccttgtcctggttgctgcaganaagctgggtantgcccttgttgcccttgncctggctgctgctgagaagcaggngatttgcccttgttgcccttgncctgncntcttgctga

SEQ ID NO: 98364 - DNA, 416 bp, Triticum aestivum
  unsure (1)..(416): unsure at all n locations
  Clone ID: PAT_TA_98364
aacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcaacancancaacaacaacaacaacaaggcatacaagatcatgcggccactatttcagctccgtccaaggtcagggcatcatccaacctcaacaaccagctcaattgggggtgatcagggcatttggtaatgggaactcctccaaccanntggnacgg

SEQ ID NO: 98365 - DNA, 416 bp, Triticum aestivum
  unsure (1)..(416): unsure at all n locations
  Clone ID: PAT_TA_98365
gttaacaccaatccaccatgaagaccttcctcgtctttgccctcctcgccgttgcggcgacaagtgcaattgcgcagatggagactagatgcatccctggtttggagagaccatggcaagcagcaaccattaccaccacaacagacatttccacaacaaccactattttcacaacaacaacaacaacaacaacaacaagaacaacaacaacaacaacaaccgtcgagccaggtctcctaccaacaagcctcaagcaacaatatccatcggggcaaggattcttccaaccatctcaacaanacccacaaggccaaggctctgttcaacctcaaaaactttcccaattcganggaaataanggatctaacgctgcaanacgctaacgggaatgtgcaatgtctaanatccctccaaan

SEQ ID NO: 98366 - DNA, 362 bp, Triticum aestivum
  unsure (1)..(362): unsure at all n locations
  Clone ID: PAT_TA_98366
nntcaaanccaggtattactagttaacaccaatccaccatgancnaccttcctcatctttgcnctccttgccattgcggcgacaagtgccattgcacanntggagactagccncgtccctggtttggngaaaccatggcagcaacaaccattacnaccacatcaacanccaccatgttcacagcaacaacaancatttccacagcaccancaaccaattattatactgcaacattcaccattttcgcagcaacaacatncagttctgccgcancancaaccagttattatactgcaacaaccancattttcgcagnagcaacaagnagttctaccacaananccaccattttnacancaaca

SEQ ID NO: 98367 - DNA, 316 bp, Triticum aestivum
  unsure (1)..(316): unsure at all n locations
  Clone ID: PAT_TA_98367
ctcctccccttccggttcgggttctggttcggttcgggtccganagtagctagcctagtctagggtttccgtagttcggagaggagagaaagggagagatccatggcgganacggngtaccgctgcttcgtgggcggcctcgcctgggccaccnncgaccacaacctccatcaggccttcagccangtacggcgagattcttcgangccantgatcatnaatcnaccgnganacgtgntcagggtcccgtntgattcgggctttcgtcacgtttcgggnatctnaggganttcttatgctccnagncccattcgag

SEQ ID NO: 98368 - DNA, 391 bp, Triticum aestivum
  unsure (1)..(391): unsure at all n locations
  Clone ID: PAT_TA_98368
ctcancagcancancanccaccattttcgcagcancaacaacaaccaattctaccgcaacaaccacctttttcgcaacaccaacaancggttcttccgcaacaacaaataccatatgttcagccatctatcttgcancagctaaacccatgcaaggtattcctccagcancattgcatgccctgtggcaatgccacaaagtcttgctaggtcgcaaatgttgtggcagatgcagttgccatgtgatgcagcancattgttgccagncagctgccgcnaatcccccgaacantcacngctatgantgcaatccgtgccaatcantctantcgatcggtccctacaacnaatnaccaancatgggtcaggggttttnaaccaatctncaagca

SEQ ID NO: 98369 - DNA, 406 bp, Triticum aestivum
  unsure (1)..(406): unsure at all n locations
  Clone ID: PAT_TA_98369
acataatagaatctggatagctttagatcacaaccaaaacaggcaaaacattctcagttcaacctaggactcgaaccgtttacagaaaatggtgttcagtatgtctgcaaacatgacatggacgcaacatctaagaaaatccaacgagtaacatgcagcagctcttcagcctaagctgtggcacccttgccattcttcttctggagcttcctcatgtagaactccagctccttgccctccaggatgtacccatcaagctctgccacactgtccagggggagacgaaatgcaggncancanccttccaacactgaactgctcctcaatgtgcgaagtccaatgtacgtccctggctggngcttctcaaagcttcctccggacaatgttgccctccttggcttcctcc

SEQ ID NO: 98370 - DNA, 421 bp, Triticum aestivum
  unsure (1)..(421): unsure at all n locations
  Clone ID: PAT_TA_98370
agganttgtgttgtctgcacctanggnagatccctgancagtcncantgcnaggccatccacatttgttgttcatgctattattctgnatcancaacaaaaaaaacaacaacaacaacaacaacaaccatcgagtcaggtctccttccaacagcctcagcaacaatatccattaggccagggctccttccggccatctcagcaaaacccacaggcccagggctctgtccagcctcaananctgccccagttcgaggaaataaggaacctagcgctacaagacactacctgcaatttgcaatgtctacatccctccatattgcaccatcgcgccatttggcatcttcggtactaactntgaagaaaatanctctngtnctatatatatgaaacaccgttttctcaantccatgggttttggg

SEQ ID NO: 98371 - DNA, 419 bp, Triticum aestivum
  unsure (1)..(419): unsure at all n locations
  Clone ID: PAT_TA_98371
agctcctccccctccccctctccagttgcagctcctccctcttctcctctggcgcaaccctcttccaccagatcagcaccagaacangtgttgctgcagtagccactggtcaggtgtccctgctctgatgaatcctaggagaagagctagatcttactccagtgtacattatgtggcaagataatccatgctggagtgaaaaggctgaagcagcacctttctgggggttccaagtgatgcggataagtgtcccgagacatccatggagattaggataagagatgcgcaattcccttaaacagtggaaaagtttaaagctacaagcgcgatatattnatgaaggangatgaaagcttaaagttcaaaaggnaccgttctgtcnatgttcaaaaagggtaatttttnggncctaangccnt

SEQ ID NO: 98372 - DNA, 411 bp, Triticum aestivum
  unsure (1)..(411): unsure at all n locations
  Clone ID: PAT_TA_98372
aaacctccccaattccatccccattcccttccccaaaaatttccccaccggtgacgacgccctccccaaatccgatccgccgccgcccgccgttgacgccagccatggccgccgccgcccgccgcgccctgctcctcctcctcgccgccgccgccgtggncctcctcgcggcgcccccggcggccgccgcccgcccctgcggccgcgcgcanacgctgctcatctccttctcctccttctcccgccccaacccggaccccgccgacccgtcgccgctcaccaccaccgtcgtcaccgtcctccgtgtccgccgcctcggaccgcaccgcttccangcccacnacnaagaaccgcctcnagatccgccncccccgcngagtcccctcctccgcngtttggcaccccccnagt

SEQ ID NO: 98373 - DNA, 443 bp, Triticum aestivum
  unsure (1)..(443): unsure at all n locations
  Clone ID: PAT_TA_98373
acaactggcacagattcctcagcagctccagtgtgcagccatccatagtgtcgtgcattccatcatcatgcagcaagaacaacgacaaggcgtgcagatccggcggccactgtttcagctcgttcagggtcagggcatcatccaacctcaacaaccagctcaattggaggtgatcaggtcattggtattgagaactcttccaaccatgtgcaacgtgtatgtctcacctgactgctccaccatcaacgcaccatttgccaacataagtcgtcggcattggtggccaatgaaaaatgcaaagagtttatgctaataggtagatgggatncatccgttgcttagcctgaatngcaccaaatccgtttgtagccgatggacaaaattaaaaggtggcggtacgccaatcaatggtgttgacccccngaccaagttgctnnttncaa

SEQ ID NO: 98374 - DNA, 409 bp, Triticum aestivum
  unsure (1)..(409): unsure at all n locations
  Clone ID: PAT_TA_98374
gccacctcttgccccgccccgcccggccggcgctccgcctcccatcgccgagcgtcgtcgcccctcctcgccgcgccgccggaccgcctaccgtcgtcacgcactgccatggcctaccttgccgccccgcctacccctaccccaagttcccccacacccgcgcccatcaccggcatccatacgcgcgacctgtttctctgttgccgggcggctgcaggaggtggccggcatcgccccgtcatcaaatcccctagccgcttgatctcatccgccgcatgctggntgcccgtacaggattgacgcgccctatatccggcgacccgcggctnctcctcccaagccccggatctgctctcccgccaactggcgaaccacgggttcaaatgatccacgancaactcgggntggc

SEQ ID NO: 98375 - DNA, 429 bp, Triticum aestivum
  unsure (1)..(429): unsure at all n locations
  Clone ID: PAT_TA_98375
gagaggagtctcgccgccggcgacggccgcccgcacatgccgatctctgccggcatccgcgcgccgccgcaaggggcggccgtgcacgtccccgggagccggctcctccgcgtccccgttcctcaactggnggcgggcggcgtccggcgcaagaggctcggggtcgtggtggcgggggnctcctccgcggngtcacccgaagagctccaaccgcgcggggaggnatntccaagggttcccccgannaattctttactttgggaactttgatnaaagatgtnaaaacttttgggtncaaagtgtaatccaaaaganntttttccccctgnaaaatggttgnttcaaatnaaaaaaggactnttttccgggaannttgggggcccccttcccgtcntgattaanttnccgnttttttccnggangggccct

SEQ ID NO: 98376 - DNA, 403 bp, Triticum aestivum
  unsure (1)..(403): unsure at all n locations
  Clone ID: PAT_TA_98376
ggtgcatatagctagaaaacaaaatatttggagtgcctttatataggtctgcattttatttaacccatttactcattttttgaatcatattacacccaggtacataattaggagtagctagtttagtgggacatggctggactgaaagcttaggtgcatgactgacagagatatatatgtgacgtggccgtctgccttctttgactactagttggctgatgacttgtgcactttgtatggcacacgcgtacacacaaatacgtatacgtatataagtagccctgggatgaatatgggcaccggccgtggatggatggaccatctagctagcgtggacagcggagcaccatggcctcgatcgtgattcccggtccgaaggncagcagtgcaccccactccggca

SEQ ID NO: 98377 - DNA, 417 bp, Triticum aestivum
  unsure (1)..(417): unsure at all n locations
  Clone ID: PAT_TA_98377
gctccttgccgcaaagtgcatggtggtggccggagaagaaggagccgtagataggcttgctaccgtaaagggaggatcacgcttacacccatgcttgctgcaagtcggcggaggagttctaccccgaccttgatgattgagtcggccttcctaggtttcattgtttagctatgtatatgaactttggttgtgttgtgaactttgtagcgcgaattggttttttaaatttacagaatgaactatggtgggattagttcagctgggaccttaaagttcccgcaaaaatcgtttcagggggaccctaaaacaattttgcagtaccgggtttatacaagtccactanaagntgctccttaatgtgtttgggatgcaacaatgcaactataaattaancnttgatatgaataacctttaann

SEQ ID NO: 98378 - DNA, 348 bp, Triticum aestivum
  unsure (1)..(348): unsure at all n locations
  Clone ID: PAT_TA_98378
gtgcatancaggttcaaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggannatgntcctcacgggcctcagagaactctccctcctccatgccctcacccaacgtaccaagtggacgaaggcgcgctttgcatacatcaggtcaaacttgtggttcgat

SEQ ID NO: 98379 - DNA, 397 bp, Triticum aestivum
  Clone ID: PAT_TA_98379
gggaagcgatcggaggcaatggcgaacggcggcgacggcgacggcgacgtcccggagaacgccaacgagcattgccccgggacgcagtcggaggcggccgggaaggcggagtcctgcgccggggtgccccaaccagcagatctgcgccaccgcgcccaagggccccgacccagacctgcttgccatcattgagcgaatgaatactgtgaaacataagatactggtgttgtctggcagggtggtgtagggaagagtactttttcagcccagctctcatttgcccttgttgagatggactatcaggtcggccttcttgacatagacatatgcggacctagcatccaaaaatgttaggcctttgaagggcaagatattcatcaaagcaatgtttggctgg

SEQ ID NO: 98380 - DNA, 152 bp, Triticum aestivum
  Clone ID: PAT_TA_98380
atcatcagcaacatctacatcatcaccaccttcatcatcatcgtcatccacatccttatcatctgcaacattaagaaccctagtggatccttcggtgtattggttgaatcattcacccatgtattccattactatgaacatgacgattgttg

SEQ ID NO: 98381 - DNA, 388 bp, Triticum aestivum
  unsure (1)..(388): unsure at all n locations
  Clone ID: PAT_TA_98381
ccgaggtccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagccaacctgctctctgtggcttacaagaatgtgattggtgcccggagggcttcctggaggatcatctcctccattgagcagaaggaggagagccgtggggaacgaggcctagttgcttcaatcaaggagtaccgtaccaagattgaaaccgagctcaacaaagn

SEQ ID NO: 98382 - DNA, 399 bp, Triticum aestivum
  unsure (1)..(399): unsure at all n locations
  Clone ID: PAT_TA_98382
gccgtgccgggccgggccggcccgtttggccagctatagtccacgagcgccagaccaccattcccccatcgcgtcaccgtcgctgacctccaagatccatccatggcggacgccgggacgctctcctacctgcccctctcgctcgccacggccctcttcttcgttctcctcctactcctcaccaaaagcaggcgcgagcgcggcctccggctgccgccgagcccgccgtccctgcggtcatcggccacctgcacctcttcaagaagccgctccaccgcgcgctggccaacctcgccgcggcacacgggncgggtgctgctcctccgcttcggctcccgccgcttgntccanaatanccgnnccggcantcgccgagggagtgcctgacggttcacgang

SEQ ID NO: 98383 - DNA, 398 bp, Triticum aestivum
  unsure (1)..(398): unsure at all n locations
  Clone ID: PAT_TA_98383
gtccatctccctcacgagctcccccaaaatcctccgctctccgctactgcgctgcgcacagagatcaatcagtcgaccgacaatggcggttcccacgccgcagcgccgtctcctggcggccgccatggccctgctcctcgtgctcgcctcgtccggcgcggtggcgcgcgcggggatgagcgggccgatcaagacggtggtggtggtggtgatggagaaccggtcgttcgaccaatgctggggtggatgaagcggctgaacccggcgatcgacggcgtgacgggcgccgagtggaacccggccaacgcgtcggacccgtcggcggggccgcgggtctacttgggcgacggcgcgcagttcgtggaccccggaccccggggcactcgttaccangaaaa

SEQ ID NO: 98384 - DNA, 397 bp, Triticum aestivum
  unsure (1)..(397): unsure at all n locations
  Clone ID: PAT_TA_98384
aagtaaagcttgtccctttcgctgctctgctttgctccgtccgtccgtctagatccatcaaactggaccgcctcctcttgatccagcagagcaggggatccatggagcagctggcagacgggtgcgagctggaggagctggagcttcccactgtagacctcgaggcggaggagtcgaggctgacggagcagctggcggcggcgtgccgggacccgggcgtgttccggctggtcaacacggcgtcccctgcgagctcacagcccgcctgttcgggctggcgcgcgggctgctggagctggacgcggccaacaagtcccggctgcccggctacttctgcggcaacccggcgctggcggcgctccccgtcaaggaaatnaactggctcganggtctgcaa

SEQ ID NO: 98385 - DNA, 401 bp, Triticum aestivum
  unsure (1)..(401): unsure at all n locations
  Clone ID: PAT_TA_98385
aagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcaagcaacaaccatttccaccaaaacaaccaatatccgcaagcgcaaccatttccatcacaacaaccatatctgcaagctgcaaacattttcaacaagccgcaactatcatatccgcaagcggcaaaccaatttcgaccaacaacaaccaatattcaaaaggccgcaaaccanaagttttccgcaaaccanaaacaaaccaaattttcgca

SEQ ID NO: 98386 - DNA, 456 bp, Triticum aestivum
  unsure (1)..(456): unsure at all n locations
  Clone ID: PAT_TA_98386
ctggaggtggagtcctcggacaccatcgacaatgtgaaggccaagatccaggacaaggagggcatccccccggaccagcagcgcctcatctttgccggcaagcagctggaggatggccgcaccctggctgactataacatccataaagagtctaccctccacctgntgctcaggctccgtggaggcatgcanattttcgtcaagaccctcaccggtaagaccatcaccttggaggtggagtcctcggacaccatcgacaatgtgaaggnanntattcaggataaggnttggcatccctccggaacaagcangccttatcttccgccggnaagcaactccagggattgcccgcacccttgggnagactttnaacatncaaaaangggngttccaaccctccancctnggggcncaaaggtttccctnggggggggaatncaanaanttttcccccna

SEQ ID NO: 98387 - DNA, 449 bp, Triticum aestivum
  unsure (1)..(449): unsure at all n locations
  Clone ID: PAT_TA_98387
tctgatcacccactagctagccagctagcagcttaaggaactancttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcnatnaacaaggagtgctgctccggcgttcaagggctgaaagggcttggccccaacaancccggaccgcaaaataaccttcaaggttnctcaaaaanccctcccaacaaanaatcaagttcaataaanattgggnaaaggccncccggngtttcccgggaaanttnnggggttnaagggttccccttccccaaanaanaatttcaaanaaatttgnaaaaaaattttnaan

SEQ ID NO: 98388 - DNA, 416 bp, Triticum aestivum
  unsure (1)..(416): unsure at all n locations
  Clone ID: PAT_TA_98388
ctcctcctccccctgcccagatccccccctattggctcccgccgcctagtccggcgatccgcgcggctgatctcgctcgcccttgtttttccgtcaagatgagtcgtggcgggagtgctggtggtggtcaaagttctctgggttacctgtttggagatggcgagcctgcaaagcctgctgcagcaccaagctgcgaagcccgcacctgctgagaaaccaacaccggcagctgctgatgtagccaagcagattccaactggcattccangtaaccgggcgaacaactattaacgtgcaaatggncaaaaaangggcaacttccttaagggncgttcntcaaacaaaggtcaangcgnccccggnngggggtcctccctgggntaacttttttgggggaaagngaggttaaggatggt

SEQ ID NO: 98389 - DNA, 438 bp, Triticum aestivum
  unsure (1)..(438): unsure at all n locations
  Clone ID: PAT_TA_98389
acaaccaccattttcgcagcaacaacaaccaccattttcacaacaacaaccaccattttcgcagcaacaacaaccagttctaccgcaacaaccatcattttcacagcaacaactaccaccattttcacagcaacaatcaccgttttcgcaacaacaacaaatagtactacaacaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcangcaatgcagccctggggggnaatgccacaaagtcntgctaggtcgcaaatgtttgcannaaaggnattggccatgtnagngcaacaacnantggttgncaaccagtt

SEQ ID NO: 98390 - DNA, 183 bp, Triticum aestivum
  unsure (1)..(183): unsure at all n locations
  Clone ID: PAT_TA_98390
aagcaacccagcatcggngaggcgaccaacccccaccaactcccgccagcccccacctacccccgccgcctctgctgttcgcgngcgatgcangcnctcctcgccccgcctgtnctcanggcctccccttcncgntccnccgccgcngttctcctccnctgtcncggnggntcgtctcnctct

SEQ ID NO: 98391 - DNA, 444 bp, Triticum aestivum
  unsure (1)..(444): unsure at all n locations
  Clone ID: PAT_TA_98391
aaaacaacaacaacaaccatcgagccaggtctccttccaacagcctctgcaacaatatccattaggccagggctccttccggccatctcagcaaaacccacaggaccagggctctgtccagcctcaacaactgccccagttcgaggaaataaggaacctagcgctacagacgctacctgcaatgtgcaatgtctacatccctccatattgcaccatcgcgccatttggcatcttcggtactaactgagaagaaaataactctagtactagatatatgaaacaccgttttctcantccaaggtttggtcattgtagccttgaaaaaatnatggtgncatggcactaaccatgttagaatcccggactntaccangtttaaaacnttgggaataaaagaaaaaananaagntctttttctanaaaaaaaaaaaaaaaaaaaaaagg

SEQ ID NO: 98392 - DNA, 423 bp, Triticum aestivum
  unsure (1)..(423): unsure at all n locations
  Clone ID: PAT_TA_98392
ctcaactggagaacaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgattcccaaagcagtcaagatgtgaggccatccaacaacgtcgtgcacgccaatcngtttttgcaaacancaacaacaatttggggaacna

SEQ ID NO: 98393 - DNA, 422 bp, Triticum aestivum
  unsure (1)..(422): unsure at all n locations
  Clone ID: PAT_TA_98393
ggttcccaacagctacagcaacatactccgcattccgcgagacgaacaaggatgctgcattttccctcttcctccgcttactccccccaagagtgttgtacctactccacctctccctgagcttacttacgccttggaaggagagatacgagaggacgccccctccttcacctgaactgccaccgctcgctcgagcggtttcatctctttcacaggggatttcgtgggatccaagtcgcgtggcggccgatctcgtacagtgcgtcgacttccgcccccatctctccggagatctccgggttggagttggagcacaagaacaagtttctcctccggagaatttgacgggttccccnaatttgaataagccttgggtcctctcaatcaaaatttancctcananaaaccgggnccnccgcccn

SEQ ID NO: 98394 - DNA, 389 bp, Triticum aestivum
  unsure (1)..(389): unsure at all n locations
  Clone ID: PAT_TA_98394
gatgcgctcacgcgctctgctcgtcctcctcctctgctctctcctcgccggcgcggccaacgccgagccctccccggacccgacgtacaaggactgccacccaggcgacaaggcggcgctgctcgccgtcaaggccgccctcggggaggcctancacttcgcgtcctggacgcccgacaagcccctgctgcgactggtaagaagtcacctgcgaacanttcancggncgcgtcgtcgggctcgccgtcttccaagaagccaacctcaaggggaacaatcccancggcctccccgggcttccccaactggaangaacttaaccttgggcaacttcccgggggtcttcgggcccaaanacggccgggcaaatgggaaaagttccncaaact

SEQ ID NO: 98395 - DNA, 237 bp, Triticum aestivum
  unsure (1)..(237): unsure at all n locations
  Clone ID: PAT_TA_98395
gtatccgaaaaatggaccaccaatgtttagtcaatggtccgatccatgtagcggtgaaaaataaagtgcaatgcattatcatgtgtggactagactggcactagttcaaacttgggaataaaaggcaaactaagttattttctgcaaaaaaaaaaaaaaaaaaaaaaaaaaaaaaaaaaaaaaaaaaaaaaaaaaaaaaaaaaaaaaanaaaaaaaaaaaaanaaaaaaacaaaaaa

SEQ ID NO: 98396 - DNA, 463 bp, Triticum aestivum
  unsure (1)..(463): unsure at all n locations
  Clone ID: PAT_TA_98396
cacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacaggccattatcccagcaaccacaacaaacatttccccaacctcaacaaacattccccccatcaaccacaacaacaagttccccagcctcangcaaaccacaacaaccaatttctncangccccaannaancaatttccccccaaacaaaccancaaacaanccatttccccccaagnctncaaacaaccaanaacaaaccntttttccccaggcaaaccaacaaacnaaccaattttccccananctcaaaaaaaccccaaaaaaaaccaattttccccaaaaaanccnaaang

SEQ ID NO: 98397 - DNA, 422 bp, Triticum aestivum
  unsure (1)..(422): unsure at all n locations
  Clone ID: PAT_TA_98397
ccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagtttgtttgacccgcctaaaccacaaacaagggcactcggtcaaatttctgaanagacttggggtccaaanttctgacgttnanaaatgctattaacctggggtnatcaacncctccanncnatatcctgaatnttaaacaan

SEQ ID NO: 98398 - DNA, 436 bp, Triticum aestivum
  unsure (1)..(436): unsure at all n locations
  Clone ID: PAT_TA_98398
atctctctcgactccggccagtctcttcttctctagaaagctagcgaggcttggaggtgagcgaaaatgccggtcagcaggatcgccgtggggagccaccgtgaggtgtacgaggtcggcgccctcaaggcggcgctcgccgagttcatctccacgctcatcttcgtcttcgccggccagggctccggcatggccttcancaagctgaaccccgacggggcggggaaccccgccgggctgatttccgggggggatagcgcaacccttcgccctgttcgttggggtgtccgttgggcgcnaaaattcccggnggggnangttaaaccccggccgtgaaccttcggnggcccttcctngggggggaaaaatcaaccctccttccgngggctgntccaaatnggtttnncccaanctccctggggttccaaanggcggg

SEQ ID NO: 98399 - DNA, 419 bp, Triticum aestivum
  unsure (1)..(419): unsure at all n locations
  Clone ID: PAT_TA_98399
gcaaaaggtagggtttccagttgcaagccgccccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacatcggcttcatcaagtaccgttaagaatggaaacctcaaaggaagcaagggctaggaaattatcaacgaactgtgggggcttcatnaaagtnctgatntttatcctaaaaagctatgttatggaactaactaataatngtttgatncctngggggacaaaaacaatgaaaccatnttaanttgaccnnctntttgggcaangttaaaaccgaataattcggttccc

SEQ ID NO: 98400 - DNA, 395 bp, Triticum aestivum
  unsure (1)..(395): unsure at all n locations
  Clone ID: PAT_TA_98400
ctcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacaagtgtagcccagttgctgatatgtcattcctccggtcacaggtggtgcaacatancanctgcttggtaatgtgggagcantnctgtcancaactaaaagcgattcccaangcantcaagaatgcnangggcaatccaaaaaacgttngtgnacccccatttt

SEQ ID NO: 98401 - DNA, 437 bp, Triticum aestivum
  unsure (1)..(437): unsure at all n locations
  Clone ID: PAT_TA_98401
aaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcnagccaagtctcctaacancaagcctcaaggacaatatccatcaaggcaaggntcccttccantcatcctcaacaaaaccccacaagggccaangggtntgttcaancctcnaaaaaattggcccantttcaaggaaattaagggaatttttngcctngcaaaacccgcccnnnaaaaggttcaatgtntaaaanncccccccaaattgcn

SEQ ID NO: 98402 - DNA, 406 bp, Triticum aestivum
  unsure (1)..(406): unsure at all n locations
  Clone ID: PAT_TA_98402
acggcacgcccaaacccaaagccaagtcgcactcctcctcctcctatcctctccctcgccgaggcggcgaccggccggcgccaccgaccgcgcgtctccgttcaattcggcgaatttggggctcaggaaagaaaaggaggagcgacttctctctggtggtcgggaattcaagacaaaatgcactttccttgcatcaattcaacggcctgcaagtttttgagctttttgtccngtttccctggggaatgggatgccaaaaaaattcctggcaaatgggtttannaaaaanaanaaanagaccccttnaaaaaaaaaggaaacccctccnnaaattggnaaanaaaaaacttggaaacaancaaatttaagggccccttnnaaaaaaanggggnaaaaaaacttcaaa

SEQ ID NO: 98403 - DNA, 331 bp, Triticum aestivum
  unsure (1)..(331): unsure at all n locations
  Clone ID: PAT_TA_98403
aacaatttccccagacccagcaaccacaacaaccatttccccagccccaacaaacattcccccancanccccaactaccatttccccaacaaccccancaaccattcccccagcctcaacanccccaacaancantttccccagtcacagcaaccacancaaccttttccccagccccaacaacanttcctgcagtcccancaaccgcaacantcattcccccagcancancatccgttgattcagctatctctacagcaacagntgtaacccctgcaagaattttctcttgnagcanatggcancccctgtgtnattggtgtcatcctca

SEQ ID NO: 98404 - DNA, 443 bp, Triticum aestivum
  unsure (1)..(443): unsure at all n locations
  Clone ID: PAT_TA_98404
gcaacactagttaacaccaatccaccatgaagaccttcctcgtctttgccctcctcgccgttgcggcgacaagtgcaattgcgcagatggagactagatgcatccctggtttggagagaccatggcagcagcanccattaccaccacancagacatttccacaacaaccactattttcacancaacaacaactatttcctcaacaaccatcattttcgcaggcaacaaccaccattttggcangcaacanccaccattttctcagcaacaaccaattctaccacaagcaacaccattttcgcagcaacancanctagttctaccgcaacanccaccattttcacagcancaancaaccaggtttttacctnccacaanaantcnactttttccaacaacancnanccagcaccancaggnntgggtgcancaancanatcccc

SEQ ID NO: 98405 - DNA, 445 bp, Triticum aestivum
  unsure (1)..(445): unsure at all n locations
  Clone ID: PAT_TA_98405
ccaacttctgccagcaaccacancaaactattccccaaccccatcaaacattccaccatcaaccacaacaaacatttccccaaccccaacaaacatacccccatcaaccacaacancaatttccccagacccaacaaccacaacaaccatttccccagccccaacaaacattcccccagncanccccaactaccatttccccaacaaccccaacannccattcccccaggcctcagcanccccaacaaccatttccccagtcacaacaaccacancanccttttcnccagccccaaacancattttccgcaancccccagcaaccacaacantcantcccccaancaacagcaaccggngattcangtcatttctacanacaacagatgaccccctgcaaagattttcctccttgcagcaantgcaaacatgtngncattggntg

SEQ ID NO: 98406 - DNA, 292 bp, Triticum aestivum
  Clone ID: PAT_TA_98406
aagaattacgtcaagccaatgtcaataccaatccccttatttacgtccctgaacaaatggactcctatgcgttgtagatatcatcgttggcccaacgggcgatgactctacttgatattcatcgctgcataccttactcacgtaagctaaatgaccaaagctttctatatgatggacctctgcctatgtagctttgtttcataaaagcaatgtaaataagctatcatgaactgatatcatacctttcttatatatgctatgtatgaacttcaaatctaaatatccaaaggtg

SEQ ID NO: 98407 - DNA, 435 bp, Triticum aestivum
  unsure (1)..(435): unsure at all n locations
  Clone ID: PAT_TA_98407
aacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacagcaaccactattttcacaacaacaacaactatttcctcaacaaccatcattttcgcagcaacaaccaccattttggcaggcancaaccaccattttctcagcaacannccaattctaccacagcagccaccattttcgcagcancaacanctangttctacccgcaacanccaccattttcacaagcaacancaaccaagttttacctccacaacaatcaccttttccacatcagcagcnncaccaacagctggntgcaacaaacanatccctg

SEQ ID NO: 98408 - DNA, 288 bp, Triticum aestivum
  unsure (1)..(288): unsure at all n locations
  Clone ID: PAT_TA_98408
actactactacaacaacaaatccttcaacaaattctgcaacaacaacaactgattccatgcagggatgtcatcgtcttgcaacaacacaacatancgcatgaaagctcacaagtattgcagcaaagtagttaccaagtgttgcaacaattatgttgtcagcagctgcggctgatccccgagcagtcgcggtgccaagccatccacaatgtccgntcatgctattattctacatcaacaanaatcaacatcancantcaacaaacaacaancaaggggacnaacattca

SEQ ID NO: 98409 - DNA, 466 bp, Triticum aestivum
  unsure (1)..(466): unsure at all n locations
  Clone ID: PAT_TA_98409
gttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacancaacaactatttcctcaacanccatcattttcgcaagcancanccaccattttgggcaagcaancaanccaccatttttctcangcancaanccanttcctaccaaaggcanccnaccattttncgcnagnaatcanncaanctagcttctnnccgnaaacaanccaaccaattttcacanggaaaccancaaccaagtttttaccttccaacaancaaatcaccttttccacaacaacaacanccaccaacaggctggggngcnaanaacnaantccctgttgttcang

SEQ ID NO: 98410 - DNA, 444 bp, Triticum aestivum
  unsure (1)..(444): unsure at all n locations
  Clone ID: PAT_TA_98410
ataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcantcccgctatgaggcaatccgtgctatcatctactccatcatcctgcaagaacaacaacaggttcagggttccatccaaactcntcaagcagcanccccaacagttgggccaatgtgtttcccanccccaacaggaggtcanaacanccaactcggngcatcancctcancaacancantttggcacaagggtncttttttggcagccacaccaagantacctcangcttgagggtgntntnctttcaattgcngctnccgttnc

SEQ ID NO: 98411 - DNA, 437 bp, Triticum aestivum
  unsure (1)..(437): unsure at all n locations
  Clone ID: PAT_TA_98411
cccgagtgctcctcctcccccgatggccgacgccgcccttccctcgcccgctatgctgccgccctccgattccgacctgctcctgccgccgtccgattccgacctgctcctgccgcccaccgacgccccgacccccgaagccgccgccaggacccccaacctccccgacacccccgcctccgccgcggatcccgagacccccttctccgacgccgccaccgcctccgacgccgacctttccgccgtcgccccgctctangcggcggccgtggatgacgccgacgacgacnggatcaacgacccctcgggcgccgcccagnaagcacatgaccctcgcgcccccggccccgcccgaccaaggaaatccaannaangaagggtggcaantgcgttctggatcaggcccaactncccgcaaggggggaatgaagaaggnt

SEQ ID NO: 98412 - DNA, 436 bp, Triticum aestivum
  unsure (1)..(436): unsure at all n locations
  Clone ID: PAT_TA_98412
gcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaggaaataaggaacttagcgctgcagacgctgcctgcaatgtgcantgtctacatccctccatattgctcgaccaccattgcgccattttggcatcttcggtactaactgagnaagngaagaactcnantacnaagatatatgaatcaccgttttcttattcgaaaggtttgatcgtntgtagcggtgaaaaaaattaaantgncatgcantatcatngtnaggaacccggancctntt

SEQ ID NO: 98413 - DNA, 436 bp, Triticum aestivum
  unsure (1)..(436): unsure at all n locations
  Clone ID: PAT_TA_98413
ggtgcacggacgtggacttctcctggtacgagctcccgggagccggcgccggctgccgcgtgcacggcggcttcatgaaggcgctgggcctgcagcggcgcggcggcggctggccgagggacgtcgccgaccccaccggcgccggcgacggaagaccgttcgcctactacgccatcagggagaagctcaagaggttcctggacgggaacccgggcgccaggttcgcggtggccgggcacagcctgggcggcgcgctggccgtgctgttcccgacggtgctggcgctgcacggggaagaggccgtgctgggcaggctgcagggcgtgtacacgttcggggcagccccgcgtggggcgaccaagcggctcgggggcgttcaatgggcgccgcacctgggaaganncccagcccggtacttcaggttccgtctanctgn

SEQ ID NO: 98414 - DNA, 442 bp, Triticum aestivum
  unsure (1)..(442): unsure at all n locations
  Clone ID: PAT_TA_98414
gtggcgggcataaatatatactcctcgggaactgggtcatggaacttcatggaaagtgggtgggactctgattccacaatttgtggcagatgtgtgtttcatcaagggatgctgcattttgtcagcgctcagtctacagtagtgtcggtagatgtggaggggaagaaatggagggcaatttcagtgccagaaggagtggaaaggtctgagcttggttttcttgctcggtcccaagggcacttgcattacatggtgcacanngggattcgtcaagaantttccatctggtgtcttgagaacgcatgattcggntgaatggacngcttgaagcaccgtgtgnggcantaaacaagttgnctgaacgccgngaggtaaagntctactactaatgaantactatancatctccgtttcatcccaagatncggtagntttgaattnt

SEQ ID NO: 98415 - DNA, 442 bp, Triticum aestivum
  unsure (1)..(442): unsure at all n locations
  Clone ID: PAT_TA_98415
ctcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggnggcgctgtcgtgcgggcaggtggactccaacctcgcgccgtgcgtggcgtacgtgacggggagggcgtcctcgatcagcaaggagtgctgctccggcgtgcaggggctgaacggccttggcccgcaagcangcccggtcccgcangataaccgtncagggtgncctcaagaggcctcncccaccagncatcanntccaattcaancaatnggggcangggtctnccgggcgtgncccgggcnaaagtnntggcgttcancgtngctcctttccccnatcagcnatngttcc

SEQ ID NO: 98416 - DNA, 222 bp, Triticum aestivum
  Clone ID: PAT_TA_98416
gtggattttctagagtaatccccatggtaattgcactgaaattccattctagttacaaataaaaaacactgtaactctactgaaatgcaatgtaattacacaactagaaaaaatacacattatttgagcacttgatatgtcaacactcaatagtagcttcactttcagctcctaagttaattgcacatctctaatatgcaagcacccatgagacacgctcga

SEQ ID NO: 98417 - DNA, 354 bp, Triticum aestivum
  unsure (1)..(354): unsure at all n locations
  Clone ID: PAT_TA_98417
gcaacactagttaacaccaatccacaatgaagaccttcctcgtctttgccctcctcgctcttgcggcggcaagtgccgttgcgcaaatttcacagcaacaacaagcaccgccattttcgcagcaacaacaaccaccattttcacagcancaacanccacnattttcgcaggaacaacaatcaccattttcgcagcaacaacagnatccaccatttgcgcagcatnaacaaccacngttttcaccatcatcaccaatttcacaggcagtcnatantcacnattttcacagncacncnacaanccacnttttttcaacantcatncaancangccaactcactnttcggcctgcaa

SEQ ID NO: 98418 - DNA, 453 bp, Triticum aestivum
  unsure (1)..(453): unsure at all n locations
  Clone ID: PAT_TA_98418
gttaacaccaatccaccatgaagaccttcctcgtctttgccctcctcgccgttgcggcgacaagtgcaattgcgcagatggagactagatgcatccctggtttggagagaccatggcagcancaaccattaccaccacaacagacatttccacaacaaccactattttcacaacaacaacaactatttcctcaacanccatcattttcgcagcaacaaccaccattttggcaancagcaaccaccattttctcagcaacanccaattctaccacagcaaccaccattttcgncagcancancangtagttctaccgnaaacanccaccatttttcagcagcnaccaacanncaagtttttancctccacanncangtcacccttttccncaaacagcacccangcaccnagcnngcgggngccagnaacaanatcccctgttgttnaggcctg

SEQ ID NO: 98419 - DNA, 448 bp, Triticum aestivum
  unsure (1)..(448): unsure at all n locations
  Clone ID: PAT_TA_98419
tggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagaagggttccgttactaaacatgtttactttcattgtnngtaacgtatttggttttcaaaagcccctaacgtgctcctacggttttggagggatctacnnaagttcccccctacctattccaaaaacntttccaaggggccgcccttcatgggcatccnaangtt

SEQ ID NO: 98420 - DNA, 298 bp, Triticum aestivum
  unsure (1)..(298): unsure at all n locations
  Clone ID: PAT_TA_98420
catccttcctccccgcagcctcaagcaattccctttcatcatcgttatcgtatcacaaccaaccaccgcctccccatccctccggcctcgacctgcagctgtcggaggtctcgacctgcagctggtcgcgtgccccgttgtgacccctgtcatttccctcctgactttcctcttcgtcagtgatgagctcctgtgagcagtgatctgttgtctgtgtcatcctcaaccacccttgagcttgcaanataggtcactgccaacnnacgggtccgattgcatatatgcccgctgtgtatct

SEQ ID NO: 98421 - DNA, 456 bp, Triticum aestivum
  unsure (1)..(456): unsure at all n locations
  Clone ID: PAT_TA_98421
gagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacancaacaactagtcccccagctccaacagccattatcccagcaaccacaacaaacatttccccaacctcaacaaacattcccccatcaaccacangaacaaggttccccaagcctcagcaaccacaagcaaccatttctccaggccccaacaaccattcccccaancaagcanannaatccattccccccagactcaacaanccacaantactcattttccncnagnaaccacaaataacctattttccccangactcaacaaaccccgaanaaccnanttcccccaaananccacaagnaactaattccn

SEQ ID NO: 98422 - DNA, 456 bp, Triticum aestivum
  unsure (1)..(456): unsure at all n locations
  Clone ID: PAT_TA_98422
caacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgagggagatcccatgggctgctgctgggtggctganttacgttgttgaagtcnaccgggngtttttcaactgnacaagggncaagggctggcagntcaaaattaagggggtggggtgccaaagaaaggtcaatcaatttctgcttcccaagcaaangatgct

SEQ ID NO: 98423 - DNA, 450 bp, Triticum aestivum
  unsure (1)..(450): unsure at all n locations
  Clone ID: PAT_TA_98423
ggtatcctcgctgctgatgagtccaccggnaccatcggaaagcgcttcgccagcatcaatgttgagaacgttgaggacaaccgccgtgccctccgtgagctcctcttctgcacccctggtgccctccagtacctcagcggtgtgatcctcttcgaggagaccctgtaccagagcaccaagggtggcaagcccttcgtcgacatcctcaaggcgggcaatgtcctccccggaatcaaggtggacaagggtaccatcgagcttgctggaaccaacggtgagaccaccacccaaggctttgatgaccttggcaagcgctgcgccaaagtactatnagggctgggtgccccgcttccgccaaantgggcgtnnaatccttaaagattgggcggccnancgaagccaatcaaangntcctccaatcgaaccangaacncttnanggttctgggnt

SEQ ID NO: 98424 - DNA, 462 bp, Triticum aestivum
  unsure (1)..(462): unsure at all n locations
  Clone ID: PAT_TA_98424
aggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagancggcaagccattgcactacaagggcanctcgttccaccgcgtgatccccgacttcatgtngccaagggcggcggacttcacnaaagggcatngggcanccgggtgggngagtccatcttnnggcgnagaagttcgcccgnccgaanaaantttcgtccacaatncacaccannccncggggnttcntcctccantggccantgcgggggccccaaacaccaanngggctcccaaggttcttcat

SEQ ID NO: 98425 - DNA, 468 bp, Triticum aestivum
  unsure (1)..(468): unsure at all n locations
  Clone ID: PAT_TA_98425
ccgcctcctccctccggcccccgtccgacctccgcgccgccacccatcccaccccaagacgacgccatcccgctcccgtacacctcctctcccgcacgagcaccaaccgacaccgcctcccgttcgagcaccgcctccgccgccaatctccgctcccgcacacactgccgccgtcgcctctctgcttcagcatccaccgccgccagcctatcnactcatcatccacacaaaagggggaaagaaaagggaaatcccactcccatccaaggncgccgcccgtnttctgattttgatntgccgtccccccaacgcccgggactaaccctaanccccgtccggttttctggccgggggggcggcagtcanatgnacaagcaagtgattgggccggggganctncgggngttcccaanatttcctccccgttcggggggggcttatncggaccngaagnggccctttcgcttg

SEQ ID NO: 98426 - DNA, 448 bp, Triticum aestivum
  unsure (1)..(448): unsure at all n locations
  Clone ID: PAT_TA_98426
agacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagctgcaaccatttccatcacaacaaccatatatgcagctgcaaccatttccgcagccgcaactaccanatccgcagccgcaactaccatatccgcagccgcaaccattttcgnccacaacaaccatntccacaccaacaaccatatngggaagtngtctttacnagcatcgggtggncaatganaatgnacgacctngtaatacaangngggatggatcatcgnttgtttaggtccaatgcagtggttcactgttacc

SEQ ID NO: 98427 - DNA, 325 bp, Triticum aestivum
  unsure (1)..(325): unsure at all n locations
  Clone ID: PAT_TA_98427
tttttttttttgccggngaaacgaantttattgcatgtcacaaacattgtccactggnacaaaacggacanacagctanagctccaagaaatgtcacaantcggcaccgatacatggntgantacattccaaagggcaacaatacatcacanaattgtggtacaagggccnccaggccgtnancagngaaatggnggatgatcatttatnacgaaagancacttttatctatctaggcttccnccacacggtacgggacacggttgatctcgngtccgttggntgcaactctcaancaanggangaactgntnccgctcttcttt

SEQ ID NO: 98428 - DNA, 452 bp, Triticum aestivum
  unsure (1)..(452): unsure at all n locations
  Clone ID: PAT_TA_98428
ccccaatccaactcgcgcagcagctccaagaggatcgtcagcgaccatgtccgggcgcggcaagggcggcaaggggctcggcaagggcggcgccaagcgccaccggaaggtgctgcgcgacaacatccagggcatcaccaagccggccatccggaggctcgctcggaggggcggcgtgaagcgcatctcggggctcatctacgaggagacccgcggcgtgctcaagatcttcctcganaacgtcatccgcgacgccgtcacctacaccgagcacgcccgccgcaagacccgtcaccgccatgggacntcntctacgccctcaagncnccanggcccgcancctcttacggcttccggcggnttanggccgcctggccccccgccaagattggtcgtcaagtctttttcggcccccntgnanattcccgantgtntttattnccgcccctttg

SEQ ID NO: 98429 - DNA, 474 bp, Triticum aestivum
  unsure (1)..(474): unsure at all n locations
  Clone ID: PAT_TA_98429
gttaacaccaatccaccatgaagaccttcctcgtctttgccctcctcgccgttgcggcgacaagtgcaattgcgcagatggaagactagatgcatccctggtttggagagaccatggcagcagcanccattaccaccacaacagacatttccacaacaaccactattttcacaacaacaacaactatttcctcaacaaccatcattttcgcagcaacaaccaccattttggcagcancanccaccattttctcagcaacaaccacttctaccaacagcaagcaccattttcgcagcaatnancnacctagttccaaccggcaatgaagcaaccanttttncaacaggnaaacaacaaacccagnttttancctnccaacaacnaatncaccgtttttccacgaacaannaaccaaccaccaanctaggttggggggnancaaacaannnccccgggtnggttcannccaatccn

SEQ ID NO: 98430 - DNA, 294 bp, Triticum aestivum
  unsure (1)..(294): unsure at all n locations
  Clone ID: PAT_TA_98430
cacacctcctcacacaaggtctgggcacctacactggtacagccatagctagctagcgcatactactacaccggagggagcgagcgagcggccatgacgagcgaggtgcagtcggcgccgccgacgccgcggccggtgtccgccccgccgtcgcagatgcactctccggcgcccagccggtcgccgctgcgcgcgatggcgtcnccgctcgccagncccgtgaataangcgggtggcgancgtgaggggggtacttggcttgaaagttgtgntatcttcnnacaacgntcattc

SEQ ID NO: 98431 - DNA, 323 bp, Triticum aestivum
  unsure (1)..(323): unsure at all n locations
  Clone ID: PAT_TA_98431
gcaagctgtggtcaatacaaatccaccatgaagacctttctcatccttgccctccttgctatcgtggcgaccaccgccacaactgcagttagagttccantggcacaattntanncacaaaatccatctcangaaaaagcacaaagagcaatttcattgnacaacaacaaaaattntaaggnagcaacaacatttcancacaacaaccatancacagcgcaacatttncatcacaacaacattntgnagtggaacattttttgnagccgcaatacaaatttccagcacaacantttntcanaaaaacattttnaaacgnaccc

SEQ ID NO: 98432 - DNA, 436 bp, Triticum aestivum
  unsure (1)..(436): unsure at all n locations
  Clone ID: PAT_TA_98432
gttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcaagcaacaaccaccattttgggcagcaacaaccacattttctcaagcaacaaccaattctaccacagcaaccacattttnggcancaacaacancanttctaacggcaacaacacattttnnacaggnaacaacacagttttacttccaanaacatcacttttttccaaaanaacaacacaccaacagttgggnggaanaaaaacccngtttttaancaccatttt

SEQ ID NO: 98433 - DNA, 481 bp, Triticum aestivum
  unsure (1)..(481): unsure at all n locations
  Clone ID: PAT_TA_98433
gttgcccttgtcctgattgttgccattgtcctggntgttgcccttgtcctanctgctgtgganaacttggatantacccttgttgcccttgtccngantgttgcccttgnccnanttgccgcccttgnccnanttgttgcccttntnctatttgcagcccttgacctggttgttgcctntgtcctgcntgttgcnganaagttgggtagaaaccttgttgtccttgcncctatctgttgcccttgtcctgnctgctgcaaataagttgggtaanaanccatgtncccttgtcntatctgttgcccttggcctgantgctgcaaacaanatggattantaccttgtagtccntgacntgactgatncacaaaattnggtataccttgtngcctgtccaantctgcatttgncgatntccctgtatgaagtntggaaactnggctgaaaaaattgccncnatgaactacctggtaaacctgaa

SEQ ID NO: 98434 - DNA, 491 bp, Triticum aestivum
  unsure (1)..(491): unsure at all n locations
  Clone ID: PAT_TA_98434
cctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtgggacacatcgtcatcaaggccncccttgcaaggttgttgagnctccacttccaaagactgggaagcatgtcacgcaaagtgtcacttttgttgcaatttaatcctttnatgggaanaacttntaggaacgttcctttantccanaatgnacttncccaagnttancgccaaatttcaactgatttacaaaccgatatgnatttcaccttctaactaaaatggacactaggtancngattncccnaagattttgctggcatntaaacggnttttatggaagctgatctgncgtgaagtccccatggtganaaaattcctgtnaggaatcgtg

SEQ ID NO: 98435 - DNA, 399 bp, Triticum aestivum
  unsure (1)..(399): unsure at all n locations
  Clone ID: PAT_TA_98435
ctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggcactttgacagttggtgagaccctgcctgactacttcaaggcggcccgcccttctgggcaatgctgcaacggngtcaaaaactccatacaagggcatttccaaacatnttnccaancgctttgaatngctcagggaattccncctngantcaaaatctaaannngggaaaacccgananaccccccaatgngggtttacctccaaaacanaattctaaattangganangggtnaangggaat

SEQ ID NO: 98436 - DNA, 513 bp, Triticum aestivum
  unsure (1)..(513): unsure at all n locations
  Clone ID: PAT_TA_98436
gcaacactagttaacaccaatccaccatgaagaccttcctcgtctttgccctcctcgccgttgcggngacaagtgcaattgcgcagatggagactagatgcatccctggtttggagagaccatggcancagcaaccattaccaccacaacagacatttccacaacaaccactattttcacaacaacaacaactatttcctcaacaaccatcattttcgcagcaacaancaccatttgggcagcaacaaccaccatttctcaagcaacaacaattctaccacagcaacaacattttcgcagcaanaacaactagttctaccgcaacaancacattttcaacagcaacaacaccagttttactcccacaacatcactttttccaacaacaacaacaanncaacaantgggtgaacaacatcctgttgtcaaccatccattttgcagnaagctaacccatgcaantatccntcaacaanatgcaaccctgtgggaatgcacacgtcttgctagncn

SEQ ID NO: 98437 - DNA, 495 bp, Triticum aestivum
  unsure (1)..(495): unsure at all n locations
  Clone ID: PAT_TA_98437
ggcaacaagggcagcaactagcacaagggcaacaagggcagcaaccagcacaagtgcaacaagggcagcggccagcacaagggcaacaaggtcagcagccaggacaagggcaacaaggtcagcagctaggacaagggcaacaaggtcagcagccaggacaagggcaacaaggtcagcagccaggacaagggcagcaaccgggacaagggcaccatgggtactacccacttcctccgcangatccaagacaagggcaacagccaagacaatggcaacaaccaagacaaaggcaccaaggtnttactaattccccgtttncactttggcaaaggcacaaggtactaccaattttctngnacaacaagacaaggcaacaccaagacatggnacatcngacaaggcanattggtatacaattttcccaanttnaaggcaagnaacgcaagacatggtncaccagcaanggcacangtttaccanttcccaaaacnaaga

SEQ ID NO: 98438 - DNA, 394 bp, Triticum aestivum
  unsure (1)..(394): unsure at all n locations
  Clone ID: PAT_TA_98438
cgagcctcacactctctgatcagagtagcactagcttcagctagccagcctctgccactccggtcattttcttgcatccacgacggcaatggccaccgctgatgtccaagaacccatcggccgcgctgacggaggaaggcgcccgcggtggagaaagccggtcgccgccgaggaggtcgcgaaagacggaggaanccccgcgccggttggaagcngaagtccaagggcctgccccngtccaaggtttaaggaaacaaaggaggaagngccggaannattttaggaanagganaacnaaagnacccaaccaacaantgcggccaaccggangccaaggccccnttgtcnaaacaaaacnaagaggctttgnttaggnaaaccggggngccagagt

SEQ ID NO: 98439 - DNA, 282 bp, Triticum aestivum
  unsure (1)..(282): unsure at all n locations
  Clone ID: PAT_TA_98439
cgggttctgaaacctgggatgcgcaaggaagctgacgagcgggaggccctcacgggccgcaccgctggccgaccctgatcttctgtgaagggttcgagttggagcacgcctgtcgggacccgaaagatggtgaactatgcctgagcgggcgaaaccagaggaaatctggtggaggtccaaaggatactnacgtgcaatcntcgtctaatttggtaatanggnaaaagactantcaacaacatannngttccccccaatttcccccaagaaaacctggccatt

SEQ ID NO: 98440 - DNA, 521 bp, Triticum aestivum
  unsure (1)..(521): unsure at all n locations
  Clone ID: PAT_TA_98440
accgcaacaaccaccattttcgcagcaacaacaaccacaattttcgcagcaacaacaaccattcccgcagcaacaacaaccacttctactgcaacaacccccattttcacaacaacgaccaccattttctcagcagcagcaacaaccagttctaccgcaacaaccaccattttcgcaacagcaacaacaacaaccaatctaccgcaacaaccacctttttcgcaacaccaacaaccggtcttccgcaacaacaaatacatatgttcaagcatctatcttggcagcaagtaaaccatgcaaggnatcctccaagcaacaatgcacctgtngnaatgccacaaancctggctaagncccaaatttnttggcanacattgccatgttatgcaacaacaagtttgccacaagtgccgggancccccngacatcacgctatgatcatccctgcaacatcnatcgttgtcctaaaaagacacaacatggcaaggtnnaacaacnaanaanaacaacccaaaatcggc

SEQ ID NO: 98441 - DNA, 483 bp, Triticum aestivum
  unsure (1)..(483): unsure at all n locations
  Clone ID: PAT_TA_98441
ggaaccaacaaatcccccagccgatctcgtctccggtcgactccagctccccctcctccggtcctcccccaccgccccaagatgcagatctttgtgaagacattgacaggcaagaccatcacccttgaggtggagtccgtctgacaccattgacaacgtcaaggcaaaaatccaggacaaggagggcatccccccggaccagcagcgcctcatcttccgctggcaagcagctggaggacggcagacccttgctgactacacatccaagaaggntcaaccttcaacttntcttcggcttcngggaaggaatnaattttttgtcaaaaccctcaactgggaanaatnacattnaggtggatcnncngaaaacantcaaaantcnaggnaaattcaagacaggnggaatcccccggcaanangctaactttncngnaacattttngaaggaagatttctactnanncaaaagancaccncactgtc

SEQ ID NO: 98442 - DNA, 484 bp, Triticum aestivum
  unsure (1)..(484): unsure at all n locations
  Clone ID: PAT_TA_98442
cgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatcttcaaggtgctcaagcaggtgcaccccgacatcggcatctcctccaaggccatgtccatcatgaatcctttcatcaaacgacatcttccaagaaactcgccggggaaggccgccaaattcgcgcgctacaacaaagaagccaacatcactccccgcgagattnaaaacttcgttcgcttgtcttccccggggagctcnccaaagaaccntctcccaagggnacaaancntnacaattaactcctccnagttngcccgccccctcatgnn

SEQ ID NO: 98443 - DNA, 508 bp, Triticum aestivum
  unsure (1)..(508): unsure at all n locations
  Clone ID: PAT_TA_98443
aatggtatttgttgttgcggtagaactggttgttgttgttgttgcgaaaatggtggttgttgcggtagaattggttgttgttgttgcgaaaatggtggttgttgcggtagtactggttgttgttgttgcgaaaacggtggttgttgctgtgaaaatggtggtagttgttgctgcaaatcccccagcaatcccgctatgaggcaatccgtgctatcatctactccatcatcctgcaagaacaacaacaggtcagggttccaatccaactcaagcagcagcaaccccaacagttngggcaatgtgtttcccaaaccccaacagcatccgcagcaacaacccnggcaacaacctccaacaacaacaattggnacaaggtacttttttcaaccacaccaagatactcaacttgaagtgatacttccatgcctccgtacctaacaacattgcntgtcaagttccttttatagacacactatgtgccatccgctttgccccgattggccacgga

SEQ ID NO: 98444 - DNA, 499 bp, Triticum aestivum
  unsure (1)..(499): unsure at all n locations
  Clone ID: PAT_TA_98444
gcaacactcgttaacaccaatccaccatgaagaccttcctcatctttgctctcctcgccattgtggcgacaagtgccattgcacaaatggagaatagccacatccctggtttggagagaccatcgcagcaacaaccattaccaccacaacaaacattatcgcaccaccaacaacaacaacccatccaacaacaaccaccattttcacaacaacaacaaccaccattttccgcagcagcaacaaccatcttcacaacaaccaccttttccacaacaacaccaacagttccacaacaacaatccctgttgttcaaccatccgttttgcagcaagctaaacccatgcaagtgttcctccaaacagcagtgttaccatgtgggaatgtccaactcttgctangtcacaatgtggcaacagagtaattgcaagtggatgcaacaacaatgtttccaacaactgccgnancccccgaacaacccgtctgaagnatccgtnccatn

SEQ ID NO: 98445 - DNA, 351 bp, Triticum aestivum
  unsure (1)..(351): unsure at all n locations
  Clone ID: PAT_TA_98445
catatgcttgtctcaaagattaagccatgcatgtgcaagtatgaaccaatttgaactgtgaaactgcgaatggctcattaaatcagttatagtttgtttgatggtacgtgctactccggataaccgtaagtaatctaagagctaatacgtgcaacaaaccccgctcctgggaaggggcgcatttattaagataaaagctgacgcggctctgctcgctgattccgatattcatgataactccaacggnttncacggctttcgtgccggngangcaacattcaaatttctgccctancacttttccattggaaggataagggctacaatggnggtnaccggtnaccgaaatta

SEQ ID NO: 98446 - DNA, 465 bp, Triticum aestivum
  unsure (1)..(465): unsure at all n locations
  Clone ID: PAT_TA_98446
aacaaccattccccctacgaccgcaacaaccatttccccagcaaccccaacaatcacaacaatcatttccccagccccaaccccagcaaccccaacaaccatccatccttcaaccacaacaaccattaccccaacaaccacaacaaccatttcagcagccccaacaacaattatcccagcaaccagaacaaacaatttcccaagcaaccccaacaaccattcccccaagcaaccacaccaacctcaacaaccatatccacaacaacaaccatatgggagtancttacaagcatcggtgggcaatgaaatgaacacctgtttatacaagacggtggttatcgtgtttaatcaatgagcgttcaatgttacgatgataaataaantgatgtgcacatatgtgttacccccgactatactattcaaacatgggaataaaagcaaagaantcttgtcaaaaaaaaaaaa

SEQ ID NO: 98447 - DNA, 231 bp, Triticum aestivum
  unsure (1)..(231): unsure at all n locations
  Clone ID: PAT_TA_98447
naatttccccagccccancatccacaacacncatttccccagccccaanaaccccannctaccatttccgcaacaaccgcaacaaccattcccccagcancancaaccattgattcagccanacctacaacancagatnancccctgcaanaattacctcttgcagcaatgcaaccctgtgtcattggngtcanccctcgtgtcaatgatcttgccacnanntgattgcaa

SEQ ID NO: 98448 - DNA, 510 bp, Triticum aestivum
  unsure (1)..(510): unsure at all n locations
  Clone ID: PAT_TA_98448
caaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacatcattcccccagcaacaacaacgttggattcaagtatctctacaacaacagatgaacccctggcaagatttctccttggcancaatggcaacctgtgtcattgggtgtcatccctcaatatcaatgattttggccacaatnaattgccaagtgatgcaacaacatgtttgccaacaaatggnanaatccctcaagaagnccaattttgcancatccaaaaggtcctnattcancatcaagcancaaggacacgacaggctgatttcggngcactgttaacccttnanggcaggganatcaacncaanaacaagncaatggggngatag

SEQ ID NO: 98449 - DNA, 486 bp, Triticum aestivum
  unsure (1)..(486): unsure at all n locations
  Clone ID: PAT_TA_98449
gccgccgccaccgccgcgagagcggcgctccgcccggcgcccctcgccggccggggcctcggcctcggctcctccctgccgtcttcctcccccgcacgagccgcccgcatcctccgcaggtcggcggtggcggggctggagacgctgctgcccctgcacaccgcggtggcgtcggcacgcctcaagtcctgcatcgccgtcgactccacctgctgggtgctccctctcccaaggttttaaaaagcgcgtctgatcatggttaggagctgtgcagctgagaatgaagacaccgattagatacactttgcctttgtgacaaagagtgcacatgaagaaaccaatgaacattaagggattgcaaactgcagaatttccgggctggtnataattaaacacttgtaaactggcggtgcatcaaaccgtttaattttgtacgtgtaaacgacgtacatcaaaaccgtttgattttataactgtatntccatg

SEQ ID NO: 98450 - DNA, 498 bp, Triticum aestivum
  unsure (1)..(498): unsure at all n locations
  Clone ID: PAT_TA_98450
aagcaaaactagttagcaccaatccatcatgaagaccttcctcgtctttgccctcctcgccgttgtggcaacaagtgccattgcgcagatggatactagctacatccctggtttggagagaccatggcagcagcaaccattaccaccacaacagacatttccacaacaaccaccattttcacaataacaacaacaacaacaacaaccatttcctcaacaaccatcattttcacagcaacaaccaccattttcacagcaacaacaactaattttacctccacaacaacaacaacagcntccgcaacancaaatctctaatgttcaaccatccgttttgcagcagctaaaccatgcanngtatcctccaacaacagtgnagcctgtggnaatggcaaaangtcttgctaggcgcaaatgtggcaacaaaacgttgcatgtgatncacaacatgttgccagcagttgtcgcaaatccccgaaaatcccgctatgatgcaan

SEQ ID NO: 98451 - DNA, 524 bp, Triticum aestivum
  unsure (1)..(524): unsure at all n locations
  Clone ID: PAT_TA_98451
cactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacaagacatttccacaacaaccactattttcacaacaacaacaactatttcctccaacaaccatcattttccgcagcaacaaccaccatttttgggcagcaacaaccaccatttttctcaagcaacaaccaattctaccacagcaaccaccatttttcgcagcaacaacaacttagttctaccgcaacaaccacatttttcacagcaacaacaaccatttttactcccacaacancactttttccacaacaacaacacaccaacagtgggtgcaacaacaaccctggtgttcagccaccatttggcancagtnaaccatgcaantatcctccaacanatgcacccgtgggaatgcaanaagtctgctagnccaaatgttg

SEQ ID NO: 98452 - DNA, 529 bp, Triticum aestivum
  unsure (1)..(529): unsure at all n locations
  Clone ID: PAT_TA_98452
cagcaacancaaccacaattttcacagcaacaacaaccaccatattcgcagcaacaacagccaccatattcgcagcancaacaaccaccattttcgcagcaacancaaccaccattttcgcagcaacaacaacaaccaccatttacacagcagcagcagcagcaacaacaacaacaaccatttacacagcaacagcaaccaccgttttcacaacagccaccaatttcacagcagcaacaaccaccatttttgcagcaacaacgaccaccattttcacggcancaacaaataccagttattcatccatctgttttgcnacagctnaacccatgcanggtattcctcccaacagagtgcatccctgggggaatgcaacgatgtcctggctaggtcacaaatgttgcagcagacattgccacgtgatgcancaacatgttgccagcanttcgggaaaccccnagatcccgccatgancatcctgctacatctanctacacctgcacaacacagcanaacacacacaacanat

SEQ ID NO: 98453 - DNA, 328 bp, Triticum aestivum
  unsure (1)..(328): unsure at all n locations
  Clone ID: PAT_TA_98453
gagatgtctcgcaccggaccgatcgcccaggactgggagccggtggtcgtgcgcaagaagctgcccaacgccgccgccaagaaggacgagaaggccgtcaacgccgcccgccgcgccggcgtcgacatccacatcgccaagaagcataatgctgggacaaacaaagctgctcatagcaccacatccgctcaaatacaaagaggtttgattgatgatacaagagaatctttgctcaatgagcgtgtgccgttcagacctggaagaaaganattatgcaaggttanaacggggacaaganctcaacacaagganaagtttcanagtgatt

SEQ ID NO: 98454 - DNA, 331 bp, Triticum aestivum
  unsure (1)..(331): unsure at all n locations
  Clone ID: PAT_TA_98454
ntaggaccaannncacacatttatatacccatttcgtcancgacanatctgagttctgtcagttcacatgtgcnancagctgnatagacnaagctcagacatcactatcnanacatcctgtattgcctcaggacggganaangaacattctggatagttganatctcntacacantaccatttagctacngntattacaanngaactcggtataatgggtcgaccatcttcaaacacgancaaatccccntgtcgcctcctnaaaccctganctcctcatcaaagatatgtgatctcctacatcancttttgccacttccanagggggggg

SEQ ID NO: 98455 - DNA, 479 bp, Triticum aestivum
  unsure (1)..(479): unsure at all n locations
  Clone ID: PAT_TA_98455
acaacaaccatatctgcaactacaaccatttccgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaatccttcaacaatttggcaacaacaactggattccatgcatggtgttgtattgcagcaacacaacatagcgcatggagttnacagtttttgcaacaaagtcttaacanctgttacagattgtgttgtcagcacctatggaattccctagcattcncaatgccagcatccaaaaggttgttcaagcattattccggattnaacaacaaaccacacacacatcagccatgcctnnaaaagntcggnaaattccnttngcaaggcctccggcacnaanaaaacanaggcggggttgncanct

SEQ ID NO: 98456 - DNA, 299 bp, Triticum aestivum
  unsure (1)..(299): unsure at all n locations
  Clone ID: PAT_TA_98456
gaaataaaaaagagaaatcaaagaaaaacgaaagaaaaaaaatacaaagtctaacatggaaaaagaaatctggagaagaacaaggaaatcaaataaaaaataaataaagaaaaaaaatggatgaacacatcaagaaactgtacatgtgttgaagaaaaatgaaaaaagatgacaatccgacaaagaaatataaataaaacaaattaaacggtaccaaattcttataagccaaaatnttnttagggaagtttcaacccagttaggaacaaaaggaancaagnaaaaaccgannaaaaaaa

SEQ ID NO: 98457 - DNA, 484 bp, Triticum aestivum
  unsure (1)..(484): unsure at all n locations
  Clone ID: PAT_TA_98457
gccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttcccaaccccaacagcagtcacaacaacaactcgggcaacaacctcaacaacaacaattggcacaaggtacctttttgcagccacaccaagatagctcagcttgaggtgatgactccattgcgctccgttaccctgccaacgatttccgtgtcaatgttcccgtttgtatagaacaccactagtgttncattccggtgtttgcaccggatttggtcctaactaataaggaaaggctcctaataatatatanttgtttaccgttttttaatccatggtatttcnatgcaacggtgacaaataattgtcacacatgtcctgtgtgaccgccatacaattt

SEQ ID NO: 98458 - DNA, 509 bp, Triticum aestivum
  unsure (1)..(509): unsure at all n locations
  Clone ID: PAT_TA_98458
aagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattgngtacaagaacaacaatttccagggcagcaacaaccatttccaccacaacagcatatccgcagccgcaaccatttccatcacaacaaccatatctgcaagctgcaacatttccacagccgcaactatcatatccgcagccgcaaccatttcgaccacaacaaccatatccacagccgcaacacagtattcgcaaccacaacaacaattncgcagcaagcaagaacagcagcaancaacaacaacacaacaacacaatcctacaacattttgcaacacaactgttccatgcagggatnttgtattgcaacaacacaacatacgcagggaactcaaaattttgcn

SEQ ID NO: 98459 - DNA, 522 bp, Triticum aestivum
  unsure (1)..(522): unsure at all n locations
  Clone ID: PAT_TA_98459
attaaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatcctgcagctgcaaccatttccgcagccgcaaccatttccgccacaactaccatatccgcangccgcatcatttccaccacancaaccatatccacaacagcaaccacagtatctacaaccacancaacaatttccgcaagcaacaagcacaacaacaacaacaacaacaacaacaacaacancaacaacaacaattcttcaacaaatttggcaacaacaactgattcctgcagggattgtcttgcaanacacaaatacg

SEQ ID NO: 98460 - DNA, 499 bp, Triticum aestivum
  unsure (1)..(499): unsure at all n locations
  Clone ID: PAT_TA_98460
gttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttgggcagcaacaaccaccatttctcaagcaacaaccaattctaccacagcaaccaccatttcgcaagcaacaacaactagtctaccgcaacaaccacatttcacaagcaacaacaacagttttactccacaacatcacttttccacaacaacaacaacaccaacagtgggtgcaacaacaaccctggtgttcaagcatccatttgcaagaactaaccatgcaanttcctccaacaagatgcaccctgtggnaagcaaaactctggctaggcn

SEQ ID NO: 98461 - DNA, 490 bp, Triticum aestivum
  unsure (1)..(490): unsure at all n locations
  Clone ID: PAT_TA_98461
ggagccagttacacttaatgatggccgaggatggacaagagagcactggatacagctcggacagtggccagacttctcactgagaacagaagcgaggctcgtgattcctttggctgttgacgatgccggacggatcttactccgacactgggaagagcgctggggtactatgacccaagaaaccagacattggaaccgtttacccgactactancancaatctgcancttaactaccgcccagttcttcttcnccgngtttttnccaagncacttaattcgtccaaattttccgaaatcatactttttgacttttaacnaaggaanaaaacatgggannttgantgactgccccggcaaaantnccactaccaccatnttatttgcaagtcttccaacaatcnatcaaagtttaaggctaccatccantcaaatnngnccccgggatttttttccggaaaacccccaatatttaccccgtttggggaaca

SEQ ID NO: 98462 - DNA, 537 bp, Triticum aestivum
  unsure (1)..(537): unsure at all n locations
  Clone ID: PAT_TA_98462
agcacaaatcagcaaatccaagtacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacaagcattcccccaacaaccacaacaaccattccctcagactcaacaaccacaacaaccatttccccaagcaaccacaacaaccattcccccaagactcaacagccacaacaacatttccccaagcaaccacaacaacattccccaagcaaccacaacaacattcccccagactcaaacaaccacaacaacatttcccaagcaaccacaacaacattcccccagatcaacaaccacaacaacatttcccantccancaacacacaacttttcccagcccacaacatcccacagccccacaacgcaacatcattccccagcancaagacgttatcaaccatctctacacaacnttgaccatgaagag

SEQ ID NO: 98463 - DNA, 540 bp, Triticum aestivum
  unsure (1)..(540): unsure at all n locations
  Clone ID: PAT_TA_98463
cccatattttcctctcctctgccgccgccaccgcgtttctagggtttcccccatccccaattcgtccgccaccacctccagcctagatccancantgatggcnaccgcagaggcaggtganaacaanatgatcatgctcatatcgtctgacggcatggagttcgaggtagaggaggcaatcaccatggagtcgcanaccatccgccaaatgatttgaggatnaattgcgccgggaaangattccgattnccaacatcaantccaaaatttctctccaangncattcgagtnctgcaacaanacttnccgacaantcaaacactttgancaaccggtgccccaanttntaaaacgttggttcccgccgcnctaanccaggacccaaatttttgganaaaaattcatcnangntaaacgtgcancnccttaagtttcaaacaanctgnagttctcaaaacnangggtttttggcctnaattgcaaaatacgacacattntgggcataatctgangacncgtatttcctancaanaaaacann

SEQ ID NO: 98464 - DNA, 552 bp, Triticum aestivum
  unsure (1)..(552): unsure at all n locations
  Clone ID: PAT_TA_98464
atcatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattgggtacaagaacaacaatttccagggcaagcaacaaccatttccaccacaacagccatatccgcagccgcaacatttccatcacaacaacatatctgcagctgcaaccatttcccacaagcgcaactatcatatccgcagcgcaaccattttcgaccacaacaaccatatccacagccgnaaccacagtattcgcaaccacaacaacatttcggcaagcaacagcagaacaanagcaacaacaacaacaacaacaacaatcctacacaantttngcaaaaacaatgatccatgcaggattttgtattgcacacacaacatacgcanggaccaaattttgcaagaantctacaactggngcacatgtttgnaacaacgtng

SEQ ID NO: 98465 - DNA, 524 bp, Triticum aestivum
  unsure (1)..(524): unsure at all n locations
  Clone ID: PAT_TA_98465
agcttaaccacactcatctgatcacccactagctanccagctagcancttaaggaactagcttgcagctagcgatcnatggctcgtctcaacagcaaggctgtggcggccgccgtggtcctgacggcggtggtgctgataatggccngnangaagcctcggcngcgctgtccttccgncaggtggctcccaanttcgcnccttccntgcgantganncgggnaagggcntctccatttaaccaaggantgtgccccggnctttnatgggcttaaacggcctggncgcangnagcccngaccgtaagaaacttgaagtgctcnaaagcctcgccacaancatcaattcatcaacattggcaagtttcccggctnccccnnaatttcggctnagcttccttcccaataanatntcacaaantggaacaatgtnactantnaatatnaaccttccaacttnatcatggacnnctgcttgactaaattcaagttgatggntgncanacattttnctcaaaaanaaata

SEQ ID NO: 98466 - DNA, 366 bp, Triticum aestivum
  unsure (1)..(366): unsure at all n locations
  Clone ID: PAT_TA_98466
aacaagcccaactaccatttccccaacaaccacaacaaccattcccccagcctcaacaaccccaacaaccatttccccagtcacagcanccacaacaaccttttccccagccccaacaaccgcaacaatcattcccccagcaacaacaaccgttgattcagccatatctacaacaacagatgaacccttggcaagaattactcttacagcaatgcaaccctgtgtcattgggtgtcatcctccgtgtcaatgatcttgccacgaaagtgatttgcaaagtgatgcaacaacaatgtttcccaacaactaacacaaattcctccgccagtccaattgtgcaaccatccanaacgnntggaattccaa

SEQ ID NO: 98467 - DNA, 409 bp, Triticum aestivum
  unsure (1)..(409): unsure at all n locations
  Clone ID: PAT_TA_98467
gatcaaggccgcctaccggcgactggctcgggagcggcacccggacgtggccggcgcggccggcgacgacttcatccgcctacacgacgcctacgccacgctctccgacccggacgcccgcgcgcgctacgaccgcgacgtcgtcgtgcangcctacgcgcagccgcccgcttccaagccgaacggctctgggggccactcgccgaacttggaaaaanacaattcttggaaggccggcccatttattncaaagtttcgccnttttaaaaaccaccactatnncaaccgttcggtcnttttcaaacccnggaatgggctcaanaaantttttgttaanggggccaacaaggtttgttaagtnaacccacttccctgtcttatttccctaangtgaatgtttttaaaatcc

SEQ ID NO: 98468 - DNA, 522 bp, Triticum aestivum
  unsure (1)..(522): unsure at all n locations
  Clone ID: PAT_TA_98468
gccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttcacaagcgcaactatcatatccgcaagccgcaacatttcgaccacaacaaccatatccacaagcgcaaccacagtatccgcaaccacaacaacatttntccagcancanaagcagaagaanacacacacacacaanatccnaaacattttgnaacaaaacgtccatgcaggagttttttgaacaaccacatacgatggagcccatttcaagaanctncaacngggnaatgttttaacacgggaatcc

SEQ ID NO: 98469 - DNA, 523 bp, Triticum aestivum
  unsure (1)..(523): unsure at all n locations
  Clone ID: PAT_TA_98469
atttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagcccgcaactatcatatccgcaagcgcaacatttcgaccacaacaaccattccacagcgcaaccacagtattcgcaacacaacaacatttccgcagcagcaacagcagagcagcaacaacaacaacaacaacaacaatcctacaacaattttgcaacacaactnttccatgcaggagtttgtatgcacaacacaacatacgcagggantcacattttgcaagaanattacancgggg

SEQ ID NO: 98470 - DNA, 388 bp, Triticum aestivum
  unsure (1)..(388): unsure at all n locations
  Clone ID: PAT_TA_98470
ggtcaatacaaatccatcatgaagacctttctcatccttgccctccttgctatcgtggcgaccaccgccacaactgcagttagagttccantgccacanttgcagccacaaaatccatctcancaacagccacaagagnaagttccattggtacaacaacaacaatttccagggcagcaacaacaatttccaccacaacagccatatccgcanncgnaatcatttccatcacaacaaccatatctgcagtgaacatttccgcagccgaacaattttcggcaaaanttacatttcggaagcgcnataatttcaananaaaaaccctttcaanacaaggacnnagtttttcaaccaaaaaccnantttccnagnaanaaccaanaggaac

SEQ ID NO: 98471 - DNA, 294 bp, Triticum aestivum
  unsure (1)..(294): unsure at all n locations
  Clone ID: PAT_TA_98471
gtgatttcctcaccttgatatatattggtaatgtattttctatttatgtaccctgcatgttataagctatggagctgataaagttgagatccaaacagctgtcctgatgatccacacggtgccgatcttgtacgacaagtaccaaggacaagtggatcacttcgccggaaaggccataccgaggcgtgcaagcactacnangtgctggccaaaaagttctgagcaaatancccgaaganccgngaaaaccaaggaacctaaangcngggtccccntattcaancngggcccctg

SEQ ID NO: 98472 - DNA, 528 bp, Triticum aestivum
  unsure (1)..(528): unsure at all n locations
  Clone ID: PAT_TA_98472
cactcatctgatcacccactagctagccagctagcagcttaaggaactagcttgcagctagcgatccatggctcgtctcaacagcaaggctgtggcggccgccgtggtcctggcggcggtggtgctgatgatggccggcagggaaggcctcggcggcgctgtcntgcgggcaggtggactccaactcccgccgtgcgtactangaaccggggaaagggcgtcctccnatttaagcaaggattctgctcccggcgttcaagggcttaaacggcttgccgcagcaacccngaccgcnaaatagctncaagtgctcnaaaacctcncaacaacatcaattccatcaacatggcaagnctnccggggttncccgnaattcgggttaanctgccttcccaatnacattttcaacaaattgaaaatttnacaatttnaaaaaaacntcctaacttcatcatggaccntgtcttgactnatctagttnatgggngncaaacaagtttactactaaaaaaaaagaatncngtttgt

SEQ ID NO: 98473 - DNA, 511 bp, Triticum aestivum
  unsure (1)..(511): unsure at all n locations
  Clone ID: PAT_TA_98473
gagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcgaccatttccgcagccgcaactaccatattcgcagccacaaccatttcgaccacaacaaccatatccacaaccgcaaccacaatattccgcaaccacaacatccaatttcacaagcagcagcagcaagcaacaacaacaacaacaacaagaacaacaaatacttcaacaattttgcaacaacaactgattccatgcatggatgttgtattgcagcaacacaacatagcgcatggaagttacaantttggcaacaaantacttacaactgttggcaagatgtgttgtcagcactatggagttcctggagcatcgcatgccangcaccacatgttttcatgc

SEQ ID NO: 98474 - DNA, 502 bp, Triticum aestivum
  unsure (1)..(502): unsure at all n locations
  Clone ID: PAT_TA_98474
ccgttcctcctccccctcgttgccgagtcaaatccccaccccacctccgccccggccaagtcttcgccctccgtcttccccgacaataatatgatctctctctcccccctcgccttcctcggtctcattctctccctgtccaaatctccatccaggacagcgcccctctgatncgccctcctcccctccgcgacccggccacgccattttatccanttcttgatccgttgatcctccccgccgcccctgccaagaagtgccgccggtccccggagaaggaaggaccggcgttaatcgctgccggatccntccttgtgggtgggatcctccggagaaggcccggtccttgaggtccggatccgggcaggtntccgtnacaaagggtgaagtgtccttcgttcttcggggtttggatgaatncccgccgattcaantccggtgaactacgtcgtcncgcgcaaaccctggagttgacttncaaaggaggaccgcggatgactcc

SEQ ID NO: 98475 - DNA, 484 bp, Triticum aestivum
  unsure (1)..(484): unsure at all n locations
  Clone ID: PAT_TA_98475
accatgnagaccatgttcatcctcgctctcctcgccttcacggcgacaagcgcagttgcgcagntgtanactacctgtagccagggctaccgggcaatgccagcctcagcagcatnaagggcaaagtttcggccagcctcagcagcaggttccggttgagataatgaggatggtgcttcagacccttccgtcaatgtgcancgtgaacatcccacantattgcaccaccancccgtgcancaccatcaccccngcaatctaaaagatccccatgacanctnctgtgctgggtgggcncctgcnanatctgtgatgtgctactanatnnatcaccgtttaattnatcatgaagattanaaanaggtgccatacatcatcagtgtggcattanatgcaacttgcaaaaacanctcctttcgnaaantnttggccgaataaanaaannacatttcnaaaacnccggggggggccntacaatcccctt

SEQ ID NO: 98476 - DNA, 482 bp, Triticum aestivum
  unsure (1)..(482): unsure at all n locations
  Clone ID: PAT_TA_98476
gagaagggcaacaaggtcagcagccaggacaagggcagcaaccaggacaagggcagccagggtactacccaacttctccgcagcagttaggacaagggcaacagccaagacaatggttgcaaccaagacaagggcaacaaggatactacccaacttctccgcagcagtcaggacaagggcaacaattaggacaagggcaacaaggatactacccaacttctccgcagcagtcaaggacaagggcaacaaggctacgacagccataccatgtttagcgcggagcaccaaggcggccagcctaaaggtggcaaagnacagcagctccgcggacagctgccggcaattnccggtanaaggcggcgaccatngtttggcaaccaatggatagatatctgcactcgcttggtgcttaagcatgcatcacttaactatacataatgtggctgtttcaattttcaagttactaatttaacccattatng

SEQ ID NO: 98477 - DNA, 457 bp, Triticum aestivum
  unsure (1)..(457): unsure at all n locations
  Clone ID: PAT_TA_98477
acaacaaccttttccccagccccaacaacaattcctgcagccccaacaaccgcaacaatcattcccccagcaacaacaaccgttgattcagctatctctacaacaacagatgaacccctgcaagaatttctcttgcagcaatgcaaccctgtgtcattggtgtcatccctcatatcaatgatcttgccacgaagtgattgccaggtgatgcagcaacaatgttgccaacaactggaacanattcctcaacanttccanttgttgcaancaacaaangntcgngaatccaacaatcatggaacaaggacaacnaagggngaattttcgggggaagttttaaccgttaagggnaggnatttcaacttaaaacactcattggggggtnaggnatgggattgaaccttcaacaatggaangnttttccaccnaangcccacataagnacattncaaanacc

SEQ ID NO: 98478 - DNA, 474 bp, Triticum aestivum
  unsure (1)..(474): unsure at all n locations
  Clone ID: PAT_TA_98478
gccgctcccgctcccgccgccgcgccaccgccgtcagccatggcaccgaagaaggagaaggccccggcggcgtcgtccaagccggccaagtccggcggcggcaagcagaagaagaagaatggagcaagggcaagcaaaaggaaaaggtgaacaacgccggtgctgttcgacnagccacctaacgacaagctgctcaaccaaggtgccaaatacaagcagtttacgcctccgtcctcttccnagcgcctcaagatttaacgggtctccntggaaccaaggctatcnaagactgaatgaaaagggancaacnagatggtgttaatccatccaaccagaatttttaccaaaggnganaacactgattanccattacaagtntccnggcccgtttttaaccaattaacnagggnttccgttaattanattcnaaaattcaaagggggaaatntcacaatnanttaatgcttttatttn

SEQ ID NO: 98479 - DNA, 491 bp, Triticum aestivum
  unsure (1)..(491): unsure at all n locations
  Clone ID: PAT_TA_98479
gcttggtaatgtgggagcagtgttgtcagcaactaaaagcgatccccaagcagtcaagatgtgaggccatccacaacgtcgtgcacgccattattttgcaacagcaaaaacaattggtacaaggtacttcaacccaacctcaagcagcagcaacaacaagtcnaacangaacatgggtcaagggtcctagccagccacaacaccaacaacaacaacagcaactgggtncaaggtttggtttcttggcgataaggacatgggttgattcaanaccgtttcccggcaatgtncgacttcatgttcccancaatactngctacacanccatatcancaaccnattgactcactaaccggatgggcggtactgagaaattananccaattcccnaaatgggcaccatgtttaatccatggccgttcaaatgtttcngggnaaataaatgccatgcttaccagtnttgggcaaacnggactaatcaaacttgggaa

SEQ ID NO: 98480 - DNA, 504 bp, Triticum aestivum
  unsure (1)..(504): unsure at all n locations
  Clone ID: PAT_TA_98480
ggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattccgcagcacaaccatttccgaccacaacaaccatatccacaaccgcaacacaatattcgcaaccacaacatccaatttaacagcagcagcagcagcaacaacaacaacaacaacaagacaacaatacttcaacaatttggcacacaactgatccancangtgttgtattgaacaacacaacatacgcatggagttacaantttgcacaaanatnccagcgn

SEQ ID NO: 98481 - DNA, 510 bp, Triticum aestivum
  unsure (1)..(510): unsure at all n locations
  Clone ID: PAT_TA_98481
gagccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacagattcctcaagcagtccaagtgcgcagcatccatggcgtcctgcattcccatcatcatgcagcaaagaacaacaacaacaacaacaacaacaacaaggcatacagttcatgcnggcactatttaactccttccaggtccagggcatcatccaacctcaaacaacaactcattgggngtgatcaaggcaatgggnattggaancttccaacatgtgcaactgttggtccactgatgtccacaacaaagnacattngcaacatatccccgacattggggggcaatgaa

SEQ ID NO: 98482 - DNA, 491 bp, Triticum aestivum
  unsure (1)..(491): unsure at all n locations
  Clone ID: PAT_TA_98482
agcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcatttcgcaagcaacaacaccatttgggcagcaacaaccacattttctcaagcaacaacaatctaccacagcaacaacattttcgcagcaacaacaactagttctaccggcaacaaccacantttcacagcaacaacaacanttttacctccaacaacataacntttccaacaacaacaacacaccaacagctggngaacaacaatccngtgtttaancatcantttggagcagtnaaccaagcaagttcctccaagaacatgcacccggtgggaatgca

SEQ ID NO: 98483 - DNA, 495 bp, Triticum aestivum
  unsure (1)..(495): unsure at all n locations
  Clone ID: PAT_TA_98483
cctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaaacaaccccaacaaccattttcccaaacaaccaacaacaaccattccccaagatcaaacaaccccaacaaccattttcccaagtccaagcaaccaacacaactttttcccaaagcccaaacaacaattggcgcaagccccaaanaacggcaacaatcattccccccaacaacaacggcattcattcaacattcttanaacaacagttngaacccaagncaagatnctcttggaanaatgaaactgcncatgggggncacccnccgggcnataactggcacaaagcgatggcaagttatccggaacaagctgcaaca

SEQ ID NO: 98484 - DNA, 469 bp, Triticum aestivum
  unsure (1)..(469): unsure at all n locations
  Clone ID: PAT_TA_98484
cccgaacgacgccctctcttccaattcgaaattcaggcgagccaactgagagaggtgagcgccgcctcgttcccgagcccaccaccggagcccttcacgagcgcgagacctagggttcaagccgccgctgccggccctccgccgcggcgcgcccagccggccgaaccctccgttggccccgcctccggcacagcagcgcctccctccccgtccctgggagcaagcgcccctctcaagcaacgccgccgcccggagctacccagcgaccggtccatagcangttcaacattcgtgttacgcttcggnaccacagcanagcaaacaagcaggatcagttctagaagcttggaagaccttnccccgcgcggatggagaaccgaaagatatggctcaatgaaaaggagttccnaacatggacgtgcaagncaagagctactacnagggatntgccaagccctaaggaatgaaa

SEQ ID NO: 98485 - DNA, 371 bp, Triticum aestivum
  unsure (1)..(371): unsure at all n locations
  Clone ID: PAT_TA_98485
cctcctccacctagggttttgctgcctccctcccccaccgccgccgtcgccgcccgcgtccaccatggcgctgccgaaccagaacaccgtcgattaccccagcttcaagctcgtcatcgtcggcgatggcgggactgggcaaaaccacatttgtgaagaggcatctcactgggaganttggagaagaaatacgaaccacattggggttgaagttcacccgttggtttcaacaactaactggtgnaaaatcgtttccaacggcngggaanacggctgggcaaaaaatttgggggccttaaggatggnacaatncaanggcaattgggattacaaggtttnggcnccttcaaggggncctaaaaagttcccaa

SEQ ID NO: 98486 - DNA, 557 bp, Triticum aestivum
  unsure (1)..(557): unsure at all n locations
  Clone ID: PAT_TA_98486
gctccaacagccattatcccatcaaccacaacaacaagttccccagcctcaacaaccccaacaaccatttccccagtcacagcaaccacaacaaccttttccccagccccaacaaccgcaacaatcattcccccaagcaacaacaaccgttgattcagccatatctacaacaacagatgaacccttgcaagaattacctcttacagcaatgcaacctggtgtcattgggtgcatccctcccgtgnccaatgatcttgncacgaagtgatttgncaaggtgatgcaagcaacaatgtttgccaacaacttanacanttcctccgccagtccagttgtgcagcatccatagcgtcctgattcaatcgncatgcnacaaggaacaacaacaagnatacaattctcccggcacggttnnactcctccaagncaaggnatcatccaactcaacaacaactcnatatgagngattaattatggggattggnaccttccnacatntnaacntgttntccnaccnaanggtcaacataagnacaatncaacaaatcccggataag

SEQ ID NO: 98487 - DNA, 533 bp, Triticum aestivum
  unsure (1)..(533): unsure at all n locations
  Clone ID: PAT_TA_98487
caagcgtgtgatcacctcatcgccacaatggatcccgcgctcaaagcttacctcgacaagatgagcgacgaggccaccgcccgtgccaacaagcaagacggcaacaacaatgccatcctccaggccttggcgacgcaagacggcgccggattgactccctccgtcacctgggaagccggagttnggaggcgccggttcgcacaatttggantctcggttccgcggtcttccaagccgcgttctccttnaactgcacatccaacggattttccgccgcttncgancctcccatggttncgcgcnaattncaanggcaatcnaggcacgaccacantgatctggggattccctcnggtacccccatcantngacttccccgtnacggactgggcaatttcaaaagcatcctggacgganaactcaactgatatggnattgatttaaactcctggtcaaanaatcaagttatggatcttaccatanatatccatggnggtacaaattncaactatggnatcggtaccattncattt

SEQ ID NO: 98488 - DNA, 401 bp, Triticum aestivum
  unsure (1)..(401): unsure at all n locations
  Clone ID: PAT_TA_98488
gtgaagcccgcgctggggcccgacgacggncggatctccgccgtcgagtgggtcccgctcgacgcggagggggccaaaggggatgagggaatggccctcttggtgggcaccgacgccggctggctcctcttctactcnctcgccggcgatctcctgcataancanagtatatatcctgcgaaagatactgaagcttaacttcaatnganagaaaggaaaatgcttgggaaanattcangttcagatgacnttccgtggttttccccggtttattcactttgtgatggtgctacttcaaattatgctttcaaaatcattttaagaattaatcnccaattttgaaaataattttcaaaggaanattatnatgacacaattctttttaaaanaccctcnaattt

SEQ ID NO: 98489 - DNA, 315 bp, Triticum aestivum
  unsure (1)..(315): unsure at all n locations
  Clone ID: PAT_TA_98489
attctatcatcgtgcagcagcagcaacaacaacaacaacaacaacaacaacaacaacaacaaggcatgcatatcctgctgccactatctcaacaacaacagttgggtcaaggtactctccgtccaaggccagggcatcatccaacctcaaacaactactcaatnggaggcgattaagtcattggtgtttgcaaatccttccaaccatgtncaacgttgtatgtccacctgantgtccatcatcaaggacatttgcaacatatccccggattttgtggccaatgaaaaagcaagtttatacnataataatgnttaa

SEQ ID NO: 98490 - DNA, 472 bp, Triticum aestivum
  unsure (1)..(472): unsure at all n locations
  Clone ID: PAT_TA_98490
ggggcgcggcaagggaggcaaggggctcggcaagggcggcgccaagcgccaccggaaggtcctccgcgacaacatccagggcatcaccaagccggcgatccggaggctggcgcgtcggggcggcgtgaagcgcatctccggggctcatctacgaggagacccgcggcgtgtcaaaatcttcctcnaaaaactcatccgnaaggccgtnaacttaaaccagcaaanccgccgnaaaacgttaacncatgganttctttaaccccttnaaggccaagnacaacccncaaggttttcngggggtanggcccaacaaccccaatttaaggccaaggttccgggcctttnngtaatccanaatcccctnntttccaatcttccgtgagtttnaaaggatttaaattggnatttaaccttatttttgggncccggactgtttncaangaaaanccgtccattctttaaaaaaaaaaaa

SEQ ID NO: 98491 - DNA, 465 bp, Triticum aestivum
  unsure (1)..(465): unsure at all n locations
  Clone ID: PAT_TA_98491
caccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagtccggcggntccgagacggccggggagaccggcggctgcgactgcacacctgcaatgcggaacgcgtgcggttgtcctgtgcagtgcaactgagccgggcccaagaggcggccgnaaaagcacacagataggaggacaacaagcagacatcacacantnacacancagcgttcatacaacgcgatcgtcgcggggccgcctgataaataacacntcgttcctattttcccttcctggttcaca

SEQ ID NO: 98492 - DNA, 514 bp, Triticum aestivum
  unsure (1)..(514): unsure at all n locations
  Clone ID: PAT_TA_98492
agcacgctggctccacggttcagcgacgattcggtataccgaccgcactctctctctcagttttgatgtttgcataaacaagtcgctgttgtgctagtactgttgccgcttcagtaaaaaacgaggaataattcgagggataaattagcgggcaccattagaatcatcgaccgctcctgccaaggaacattctaggctgggcgtncgtgccgagcagattctgaacccgcaacctgcggttgggagtgtcctgctgctcctcctcccccaacttggggatccccttgtnatggccgatgctccctttgggcaacaatgggaggcagtacnttggggaattggcccatcccaacnggaanttttcccccacngaaacatatcaatcaaggagtccnaaganccatnatggttcaaanangtgattcccccaaaccaagttctccccnatnaacntcctaanataactatttttgcaaatttgctnggttgactccgaactaaaanaccccaaccn

SEQ ID NO: 98493 - DNA, 517 bp, Triticum aestivum
  unsure (1)..(517): unsure at all n locations
  Clone ID: PAT_TA_98493
agcaacaacaacaacaacaacaacaaatccttcaacaaattttgcaacaacaactgattccatgcatggatgttgtattgcagcaacacaacatagcgcatggaagatcacaagttttgcaacaaagtacttaccagctattgcaagaattgtgttgtcagcacctatggcagatccctgagcagtcgcagtgccaggccatccaaaatgttgttcatgctattattctgcatcaacaacaaaaacaacaacaacaaccatccgagccagnctccttccaaacagctctggcaacaatatccattaagccaaggtccttccnggcatctcaagcaaaacccacaggaccaaggtctgtccagcctcaacaacgccccatttcnaaggaataaggactaacgctacagacgctactgcatgtgcatgtctanaccctccatattgacatcgcccatttggatctccggtactaactgagaagaataccnantactagtatatgaacacgtttcnantc

SEQ ID NO: 98494 - DNA, 508 bp, Triticum aestivum
  unsure (1)..(508): unsure at all n locations
  Clone ID: PAT_TA_98494
ctctttcccacttagctagctagcagccatggccgccctctcctctgcagccgtctccgtcccttccttcgccgccggcgccaaggtggccgctccccggagcagcaggatggtggtgcgcgcgtccctgggcaagaaggccgccagcgcggccgtggccatggccgcgagcgcgatgctgctgggcgggtcggcgatggcgcaagacgtgctcctgggcgccaacggcggcntgctggtgttcgaagcccaacaattcaagcgtcaaaggccggcaaaacatnacttcaaanaaaacgccnggtacccgcanaangnggtgttccnacnaagnaccngngccctccnggntcaaattctcaaatttcccaaagaggagtactcaaagcccccgggaaacttctccgttaagctaacgtcccnggaactaaggttttaanggnaacccaacccggaccngaatggtccggaaagnaacgttaacaaacntaacaactnttgcaattnt

SEQ ID NO: 98495 - DNA, 522 bp, Triticum aestivum
  unsure (1)..(522): unsure at all n locations
  Clone ID: PAT_TA_98495
gttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcaagcaacaacaatctaccacagcaaccaccattttcgcagcaacaacaactagttctaccgcaacaaccaccattttcacagcaacaacaaccattttacctccacaacatcacttttccacaacaacaacaacaccaacagctgggtgcaacaacaanccctgttgttcagcatccatttgcaagcaactaaaccatgcaagtatcctccaacagcatgcaccctgtgggnaagcacaacgtctgctagtccaaatgttgcacaaacag

SEQ ID NO: 98496 - DNA, 483 bp, Triticum aestivum
  unsure (1)..(483): unsure at all n locations
  Clone ID: PAT_TA_98496
atcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagtccggcggntcgagacggccggggagaccggcggctgcgactgcaccacctgcaangcggaccgcctgcggtgctcctgctgcagtgcaactgagcccggngcccaaggaggccggccggcaaaaggcaacacgagatnagganggacaaacaagcaaanacataacacaattnacacaccaaggtacataacaaccgccgcangcctcncngggccgcctgataaataacactttcntcctattcttttgccttcctgtgttnacatatgtcttctnngctcant

SEQ ID NO: 98497 - DNA, 493 bp, Triticum aestivum
  unsure (1)..(493): unsure at all n locations
  Clone ID: PAT_TA_98497
catcaaagttgcaacacaaattttattaccagcagcagcagccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtgggcaatgccacaaagcttgctaggtccgcaaatgttgcagcagagcattgccatgtgatgcaacaacaatgttgccagcattgcccgcaancccccaacatccccgctatgagcatcccgtgctacatctaccccatcatcctggcaagaacaacacaggttcagggtccatccaaatccctcagcanaacccaacattgggcatgtttcccaaacccaacagatcacaacaacaatccgggaacaactcaacaacaacattgggacaagnacttttgcaccacacn

SEQ ID NO: 98498 - DNA, 501 bp, Triticum aestivum
  unsure (1)..(501): unsure at all n locations
  Clone ID: PAT_TA_98498
gacacactataagaacttaaccaacaggtttgaagaatggatgacattaagtacacaaaaaagagcaggagaatgaattctgatagaatgttgcatcttccaaatgaatatgatttgcttttggagctagctagcacttggaagagtctgaaatcagccgagattaagaatctataatgcaaaaaccataaccattgaagattgaaagaatccatgaagtgagttcacctcctttatagatattttgactgttttgagtaaacacacatattaaagtaagcgaccataccctttatatanccnggccaaacactacccttggagttacancctcaatttaagcacaagttacaaagtatangagatggatgaaccaaagcatngtttaagntaatgcctcaaactttgtttgcatcaagtatttntgaacaaacaatncccctttaanggaatanaggtagtaaaaagaatatgacataaggtttaataagttganccaag

SEQ ID NO: 98499 - DNA, 387 bp, Triticum aestivum
  unsure (1)..(387): unsure at all n locations
  Clone ID: PAT_TA_98499
cgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcngcgagcgcaacgggtacctcaagggcgtcgtcacagatgtcatccacgacccggggcgtggtgcgccgctggcaaagtgacttccgcaacccnttcaaggtacaacaccaaaaagnnttctttttcncccccgaaggtatntnaaccggcatttcttctaaangnggaacccggccaactcttcctttggaaattcttccgtncgctccctttcctaangaaggttattttnaaattttaaaaanttttggaac

SEQ ID NO: 98500 - DNA, 498 bp, Triticum aestivum
  unsure (1)..(498): unsure at all n locations
  Clone ID: PAT_TA_98500
gcaaaagtagttagcaccaatccatcatgaagaccttcctcgtctttgccctcatcgccgttgtggcgacaagtgccattgcacagatggagactagctgcatctctggtttggagagaccatggcagcagcaaccattaccaccacaacagtcattttcacaacaaccaccattttcacaacaacaacaacaaccattacctcaacaaccatcattttccgcagcaacaaccaccattttcgcagcaacaaccaattctatcgcagcaaccaccattttcacagcaacaacaacanttctaccgcaacatcacattttcggcagcaacaacactattttacctccacaacacaacaacaacacttgtgcaacagcaatccctatgttcaacaatcgttttgcagcagtaacccatgcaaanntccnccaagangaatgcacctgttncaatgcacaactctgctaggcacanattggaacanacattncaagtgntg

SEQ ID NO: 98501 - DNA, 508 bp, Triticum aestivum
  unsure (1)..(508): unsure at all n locations
  Clone ID: PAT_TA_98501
actcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggngtgcaggggctgaacggcctggcccgcagcagcccggaccgcaagatagcgtgcaggtgcctcaagagcctcgccaccagcatcaagtccatcaacatgggcaangtctccggcgtgcccggcaagtgcggcgtcagcgtgcccttccccatcagcatgtccaccaactgcaacaagtcaactaantcaatatataatccttcctacntgcatgatggaccgcttgntggacttaattctacttgatgnctgctcatac

SEQ ID NO: 98502 - DNA, 281 bp, Triticum aestivum
  unsure (1)..(281): unsure at all n locations
  Clone ID: PAT_TA_98502
gcacaaacagcttttacacatcaacaacaaccacaattttcacagcaacaacaaccaccatatggtggctgttgttgctgcgaatatggtggttgttgttgctgtgaaaattgtggttgttgttgctgtgaaaatggtggttgttgctgctgtgaaattggtggttgttgtgaaaacggtggttgttgttgctgcgcaaatggtggttgttgttgttgttgcgaaaatggtgattgttgttgctgcnaaaatggtggtgttgttcttgaaaaagggggggc

SEQ ID NO: 98503 - DNA, 516 bp, Triticum aestivum
  unsure (1)..(516): unsure at all n locations
  Clone ID: PAT_TA_98503
gcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatcccgacttcattgccagggcggcgactccacccggggcaacggcaccggcggcgatccatctacggcgagaattcccgacgagaattcgtccacaagcacaccaacccgggatctctcaatggcaacgcggggccaacacaacgtccaattctcanctcacntcccctgcattggtcaacggaacactggnctccgggagtcntcaagnatggactctcaagaacatcaaaaagnggctccgcaacgga

SEQ ID NO: 98504 - DNA, 381 bp, Triticum aestivum
  unsure (1)..(381): unsure at all n locations
  Clone ID: PAT_TA_98504
gttaccaagtgttgcaacaattatgttgtcagcagctgcggcagatccccgagcagtcgcggtgccaagccatcaacaatgtcgttcatgctattattctgcatcaacaacaacaacaacaaggacaacatcaacagtcgagccaggtctcctaccagcagcctcagcaacaatatccatcaggccagggtccttccagccatctcagcaaattccacaggcccagggtttntccancctcanaatctgccccaactccgaggaatatntancctagcgctgcaaacctaccaccatgtgnatgtcaaaatccctccatatngctngacancaattgccccntttgacatcttcgggtactaactgaaaagagaacactct

SEQ ID NO: 98505 - DNA, 545 bp, Triticum aestivum
  unsure (1)..(545): unsure at all n locations
  Clone ID: PAT_TA_98505
agggcagccagggtactacccaacttctccgcagcagtcaggacaagggcaaccagggtactacctaacttctccgcagcagtcaggacaagggcagcagccaggacaattgcaacaatcagcacaagggcaaaaaggacagcaaccaggacaaggtcaacagccagggcaagggcaacaaggtcagcagccaggacaagggcaacaaggtcagcaaccggggcaagggcagccagggtactacccaacttctccgcagcaatcaaggacaagggcaacagccaggacaatggcaacaaccaagacaagggcaaccaaggatactacccaattctccgttgcanccaaggacaagggaaccaagtncaaccaanttttccggnaaaaccaaggacaagggancaaccaggacatttcacaacaacacaaggcaacaaggnancaacttcnnagggaacaaggnancaacancacaatncaacaaggcaacggcaacananggcacaagncgcaacagacaaggcaacagtagcagntggcaaggc

SEQ ID NO: 98506 - DNA, 532 bp, Triticum aestivum
  unsure (1)..(532): unsure at all n locations
  Clone ID: PAT_TA_98506
caacaaccagttttacctccacaacaatcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcaggagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaacccaacagttgggcaatgtgtttcccaacccaacagcagtcgcaacagcaatcgggaacaactcaacaacacaattggnaaaggtacttttgcagcacaccaagatactcaactnaagtgatgactccattgcgctcgtttcctgcaacatgtgcatgtaagtgcgttgtanaaacacactan

SEQ ID NO: 98507 - DNA, 534 bp, Triticum aestivum
  unsure (1)..(534): unsure at all n locations
  Clone ID: PAT_TA_98507
ccacaacagccaccatgttcacagcaacaacaaccaccattatcgcagcaacaacaaccaccattttcacaacaacaaccaccatttttgcagcaacaacaacccgttctaccgcaacaaccaccattttcgcagcaacaacaacaatttccgcagcaacaacaaccacttttaccgcaacaaccaccattttcgcagcaacaaccaccattttctcagcagcagcaacaaccaccattttcgcagcaacaacaacaaccattctaccgcaacaaccaccattttcacaacaccaacaaccattctaccgcaacaacaaataccatctgttcagccatctatcttgcagcagctaaaccatgcaaggtattcctccaagcagcatgcancctgtggnaatgccacaaatcttggctagncccaaatgttgtggcagagtattgcatgtgatgcaacaacatgttgccggcagtgccgcaatccccgaacatcacgctacgatcatccgtgccatcatctactcgatgtctacag

SEQ ID NO: 98508 - DNA, 496 bp, Triticum aestivum
  unsure (1)..(496): unsure at all n locations
  Clone ID: PAT_TA_98508
acccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtactgaacggggaanggcgtcctcgattaacaaggagtgctgctcccggcgttcaagggctgaacggcttggccgcagcaacccggaccgcaagatagcgtgaagtgcctcaaagacctcgcaacaacatcaantccatcaacatngcaaggtctccggngtgccccggnaaatncgggttaancgnnccttcccaatnagaattcacaaactgcaacaatntcactaattaatanaaaccttccaacttcatcatgancctncctggactaattcacttgaaggatgccaaacagttnacacaaaa

SEQ ID NO: 98509 - DNA, 513 bp, Triticum aestivum
  unsure (1)..(513): unsure at all n locations
  Clone ID: PAT_TA_98509
ggcaacaacaaccaccattttcacaacaacaaccaccattttcgcagcancaacanccaccattttcacaacaacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcaagctaaacccatgcaaaggtatcctccaagcaanaatgcancctgtggcaatgccacaaagtctgctangccgcaaatgttgcagcagagcattgcatgtgatgcacaacatgttgccagcattgccgcaanccccaacatccgctatgagcaatccgtggcnncatcnatccatcacctgcnnn

SEQ ID NO: 98510 - DNA, 510 bp, Triticum aestivum
  unsure (1)..(510): unsure at all n locations
  Clone ID: PAT_TA_98510
gcaacaaccatttccccagccccaacaaacattcccccaacaaccccaactaccatttccccaacaaccccaacaaccattcccccagcctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtggattgccaggtggatgcaagcaacaatgttgccaaacaaactagcacaaatcctcaacagtccaatggcgcaaccatccacagtgtcgcgcattccatcatcaatgcaacaaggacaacaacaaggngtgccgattctgcgggcaactatttnagtcgcccaaggtctgggttatccaactcaa

SEQ ID NO: 98511 - DNA, 487 bp, Triticum aestivum
  unsure (1)..(487): unsure at all n locations
  Clone ID: PAT_TA_98511
caacatccaatttcacagcagcagcagcagcaacaacaacaacaacaacaagaacaacaaatacttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgccaggccatccacaatgttgttcatgctattattctgcgtcaacaacaaaaacaacaacaacaaccatcgagccagtctccttccaaacagctcagcaacaatatccattttgccaaggtccttccgggcatctcagcaanaccacaggccaaggtctgtccanctcaacaacgcccaattccagggaataagaactacgctcagagctactgcatgtgaagtctantccctcatattgcacatcncgcattggatcttt

SEQ ID NO: 98512 - DNA, 497 bp, Triticum aestivum
  unsure (1)..(497): unsure at all n locations
  Clone ID: PAT_TA_98512
ggagaacaaacattatctaacacaaatcaaccatgaagaaattcctcgtccttgccctcattgttgtcgcggcgaccaccacggccgccgaaccctttactgcattccgtactgcttgggagccgcaccatccatcatctccaagagcagcaaccaactccacagccacaagaacaaccagttccacatcaaaagttgaacccatgcagggatgccctcctacaacagtgtacccagttgctgatatgtcgttcctccggcacangtggtgcaacatagcactgcttgggtaatgttgggagcagtgtttgtcaacaactaaaagcgattcccaaagcatccaagtgtnaaggcatccaaaacttcntgcacccatcgttttgcaacagcaacaacatttggtacaagtattccaaccaacctcaacagcaacaacaacaagtcaacaacaacagncaggttctancaancacaacaacaaacacaatggttnnggn

SEQ ID NO: 98513 - DNA, 242 bp, Triticum aestivum
  unsure (1)..(242): unsure at all n locations
  Clone ID: PAT_TA_98513
ngaacattcctctttctctcccttgcttggggaanaagaagaagaagaanaagaatatagggcgagngcctcgnctcccgacgncgtcgcccntcgccgccgatctgatctcanagagccatgcgaatatgcattccancaatctgctcctcnaggagcccatcacggatggtctccatcctctagccatccaagncgaacttcttcncggnnatgactaaaattgtggngaacgcngggtc

SEQ ID NO: 98514 - DNA, 467 bp, Triticum aestivum
  unsure (1)..(467): unsure at all n locations
  Clone ID: PAT_TA_98514
cctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagtccggcggntcgagaacgccggggagaccggcggctgcgactgcacaacttgaaatnccggaacgccttgcggttgtcctgctgcaacttnaactnancccggggccaaagaggccggcgggaaaaggcancaccaggttagganggncaagcaagcaagacataccaccanttaacaacaaccangnttcataacaancgccnaagggtttccgggggccnccctgataaaaaacantttngttcctatttgttnccttt

SEQ ID NO: 98515 - DNA, 511 bp, Triticum aestivum
  unsure (1)..(511): unsure at all n locations
  Clone ID: PAT_TA_98515
gccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttccgccacaactaccatatccgcagccgcaatcatttccaccacaacaaccatatccacaacagcaacacagtatctacaaccacaacaaccaatttcgcagcaacaagcacaacaacaacaacaacnacaacaacaacaacancaacancaacaattctcacaaatttgcaacaacaacgatccagcanggatgttgctgcaacaacacacatagcgg

SEQ ID NO: 98516 - DNA, 512 bp, Triticum aestivum
  unsure (1)..(512): unsure at all n locations
  Clone ID: PAT_TA_98516
gccagaccaaggccttatcgtcttcttcctcgacctcctccaccgcctgagctcgccatggccacgacggcgtcggcgcgcgcacatcagcagcacggggggaagcagcagcagtaccagccgctgcggcgcattgaggggctgagcctgaggtccgcgctccgcagcgacccgcgcgtccccgcgctggccgcggccgcgctcctcgtccctctcggcgccgcgctgctgggcctctcgggcctcttcctgctggcacgctcgccggcgtcgcgctcgcggcgcctctcgtcctgctcttcaatccggtgctcgtgccgctgcgctggggcgccgtgctcgccatcgcggggctcgccgcaaccggcgcgctcgcggtctcggggtctccgngctcgtctgggtccttgggtactcaaaaggggctccgcaaggcnatcnggccggttggcggatggtggtgnaccttngaaaccggaaacgganggaaaaaaggggccccgcttctcttg

SEQ ID NO: 98517 - DNA, 489 bp, Triticum aestivum
  unsure (1)..(489): unsure at all n locations
  Clone ID: PAT_TA_98517
gcgggcgccgcgcaccttcttggaggcgctggtcaggtataccttccccaccccctcccccttgtcctcccgggtgaaaaccccaacgatgttgggcggcggcgacgcccttggcgccgtttccttcttgaaagcgctgctttgggagcaaggtgggaatttgggtcttcgccgtgaggtgtgcngtggggtgtcngcggcaagcaattatctccagctgtgctgtgctccccctggtggtgggctgctgctccttccgtgcatcctgggnagtctcctcttgaatgcccaatctctggtttccggtgttgctctgctccaangtgagaattcgacgacaagtcgcgttctgcctaacccaacattnngatgcatccggtgcctctcanccaagttctaaggtgaactgttcaatngtcaacgttcngnnctttttaancaagcnaagaggnanggcttcttcnacaagggttttgatggnggnctccn

SEQ ID NO: 98518 - DNA, 443 bp, Triticum aestivum
  unsure (1)..(443): unsure at all n locations
  Clone ID: PAT_TA_98518
gttggcatctggtaagaaccggatccgccgtcgccgtcggcggcggcatccgaacccggcgagttacgcttccgctggttcttctccacgctacccgcccatttatttgcctacttttcgttccttgctgcgagattcagattgcatctgccgtatttgatttgttctcgagggcatccgtgatgttacatccacttaaactcatccttgcactttgagtctcggcagtgaagaaaaacattgggggaatatgtagtccgagatgctctcangttcctgctttgnttaaatttgtccggctgtttttcaatggattctgctcctggctcaaagtctggttcngtgangttaatggtnacggcnttancttncccaanttcaaattatnnnggaacattanccgntgagatncaaacacctttaattccttttnngggaaaact

SEQ ID NO: 98519 - DNA, 354 bp, Triticum aestivum
  unsure (1)..(354): unsure at all n locations
  Clone ID: PAT_TA_98519
ttcgagagagaggccgagtagctagcctagtctanggtttcggtagagaggaagggagatccatggcggagacggngtaccgctgcttcgtgggcngcctcgcctgggccaccgacgacancaacctccagcaggccttcagccagtacggcgagatcctctacgccaanatcatcancnaccgctagacggggaggtcccgtgggttcggnttcgtcacgttcggnagncaggagtcnattntncatgccatccacgagatgaacggtaaggcnctcgactgncgcaacatcaccgtcaacgnaggcccaatcacgncgctccngcggttccnggcggcngtngcggctaccg

SEQ ID NO: 98520 - DNA, 472 bp, Triticum aestivum
  unsure (1)..(472): unsure at all n locations
  Clone ID: PAT_TA_98520
ccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaactccgcgcgctgtgcaccggcgaagaagggcgtcggcaagagcggcaagccgctgcactacaagggcaacgcttccancgcgttgattcccgacttatgtnccaaggcggcgacttcaccccggggcaacggaaccggcggcgaatcatctacgggaanaattcnccgacaaaattnntcaaaaganaacannccggtttcccccatggcnaaagggggcaaaacaaagngccattttnaactgaactttcccngaatttgtccaangaanacttgctttgngagtcttnaggatggcnnttcaaaaaan

SEQ ID NO: 98521 - DNA, 518 bp, Triticum aestivum
  unsure (1)..(518): unsure at all n locations
  Clone ID: PAT_TA_98521
aagccangcaagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacantttctagggcagcaacaaccatttccaccacaacaaccatatccacagccgcaaccatttccatcacaacaaccatatctgcagctgcaaccatttcccgcagncgcaactaccatattcgcagccacaaccatttcgaccacaacaaccatatccacaaccgcaaccacaatattcgcangcacaanatccatttcacnagcagcagcaancagcancaacacaacaacaacangacaacanatctnnacaaatttgaacaacacgatccatgcatggtgtggtttcagcaacacacataggcatnggagttccaatttgaacaagtnctncaacg

SEQ ID NO: 98522 - DNA, 515 bp, Triticum aestivum
  unsure (1)..(515): unsure at all n locations
  Clone ID: PAT_TA_98522
gagaactagtctcgagttttttttttttttttttttttttttttttttttttttttttttgagacgagtaanggtttcatggntaacactgcaacaagtcaacaattgccaacaacaacaacaacaacaacaacaacaacaacaacaacaacaacancaagttccccagcctcagcaaccacaacanccatttcnccagccccaacanccattcccccaacaaccacaacanccattcccccagactcaacaaccacaacaaccatttccccagcaaccacaacaaccatttccccagacncaacaaccccaacaaccatttccccaacaaccacancaaccattcccccanactcaacaacccaacaaccatttccccagctccagcaaccacaacaaccttttcccagccccancancaatgccgcanncccaacaacggcagcaatcattccccancaacacggcatccatcaacactcnacagcacagtngacccancancataccctggg

SEQ ID NO: 98523 - DNA, 532 bp, Triticum aestivum
  unsure (1)..(532): unsure at all n locations
  Clone ID: PAT_TA_98523
ccacaacaaacatttccccaacctcaacanacattcccccatcaaccacaacaggaagttcnccagcctcagcaaccanaacaacnatttctcnagccccaacaaccattcccccaacaaccacaacaaccattcccccagactcaacagccacaacaaccatttccccagcaaccacagcanccatttccccagactcaacaaccccaacaaccatttccccancaaccacaacaaccattcccccagactcaanaancccaanaaccatttccccagctccagcaaccacannaaccttttccccangncccaacaacaattgccgcanccccaacaanngcaacaatcattcccccaacaacaacggcattcantcaaccatctctacagcaanagttgaacccatgcatgaatatcctcttgcancaatgcaaactgcgtcattgggtgtcatcctccgggtaatatctggcacaaagngattgcangtgatgcggaacaatgctgcaacaactncacagatcctcag

SEQ ID NO: 98524 - DNA, 528 bp, Triticum aestivum
  unsure (1)..(528): unsure at all n locations
  Clone ID: PAT_TA_98524
cccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtggattgccaggtggatgccagcaacaatgttgccaacaacttagcacagntcctcgccagctccagtgtgcagcccacccatacgtccgtgcatccancgtccatgcnacaaggancaanaccangcatacagttctcccggccacgtttcaactcgtccaaggtcnaggcaccaccaacctcaannaccaactccattngagtgttcaagtcatgggtatgggaaccttccnacaagttcacgtggttgtccggcctggcggtccancaaccacnggccattgccnacangacccccgntaccatgggcaaaggnaatgagnaantttgctnaagt

SEQ ID NO: 98525 - DNA, 388 bp, Triticum aestivum
  unsure (1)..(388): unsure at all n locations
  Clone ID: PAT_TA_98525
aggttcccccaacaacaacatttaccgcaacaacaattcccccggccacaacaatcccctgaacaacaacaattcccccaacaaaaattcccccagcaaccaccacaacaattcccccaacaacaatttccaataccatacccaccccagcaatcacaagaaccttccccataccaacaatatccaaaacagcaaccatctgggacgacgttataatacggtggcctatgaanggaagagtngttaatatagnngggtgancacgttgttatcaatggngcatangttangatggataantaagtggagtgcacaccagtgttancccggnctgttntatccaaancaggggnantaaagnaaataattcttttccaaaaaaaaaaaa

SEQ ID NO: 98526 - DNA, 376 bp, Triticum aestivum
  unsure (1)..(376): unsure at all n locations
  Clone ID: PAT_TA_98526
gagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacgggaggaagcccccgcgccggtggaggccgaaatcgaggcgcctgcccccgtcgaggttngaggagacaaggaggaggcgccggcagcattntggcagaggagacgaagacccgaccacactgcggccgancggagcgagccccgcctggtcggagaananacaaggagccttgtttagcaaaccngcggcggc

SEQ ID NO: 98527 - DNA, 532 bp, Triticum aestivum
  unsure (1)..(532): unsure at all n locations
  Clone ID: PAT_TA_98527
agaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcaaccatttccgcagccgcaactaccatatccgcagccgcaactaccatatccgcagcgcaactaccatatccgcagcgcaaccatttcgaccacaacaaccatatccacaatcgcaaccacagtattccgcaaccacaacaaccatttccgcagcagcagcagcaacaacaacaacaacaacaannacaacaacaacaacaacaacaacacagttcttccaacaattttggcaacaacaacgatccatgcaggatgtttgtatggcaan

SEQ ID NO: 98528 - DNA, 549 bp, Triticum aestivum
  unsure (1)..(549): unsure at all n locations
  Clone ID: PAT_TA_98528
aaggctccctctcacttctcctacaccaaatcttagatcccagagagattcatgagagttcttgagagattttccaatcaagtgatagatccactccctctccctctcttgaccaaaggaattcgtgatttgagcaagtcttgagcatttcccctttgttcttgttactcttggaggttggagactcctaggcggtaggagtgctccggtgaggaatcaacttgtgatttgtcccctgggaaagttgtgaaggtttggaggccgcctcaaggtctaccactaagtggatgagaatcgccttccgtggtgatatcttaaaggagaatagggtgagcttccgtggcgttggtgtgccttccgtggtaacatccacctctcctaacggtgactacttccctcccaaaggaaattgaacatcgggatacatcctccgtctttggtgacttgggtaatccctaacctaatccttactggtggttacttgggcactttaccngcatcatggtacctggtgnccctcataaatgggtttggcatccctttgaagaa

SEQ ID NO: 98529 - DNA, 462 bp, Triticum aestivum
  unsure (1)..(462): unsure at all n locations
  Clone ID: PAT_TA_98529
gtttgatcatcgaccatgggcatggctatggccatgggagcaaggtcaacgatgaagaagagcttattgctaatattgtttgtgtgcccgctgaccatcactgtgactgattgcgccaaggacatccctgcctctgttccccaggatcctccaggaaacaaaatctgcgagaccgtcaacagaacatggccctggttgaagttttgcggcaggcacggcacctgcaataagccatgccgggcagaagggttcgaggaaggctactgcggcatgttcccctacatatcgacctgttgttgcaccaacactgtctcaanggccgcccctgggcatccgtgcaaccatgcacaaagggggcaaacaatcanccatttttacaaaatgctggactaattgaaagtttgtacttgggatcaaacacaataactacctataagggcaataaccgtgccnaaaaaaaaa

SEQ ID NO: 98530 - DNA, 401 bp, Triticum aestivum
  unsure (1)..(401): unsure at all n locations
  Clone ID: PAT_TA_98530
gcaacaaccaccattctcgcagcaagaactaccaattctaccgcaacaaccaccattttcgcagcaacaacaaccacanttttcgcagcaacaacaaccattcccgcagcaacaacaaccacttctactgcaacaacccccattttcacaacaacgaccaccattttctcagcagcagcaacaaccagttctaccgcaacaaccaccattttcgcaacagcaacancaacaaccaattctaccgcaacaaccacctttttcgnaacaccaacaaccggttcttccgcaacaacnaatancatatgttcagncatccatcttggcagcagctnaacccatgcaanggtantcctccagnagcaatggcagcccctgtggcaatgccaccaaagttcctgcca

SEQ ID NO: 98531 - DNA, 546 bp, Triticum aestivum
  unsure (1)..(546): unsure at all n locations
  Clone ID: PAT_TA_98531
aagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcagccgcaaccatttcgaccacaacaaccatatccacagccgcaaccacagtattcgcaaccacaacaaccaattcgcagcaagcagcagcaagcaagcagcaacaacaacaacaacaacaacaanccctacaacaatttttggcaacaacaacggatccatgcaaggatgtttgtatggcaacaacacaacattacgcaagggantccacaantttggcaaggaaagacttacaactggggnna

SEQ ID NO: 98532 - DNA, 532 bp, Triticum aestivum
  unsure (1)..(532): unsure at all n locations
  Clone ID: PAT_TA_98532
tttttttttttttttttggaagagaaataagtggcaacatggtgagccaccgtgttaaaatagaaaacgctcatatgtcagggtattgagtcatacttatttggctagcgcatagattttttgtctccgcttgcacgcacaggcatatttgcttgtaatacccaaaacacaaaccgcaccagataatattaggggctcaacccattaaatcacatccaaagacgaaactacggttccaatccaaaatattcccaggtttaagccatatcagacttgatgtccatcaacatgagctctcttgcttccatcacccatgaaaaaaaaccattataaaatgcactggggaacttgtcactccttggcccttggtgggaatttcctccgaacacattaagcgcggccggtggggcaccaaattgcaactccngggggccttccggcggcggtggcgggagctgggaaggcggccggagctncacacaacgaccggatccgcttgccctcctttggnttccatccgcgcaacaacngg

SEQ ID NO: 98533 - DNA, 541 bp, Triticum aestivum
  unsure (1)..(541): unsure at all n locations
  Clone ID: PAT_TA_98533
gcagccccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaatgctgccaacaactagcacagattcctcaacagtccagtgcgcaaccatccatagcgtcgtggattccatcatcaagccagcagcagaanaacaacaacaacaacaagggatgcatatctttctgcactatctcaagcaanaacaagngggtcaaggtctctagnccaaggcaagggatcatccaacacaacaacaagtnaattgggggg

SEQ ID NO: 98534 - DNA, 522 bp, Triticum aestivum
  unsure (1)..(522): unsure at all n locations
  Clone ID: PAT_TA_98534
gcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcagctgcggccgaaccggangccgangcgcccgccgtggtcgagacaagagaccaaggangccgtngctgaagcaaagccggcggcggccgangaagtgaaggaagaggcggcgcctgctgccgangccaaccggccgtccgctgctgctgagaaacacggttggaagnaaccccgcgcgtggcaacgtaacnttnaagngcaaccncncgganga

SEQ ID NO: 98535 - DNA, 504 bp, Triticum aestivum
  unsure (1)..(504): unsure at all n locations
  Clone ID: PAT_TA_98535
gtgattcggccattgccattctccacggatctggccgtggccacaaccgacgctgccggttccatggaggagctcaccccggccttctcctcattttcctccatggtcgggtctcctagtggaggtgccgatgctgccgattccacaacgcaagagcccgtggcaacgcggcaaactgaagttgttcgccggcgtcgcacagggcgtctttggcgtcgcaggaaaccctaccttggggttggcatagggcatctctggcgtcgtatgaaaccccaccgcggggctggtgcagggagtggccgaccatcccaccctgctgaagccgcaaggcgtctctgccaatccatggttggcgatccaagccgtctctatcangctccgtggttnaggcgaactgcactaacacgatttctgccctgaacgtttnatctaaaactcttgtgacgatggaanctactccaanggacaaaaaagaaacnncctaaaaatctcgcctgaacacta

SEQ ID NO: 98536 - DNA, 546 bp, Triticum aestivum
  unsure (1)..(546): unsure at all n locations
  Clone ID: PAT_TA_98536
caacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctccgtgtcaatgatcttgccacgaagtgattggccaggtgatgcaagcaacaatgttgccaacaactagcacagattcctcgccagtccaagtggtgcaagcatccatagcgtcgtgcattccatcgtcatgcaagcaagancaacaacaaggnatacagttctccgggcacngtttaagtcgtcaaagncaaggnatcatccaactcancaacaagtcaatatgng

SEQ ID NO: 98537 - DNA, 521 bp, Triticum aestivum
  unsure (1)..(521): unsure at all n locations
  Clone ID: PAT_TA_98537
ccacagtacgccgccgccgggtagtggaggccggacggctcacttccccttcctctccgcctcgtcgcctgatccagtgagggccgtcgcggcgcgtccccgcatctgcctccggtcaccgaatcccgtcggccacctccttccccacttaatcgacctacagatccttacctcccttcgccgggttcccgagcagccgaccgccgcgctgttcttcctcgtctctggcgtccacgtacagcggctgggtgccatcgtggagagtagcacgctctccccggcgaccagatgcggcgcaagaaggacgacccggcgtccacggcggagcgtgtggcgacgctggaatgctgtgcacccggcaacgacgccgcngtggtgctttggaagcctggcatcgactctgggnggcatctaaggcaggaagccntgggaanttcacgngagtgcgcgtacgcggcggtcaaggcaactactctccgcggggctccctgatnaacgaacttgcctttgnccggaaatgc

SEQ ID NO: 98538 - DNA, 535 bp, Triticum aestivum
  unsure (1)..(535): unsure at all n locations
  Clone ID: PAT_TA_98538
ccaggacaagggcaacaaggtcagcaggtangacaagggcaacaagctcagcagccaggacaagggcagcaaccgggacaagggcagccagggtactacccaacttctccgcagcagtcaggacaagggcaaccagggtactacctaacttctccgcagcagtcaggacaagggcagcagccagttacanttgcaacaatcagcacaagggcaaatnggacagcaaccagnacanggtcaacanccagggcaagggcaacaaggtcagcagccaggacaanggcaacaaggtcagcaaccggggcaagggcanccaggtactacccaacntctccgcagcaatcaggacaangggcaacagccaaggacaatggcaacatccaggacnatgggcaaccaggatactaccaacttctccgttgcaaccnaggacaagggcacccagggtacgacccaactctcccgcacagccaagacaagggcatnaaccanggacaatgcaacaaccatcacaaggcnncaagggcannacttg

SEQ ID NO: 98539 - DNA, 503 bp, Triticum aestivum
  Clone ID: PAT_TA_98539
agcaaaagtagttagcaccaatccatcatgaagaccttcctcgtctttgccctcatcgccgttgtggcgacaagtgccattgcacagatggagactagctgcatctctggtttggagagaccatggcagcagcaaccattaccaccacaacagtcattttcacaacaaccaccattttcacaacaacaacaacaaccattacctcaacaaccatcattttcgcagcaacaaccaccattttcgcagcaacaaccaattctatcgcagcaaccaccattttcacagcaacaacaaccagttctaccgcaacaatcaccattttcgcagcaacaacaactagtttacctccacaacaacaacaacaacaacttgtgcaacagcaaatccctattgttcaaccatccgttttgcagcagctaaaccatgcaaagtatcctccagcagcagtgcagcctgttagcaatgccacaacgtctgctagtcacaagatgtggcaacagaca

SEQ ID NO: 98540 - DNA, 532 bp, Triticum aestivum
  unsure (1)..(532): unsure at all n locations
  Clone ID: PAT_TA_98540
gcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacagtattcgcaaccacaagaaccaatttcacagcagcagcaacaacaacaacaacaacaacaaatccttcaacaaattttgcaacaacaactgattccatgcatggatgttgtattgcagcaacacaacatagcgcatggaagatcacaagttttgcaacaaagtacttaccaagctattgcaagaattgtgttgtcaagcacctatggcagttcctggagcagtcgcagtgccaaggccatccaaaatgttgttcatgctattatcctgcatcaacaacatanacaacaacaacaacatccgagcaagnctccttccaacagcctctnnaacatatccattaggcaagntccttccggcatctaacaaaaccaa

SEQ ID NO: 98541 - DNA, 523 bp, Triticum aestivum
  unsure (1)..(523): unsure at all n locations
  Clone ID: PAT_TA_98541
ncccagactcaacanccccaacaactatttccccagtcccagcaaccacaacaacaattttctcagccccaanancanttcccgcanccccaacaaccgcaacaatcattcccccaacaacaaccaccgttcattcanccatctctacaanaacaggtgaacccatgcangaatttcctcttgcagcaatgcaaacctgtgtcactggtgtcatccctctggtcaatgatctggccacaaagcgattgccangtgatgcggtaacaatgctgccaacaactagcacagattcctcagnagctccagtgtgnanccatccatacnatcanacattccatcatcatgcagcaagaacaacangaacaacatcanggcatgcatatcctgctgccactatatcagcatnaacangtgggtcaaggtactctcntccaanggcaaggcatcatcnaaccncaacaacnagctcaattggngggatnangtcattggtgttgcaaactcttcaaccatgtgcaacgtg

SEQ ID NO: 98542 - DNA, 523 bp, Triticum aestivum
  unsure (1)..(523): unsure at all n locations
  Clone ID: PAT_TA_98542
ntcaactggngaacaaacattatctaacacaaatcaaccangangaanttcctcgtccttgccctcattgttgtcgcggngaccaccanggccgccgaaccctttacngcattccgtagtgcttgggagccgcaacatccatcatctccggagcatcaaccanctccgcagccacaagaacatccagttccacatcaaaagttgancccatgcagggatgccctcctacaacagtgtagcccagttgctgatatgtcattcctccggtcacaggtggtgcaacatagcagctgcttgcgtaatgtgggagcagtgctgtcagcaactaaaancgatncccangcagtcaagatgcgaggccatccacaacgttgtgcacgccattattttgcancaacaacaacaattggtacaagctacntcacccaacctcaacaagcagcaacaacaagtcaacaacaacaacanggtctgggttctaancaaccacaacancatgcacaactggctangggtggattcg

SEQ ID NO: 98543 - DNA, 507 bp, Triticum aestivum
  Clone ID: PAT_TA_98543
atcacatgcgtttattttcagaccagtagctattacacagtgctatctcgacagcaactacgaaacaaagtgcacagtttcacacacacaacacgaaagcgctgtaacgcacttctgccgacacgtctggcgcgccaagaaactgggtctggggtcgctcacggaaacggagcgtggcgcttcatctcgtgcggcacgacgtcgacggcgaagcccttgtggtggcggacccagtagtcggcctggcccgggcgcggctccgccggcacctccacgtcggccctggcggccttgagctcctccgtggagaagctgtacttctgggtcgcgcttccgcaccaggtccgggcgcacggcgccgtcgcgctccccctgcggcgacaccatgagcgcgggcgcgccgagcggcaagcggtcgccgcggtcaactgccaagtgcaccaaaacttgccgaacgtgccggcattggtccaactccgccttcccaacatgctgggaaccacggtt

SEQ ID NO: 98544 - DNA, 508 bp, Triticum aestivum
  Clone ID: PAT_TA_98544
gctctctttcctcaatcagatggctagcaaaaagaaggtaacaccagccacgagtttcattcccaattcctatgaagttcatacgattgaaacgacaaggacatggctgctgaacacaaggtttccctctaaaaaaaacatggagttcaacttgactttgtgttagttggatcactcgtggattcaacaacaagaaaagcgcaccgccgctgcccagcacacccaaggccggaagtacaaattttttgcaattttgtcaattaaggcttcctcgctttgaccggagatgatgctctgcatcgtatgttaattaggattgcatttgctgttagcttttgggtagtgcaacacgagttcaagagttaaacagggggagaatgggaagcacgtgagaggataaatatgtgtgtggtagaggaacgtgtgcaacgcaagcacgtgctactacctagaaaaacaactcctgtataaaaaaacatactttttgtgatgttaaatattaactatg

SEQ ID NO: 98545 - DNA, 501 bp, Triticum aestivum
  unsure (1)..(501): unsure at all n locations
  Clone ID: PAT_TA_98545
ctttcttcaaggtgttagttgctttggcacatgggtgtaagcatactggtatttgcgaaagtacatagggactacgaacagcataacaaggccagtgagcatgatgttggcagctgcaagcagaacagctacgacgccaagggcctgagatcctgaagcagcaaccatgggggtgtccggcctgaagatttgattcacagcccctgcctcaggctgcggggcggctggccagttggggcaggtgcgttcacggcgtagttggcctgctggacgtgctgtgaagcaggaacaccaagctcctggccgcctgtgtagccgtaggcctgctggtgagcacgagcgatctgggccgcactcatcctccgcaggtatgccctctggaactcgaatggcggcaatgccgtgaatcatggcggatgcacttgtangagcgttgacagcatactcgccgctccttgctacattggtgacgatntcatcgccggttcgccgcacagaang

SEQ ID NO: 98546 - DNA, 510 bp, Triticum aestivum
  unsure (1)..(510): unsure at all n locations
  Clone ID: PAT_TA_98546
atcgccccgtgccccgtgccccacgctcatgctcgtcttccacgcacggacgggagaggagctcccgatccttgtgtccaaggcgtcctcgtcgccgttgctcgagcctcctccggcagccgtcgccggcgaccacccgcaggaccccatcgtgcccatcaccttcctcctccttgctcgtttcctccttcctgcctctcatctctcccctgtttctcttgacaggcgccgagccaccatgtccgccgccaagttcttgccaggagcgacgccgcccggatccggttgtctccgcgtcgtccgcgcccctgcctcgccattgacccgcctccccagcttgccggagtcccagcagccccgcctgctcccctgcttcacaagttcatcgctgctcgagctcccggggctactccaacgccccatggcctctgccgcgccgggactttgctgcagcangngacaanaacaacaattcgtcgtcgccttctcctctcttccgtgcgcgcggga

SEQ ID NO: 98547 - DNA, 507 bp, Triticum aestivum
  unsure (1)..(507): unsure at all n locations
  Clone ID: PAT_TA_98547
caccaccgcctcctcctcccctctcccctaggcgagacggccgggcacccgaggctctcatccgggcgagacctccggacggccgccatggccaccgctcgcgcctcctccctcctccacgtgcgcgctcaaattcccagcgccagtcctcttctcttcgcgcggcgcctccgcctgccgcgcagccgccgctcggctccctcctcccagcaacgcctccgcctcatcccgcgcgagctaccagcgggcacgccccgtgccgcggccgaccntccgcctcnaccgccgtcgatgtggccccgnngcggaggagggggccngcgcgacngtgatgtcgactcagcggnatgatgtgcggtgctgcgcggngcgnggtgccgtccatnctcgcntcagangctcggggtgaaaacgcgncgtaacctcntcgccgagtcggcgcctncggtgangtnaccngcgccgggttnnggaaagantggcggnnaggtnacgcttcnggttccn

SEQ ID NO: 98548 - DNA, 527 bp, Triticum aestivum
  unsure (1)..(527): unsure at all n locations
  Clone ID: PAT_TA_98548
ctgaacccatgcaaggtattcctccagcagcaatgcagccctgtggcaatgccacaaagtcttgctaggtcgcaaatgttgcagcagagtagttgccatgtgatgcaacaacaatgttgccagcagttgccgcaatcccccagcaatcccgctatgaggcaatccgtgctatcatctactccatcgtcctgcaagaacaacaacaggttcggggttccatccaaactcagcagcagcaaccgcaacagttggggccaatgcgtttcccaaccccaacagcagtcacagcagcaactccgggcaacaacctcaacaacaacaattgggacagggtacctttttgcagccacaccaagatactcagcttgaggtgatgactccattgcctccgtancctgccantgattgccgtgtcaagttgccgttgtataaaccaccactatgtgccattcggcgttgggactggatttgggcctacggataaggaaggcncagtaataaaattggttnacgttttaancnangga

SEQ ID NO: 98549 - DNA, 442 bp, Triticum aestivum
  unsure (1)..(442): unsure at all n locations
  Clone ID: PAT_TA_98549
aagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcaacnatttccgnagccgcaactacnatatcngcagccgcaantaccatatccgcagncgcaaccatttcggaccacaacaaccatatccacaatcgcaaccacagtnttcncnaccacaacaanntttcgcagcagcagcagcagcaacaacaacaacaacaacanagacancaacacaaca

SEQ ID NO: 98550 - DNA, 524 bp, Triticum aestivum
  unsure (1)..(524): unsure at all n locations
  Clone ID: PAT_TA_98550
cgcatcatttaagccangcaagcagtgctcaatacaaatccaccatgaagacctttctcatccttgcactccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcagccatttccgcagccgcaactaccatatccgcagccgcatctaccatatccgcagccgcaaccatgtcgaccacaacaacaatttccccagccccagcaaccacaacaaccatttcctcaagccccaacaaccccaactacatttcccaacaaccacancagcatcccccagctcaacaancccancaacattcccagtcacagcaaccagnanaccttttcccagccccancacattcgcatg

SEQ ID NO: 98551 - DNA, 532 bp, Triticum aestivum
  unsure (1)..(532): unsure at all n locations
  Clone ID: PAT_TA_98551
gtagagtgcatcattaaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttccgccacaactaccatatccgcaagccgcaatcatttccaccacaacaaccatatccacaacagcaaccacagtatctacaaccacancaaccaatttcgcagcaacaagcacaacaacaacaacaacancaacaacaacaacaacaacaacaacaaattcttcaacaaatttggcacaacaacngatccatgcanggatgttgtctgcaacaaacaacan

SEQ ID NO: 98552 - DNA, 536 bp, Triticum aestivum
  unsure (1)..(536): unsure at all n locations
  Clone ID: PAT_TA_98552
ttttttttttccaacaagaactactgttagcagcatattatatatttcctgaaattgcaaaaatccacaaggtaaatggcacaactaaaaaatacacccgttgatcaaaattggcaacactagagaatgacagctatttctatgttaagagtatggtgaacagagaacaacagcttactaaaatttcctaaaacagaatcatagcattctaggaagataagaggggaaaagagagcatgctcttaagaatgctacttgcatacaaattgaccgcctttcctcaataaggttatgctcacgagaagtggtgcatgggaactcaacaaatgcagtccaaatggcaatcttcaacttaagacaganccacaggcctgnttcctggntttccttccgtctattataacttgggcttcaatggagagagaaccccgcctagatgctgatggatctccttacaccgggggtgaccctttaccctaagtaagtgtagacggacatgccccctaatgcaatgacagncataaagcggggagcca

SEQ ID NO: 98553 - DNA, 467 bp, Triticum aestivum
  unsure (1)..(467): unsure at all n locations
  Clone ID: PAT_TA_98553
caccagcttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatnaagcaaggagtgctgctccggcgtgcaggggctgaacggatggccgcagcaactcggaccgcaagatagcgtgcaagtgcctcaaagncctcgcaacaagcatcaagtccatcaacatgggcaaggctccnggcgtgcccgggaaantccggntcaagtgtgccttcccaatcannatntccaacaaactgcaaactttcaataattcaatatanaccttcccaa

SEQ ID NO: 98554 - DNA, 488 bp, Triticum aestivum
  unsure (1)..(488): unsure at all n locations
  Clone ID: PAT_TA_98554
tcggatcagaccagagacacagagcagagcggataaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtccgttcgaggccgccgccgagaccggagccgacaacggcgggtgcaagtgcggtccaactgcacctgcaacccgtgcacctgcaagtgatccatcaaatcaagacaaggagatggaatgcaatggatgacctaatgaagggcactatagtanttatnnatgngtttcgnttgggttcccnttttnaattnccncccagataaccaatttancctanctacctaacgtancagctattcaatgcccttttggttgtccttttgttgnaaag

SEQ ID NO: 98555 - DNA, 536 bp, Triticum aestivum
  Clone ID: PAT_TA_98555
caaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcatatcaatgatcttgccacgaagtgattgccaggtgatgcagcaacaatgttgccaacaactggcacagattcctcaagcagtccagtgtgcagcatccatagtgtccgtgcattccatcatcatgcagcaagaacaacgacaaggcgtgcagttcggcggcacgttcagctcgttcaaggtcaaggcatcatcaaactcaacaacagtcaatgggggtgt

SEQ ID NO: 98556 - DNA, 540 bp, Triticum aestivum
  unsure (1)..(540): unsure at all n locations
  Clone ID: PAT_TA_98556
ctcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggcatccacaacgttgtgcacgccattattttgcaacaacaacaacattggtacaagctacttcaaccaacctcagcagcaacaacaacaaggtcaacaacaacaacanggtctgggttctaaccagccacaacaacaaacacaactggttaaggttggatgccgtgatanggaatgggtgatn

SEQ ID NO: 98557 - DNA, 524 bp, Triticum aestivum
  unsure (1)..(524): unsure at all n locations
  Clone ID: PAT_TA_98557
caccaatccatcatgaagaccttcctcgtctttgccctcatcgccgttgtggcgacaagtgccattgcacagatggagactagctgcatctctggtttggagagaccatggcagcagcaaccattaccaccacaacagtcattttcacaacaaccaccattttcacaacaacaacaacaaccattacctcaacaaccatcattttcgcagcaacaaccaccattttcgcagcaacaaccaattctatcgcagcaaccaccattttcacagcaccaccaaccagttctacggcaacattcaccattttcgcagcaccaacaactagttttacctccacancagcaacaacaacaacttgtgcaacagcaatccctattgttcagccatccgttttgcagcagctaacccatgcaaantatcctccancagcagtgcaccctgtancaagccaaacgtcttgctaggcncagatttggcncagacattgccatgtgagcaacaaantttgccagaattgcacaanc

SEQ ID NO: 98558 - DNA, 283 bp, Triticum aestivum
  unsure (1)..(283): unsure at all n locations
  Clone ID: PAT_TA_98558
cccactcantcctcggttcccggtccggtcccgttccgttcgttanggtttagtaggtagcggngaanangaaggaatggcnggcgtcgagtaccgctgcntcgtcggcgggctcgcctgggccaccgaagancaatccctctacaacnccttctccaagtatngcgacgtcatcgacnccaagatcatcactgacaggganacgggccgatncngcgggttcgggntcgtcaccttcgcgtcanncgaagcgatgcgccaggcnatngangtcatgaacggc

SEQ ID NO: 98559 - DNA, 495 bp, Triticum aestivum
  unsure (1)..(495): unsure at all n locations
  Clone ID: PAT_TA_98559
ctgcctccctccctcttcctctgtcccttgtcggagaagctcgatccctcgccggagaagctcaatccctcgccggagaagctcgatttgtcgtcggggcagttgaatccctcgtcggcgaggatgaatcctcgcaggggaggtcgaatcctcgccggggagactgatttctcacctcagaaagctgattcctcgccggagaggctgatttctcgccggaggacctcgccggccgcttttttgagcgcctagggccaaagcgaggcgctatgccaacgcccagcgcttaagcgcgcctaggcgagcgcctaatagcgccttcttgaacagtggtccagcatcaaattattaatagtcnacaagtgataaacattttgnctggcactttaagacttgcaaattaattaactctacaggtaaattgcttccngccaatacannatcatacgggtcactttanttgcccaancctaaanttccgatgagccaanaacn

SEQ ID NO: 98560 - DNA, 498 bp, Triticum aestivum
  unsure (1)..(498): unsure at all n locations
  Clone ID: PAT_TA_98560
ctagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaagggaggaggcgccggcagcattngaggcagaggagacgaaggaccccgagccagcagctgcggccgaacccggaggccgaggcgccgccgtggtccagacaagagaccaaggagccgtttgctgaagcaaagccggcggcggcgangaagtnaaggaagaggcgggcctgctgcccgaggcgaccggcgtcccgctgctgctgaagaacacngtngagcaccgcngcgcggtggcaacttaaccntttagggccaaccccccgaagaaaattgntg

SEQ ID NO: 98561 - DNA, 509 bp, Triticum aestivum
  unsure (1)..(509): unsure at all n locations
  Clone ID: PAT_TA_98561
agtgcacaacctcaagaaactacaccaacaaaccggaccaagctagaaagaataatatggcgtccaagtctagcatcacccacctcctcttggccgccgtcctggtctccgtcttcgccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagctcacaantttgcaagaaagtacttaccaagctggtgcaacaattgtgttgtcagcagctgtggcagttcccgagcagtcncggtgccaagccatcccacatgttgttcatgctatattctgcatcaacaacacaaccacaacaacancaacancacaacaacaacaacaacgttgagccantctccttcaa

SEQ ID NO: 98562 - DNA, 495 bp, Triticum aestivum
  unsure (1)..(495): unsure at all n locations
  Clone ID: PAT_TA_98562
ggcagtcctgtctggttgtcactagtggagcaaaaggtgatgggaagcttctactatggaatgctctgagaggtgaactcgcttctgatctgaattcaaacctgaggtcacaggatatggtgtatccttcgattgatacaatggagttctgtagcgagaatcttctggcgtgtggaagtgactgtgattatggtggctcagctgtggtacaactatgggatattgagtctccaagaacttacttatctttctctgcaagcgattccgtatattactcccttaaaacaacctgctggcaacactatcattacaggttctggtgatgggactattggtttatttgacatccgtgcttgttctgcaattnacattgtcngtgggggtccggtcctgaggtacatctgttcatttaacaactggtggnacctattttctgctccnacacacaaatatactttggtttgggatacaagactantccactaatcacaccag

SEQ ID NO: 98563 - DNA, 512 bp, Triticum aestivum
  unsure (1)..(512): unsure at all n locations
  Clone ID: PAT_TA_98563
ccaacttctcggcagcagtcaggacaagggcagcagccaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactaagtgtactacccaacttctccgcaacagccaggcaattgcaacaaccagcacaagggcaacaaccagcacaagggcaacaatcaagcacaagagcaacagccangacaagcgcaacatcaaggacaatggcactantgtactaccaacttcttccgcaacattcaagncaagggcaacanggtactaccaaatttttccgcaacantccaggacaagggnaacagccagacaaggcaacagccaagacaag

SEQ ID NO: 98564 - DNA, 491 bp, Triticum aestivum
  unsure (1)..(491): unsure at all n locations
  Clone ID: PAT_TA_98564
atatcacatctgggcaaacaaattcacaaggaattgagcaaaaggacaataacaacaacaacaacaacaacaacaaatccttcaacaaattctgcaacaacaacaactgattccatgcagggatgtcatcgtcttgcaacaacacaacatagcgcatgaaagctcacaagtattgcagcaaagtagttaccaagtgttgcaacaattatgttgtcagcagctgcggcagatccccgagcagtccgcggtgccaagccatcaacaatgtccgttcatgctattattctgcatcaaacaacaacaacaacaaggacaacatcaacagtcgagccaagtctcctaccaagcagcctcaagcaacatatccatcaagccaagntccttccaaccatctcaacaaatccacaggccaagntttgtccacctcaacatctgcccaactccaaggggggcccngtaccaattcncctaaagnancctattaccccgcc

SEQ ID NO: 98565 - DNA, 510 bp, Triticum aestivum
  unsure (1)..(510): unsure at all n locations
  Clone ID: PAT_TA_98565
catcatttaagccaagcaagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattgggtacaacaacaacaatttctagggcagcaacaaccatttccaccacaacaaccatatccacagccgcaaccatttccatcacaacaaccatatctgcagctgcaacatttccgcagccgcaactaccatattcgcagcacaacattttcgaccacaacaaccatatccacaaccgcaaccacaatattcgcaaccacaacatccatttcacagcagcagcagcagcaacaacaacaacaacaacaaggacaacaaatacttcaacaattttggcaacaacaacnnttccatgcangtgttgtattgcagcaacacaacatacgcanggaatnaca

SEQ ID NO: 98566 - DNA, 478 bp, Triticum aestivum
  unsure (1)..(478): unsure at all n locations
  Clone ID: PAT_TA_98566
gccggctcgccgtcgtggcgcagtagcggtggcgctggtggcgttgatggcggcagttggtctggcgggcgcggacttcgcgtcggacagcaagatgtgcgcggagaagctggctgtactggcgacgtgcttgcccgtcgtggacgcgacggcgacggcgcatgcgccgacgccggactgctgctccgggctccgggaantctgggtgacagcaaaattgctgttgcttctgatcaaggaccgcgacacccggcatcggatcaagtcaacgttaccgcgcatggactccctccgctgttcgtcccgccttcttctccgantgcccaacttcttnaatcttcgccgattccaagagggnattnttcagcattaccantcaacnaggnaaganccaacgccggaaccccgggggaacanaacnatccgtttccggtnaaggaagaancgggtttcttcccttctcctntcggntgccacn

SEQ ID NO: 98567 - DNA, 498 bp, Triticum aestivum
  unsure (1)..(498): unsure at all n locations
  Clone ID: PAT_TA_98567
atccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctgggcaagcagtccgaggatggccgcacccttggcggactacaacatccagaagganccactctccacttgggtgctcaagctacgtgngtgggtatgcagttcttttgtcaaagaccctccaccgggcaagaccatcaccctggagttngancctccagacaccattggacatgttgaaggcaagtttcaaggacaagganggatcccccccggacaacacgcctgattntttgccggnaagcactccnaggatngcgacctttccgattacaaatccaagaag

SEQ ID NO: 98568 - DNA, 499 bp, Triticum aestivum
  Clone ID: PAT_TA_98568
gccattttgttggatttgtagtagtcaaagcagggttcctgaaatgctcctgcaaactccaaagggtctggtagaagttgaaatcaacagaaattccgtcagtggcatctttctcatacttagtttcatttgatgtgttgaaaactcccttgatattgagagctgaacgctctgacaacgggaagaaatgtgccaggaacatgataatgcgtccacagaacaccacatcgttcgactttgaaagcttcgaagtagttgggttgcaatcctcaagcataaccaacttgccacgcccaaataccttgctccccaagacatcctgcttgctctcaatatacccaaagaatcttgcatcctttgatagttgacatatccgtcaatcttccaataacgggataccatgccacctcaacagcctcctttcacaaaggtaaagcatgatatcaagaagactgttatcaagcaattacttccccgctaccaatgatttcatacgcat

SEQ ID NO: 98569 - DNA, 496 bp, Triticum aestivum
  unsure (1)..(496): unsure at all n locations
  Clone ID: PAT_TA_98569
gccaagcaagcgggggtcaataaaaatccaccatgaagacctttctcatcctagccctccttgctatcgtggcgaccaccgccacaagtgcagttagagttccagtgccacaattgcagccgcaaaatccatcttaacaacaaccaattctaccacaacaaccatcattttcgcaacaacaacaacaactagttctaccgcaacaacaaataccatttgttcatccatctatcttgcagcagctgaacccatgcaaggtattcctccagcagcaatgcagccctgtggcaatgccacaaagtcttgctaggtcgcaaatgttgcagcagagtagttgccatgtgatgcaacaacaatgttgccangcagttgccgcaaatcccccagcaatcccgctatgaggcaatccgtgctatcatctactccatcgtcctgcaagaacaacaacangttcggggttccatccaaactcagcagcagcaacgnagcagtgggg

SEQ ID NO: 98570 - DNA, 547 bp, Triticum aestivum
  unsure (1)..(547): unsure at all n locations
  Clone ID: PAT_TA_98570
gtctctctactactccaccccagccaaacttctctctcgccttcgaagaagcagcagccgccgccgtagcatccatggcacccaaggctgctgagaagaagcctgtggagaagacccccgcgggcaagaagcccaaggcggagaagaaggtgccggcgtccaaggagggcggcgacaagaaaggggaagaagaaggccaagaagagcgtcgagacgtacaagatctacatcttcaaggtgctcaagcaggtgcacccggacatcggcatctcctccaaggccatgtccatcatgaatccttcatcaacgacatcttccgagaagcttgccggcgagtctgccaagctcgccaaggtacaacaagaagccaacatcactcccgggagatccagactccgtccgctctctcccggcgantcgccaanacncgtctccgagggcacaaggcgtcacaattnactcgtctagtcctctgcattantctgggttcttctctccgttgncngatnatcgtactacttgtgtgtctgacagctcatacgtacat

SEQ ID NO: 98571 - DNA, 545 bp, Triticum aestivum
  unsure (1)..(545): unsure at all n locations
  Clone ID: PAT_TA_98571
aagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccattttacctccacaacaatcaccttttccacaacaacaacaacaccaacagctggtgcaacaacaatccctgttgttcaaccatccattttgcaagcagtaaaccatgcaagtatcctccaagcagcatgcagcctgtggcaatgccacaantctgctagtccaatgttgcagcagagcattgcatgg

SEQ ID NO: 98572 - DNA, 520 bp, Triticum aestivum
  unsure (1)..(520): unsure at all n locations
  Clone ID: PAT_TA_98572
ccagaatgttgttcatgctattattctgcatcaacaacaacaacgacaacaacaacaacaacaacaacaacaacaacaacaacaacaacaacaacaacaacaacaacaacaacaacaacaacaacaacaacaacaacagcagcaacaaccgtcgagccaggtctccttccaacagcctcagcaacaatatccatcaggccagggctccttccagccatctcagcaaaacccacaggcccagagctctgtccaacatcaacaactaccccaatttgaggaaataaggaacctancactgcagacgctaccagcagtgtgcaatgtctacatccctccatattgctcgaccaccattgcgccatttggcatcttcngtactaactgagaagagangactctnagtcctanatatatgaaacacngttttcttagtccatggttgggcantgtancggtgagaaaataaagtgacatgcnctatcatgtacgaacccgactatactagtnnaactgggataaa

SEQ ID NO: 98573 - DNA, 558 bp, Triticum aestivum
  unsure (1)..(558): unsure at all n locations
  Clone ID: PAT_TA_98573
aaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttccgccacaactaccatatccgcagcgcatcatttccaccacaacaaccatatccacaacagcaaccacagtatctacaaccacaacaaccaattcgcaagcaacaagcacaacaacaacaacaacaacaacaacaacaacaacaacaacaacaattcttcaacaattttgcaacaacaacggatccatgcagggagttgtctgcaacaacacaacatancgcagcaactcacaatttgcaacaaattatacaagctatgcaa

SEQ ID NO: 98574 - DNA, 580 bp, Triticum aestivum
  unsure (1)..(580): unsure at all n locations
  Clone ID: PAT_TA_98574
ctccgcagcagccaggacaagggaaacaactaggacaagggcaacaagggtactacccaacttctccgcaacagccaggacaagggcaacaaccaggacaagggcaacaagggcactgcccaacttctccgcagcagacaggacaagcgcaacaaccaggacaaggccaacaaataggacaagtgcaacaaccaggacaagggcaacaagggtactacccaatttctctgcaacagtcaggacaagggcaacagtcaggacaagggcaacaatcagaacaaggacaccaactaggacaagggcagcaatcaggacaagagcaacaaggctacgacaacccataccatgttaacacaagagcagcaaacggccaacccaaaggtggcaaaggtgcagcaacccgcgacacagctgccgangcgntgttgggangggggggccnacccattgtcggtaaccatnatagaanctctcaacttgcntggtcttggtatcatcacttancttccataacatgactgttgcacaagtttcanttactagataaaaccattataancaaatgaaaactctcanctaa

SEQ ID NO: 98575 - DNA, 544 bp, Triticum aestivum
  unsure (1)..(544): unsure at all n locations
  Clone ID: PAT_TA_98575
gggaaacctcccatcgaagcgaagccaaggctctctcctcctcctcctcaagatgcagatcttcgtgaagacccttaccggcaagaccatcacacttgaggtcgagtcctctgacaccatcgacaatgtcaaggcaaagatccaggacaaggagggcattcccccggaccagcagcgtctcatctttgctggcaagcagctcgaggatggccgcacccttgcagactacaacatccagaaggagtccaccctccacttggtgcttaggctccgtggtgggtatgcagattttccgtcaagaccctgaccggcaagaccatcaccctgggagtttgancctccgggacaccatccgacaacgtcaaggccaagttccaagacaaggagggattcccccggacaacaactcttacttcgccngcaacacttgangatggccnaccttgcggttacaacatccaagaaganccacctcaactggtatcaggttcctngggggatcaatcttgtcaagacctcactggcaagacattacctggaggtg

SEQ ID NO: 98576 - DNA, 545 bp, Triticum aestivum
  unsure (1)..(545): unsure at all n locations
  Clone ID: PAT_TA_98576
accacaccgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccacagcatcaagtccatcaacatggacaaggtctccggcgtgcccggcaagtgcggcgtcagcgtgcccttccccatcagcatgtcaacaactgcaacaatgtcaactangttcaatatataaccttccgacgtgcatgcaaggaccgcttgtgtggagcttaattctacgttgatggatgctcatacatactgactactaatantaaatgaattctng

SEQ ID NO: 98577 - DNA, 407 bp, Triticum aestivum
  unsure (1)..(407): unsure at all n locations
  Clone ID: PAT_TA_98577
cctatcaagccgctaagcttgcccgcgtgttctcctgcaccggattccgcgtccaggagatcggcggttgcctctcgctcgcgtggcacgagcaccccctgttcacggtgtccgtgtggagcgcaatggccgccgacggcgccgacactgccaaggagcacgccgataatcacaagcttaagatgagcatcggcgagagcagcgacagccacctgccggacatcggggcgtagtgaaagagcacgacatgcatgcatcgtgggtttgaataatttgtaaaganccttggaggcagntcgtcgatcgatttatttgttagtggccggagcttaantgtatcctgancatcctcagatgggatatcggctangcaataaatgtcgnctcaatttgtgagaatatgtctc

SEQ ID NO: 98578 - DNA, 553 bp, Triticum aestivum
  unsure (1)..(553): unsure at all n locations
  Clone ID: PAT_TA_98578
atcaaaacaaggtgccatctttgtttgtcatacatgaccatggccatgcccctgtttctgatgttccttcttctgcacatagcttgggtggcatcgtcggatctccgacctgggttttactcaaaaacatgtccaaaagcggaactcatagtccgagatgtgatgaagaaggcccttatgagggaacccagaagtgttgcctctgttatgcgcttccagttccatgattgctttgtcaacgggtgtgatggttctatgctgcttgatgatacaccaacgatgctgggggagaaatggcctctcaaatataaatcgctgagatcgtatgaantgtccatcaagtgaaggaagcgctccgagaaggactgccccggagtgggttcctgtgctgacatcataatatggcatctagagatgctgtctctctgacaagtggactgaatgggagtgagttgggaagatggncaacttgagtgctaacaagaagancaaacaacatcatgcaagccaanagcaaccaantcnctaatgattctccanaaatatactacgg

SEQ ID NO: 98579 - DNA, 542 bp, Triticum aestivum
  unsure (1)..(542): unsure at all n locations
  Clone ID: PAT_TA_98579
cgggttcgggtcttcgggatcccgctctacgcccatctcttcccccccacagtccccagtctccccaccccgaacaccctcccctctcttcctcaactcctccccttctcccccggcgcgcgtcgcctcgcgcttgccgtccacgcccacgctgtcaggctcggactcacggaattcctcctcgtgaacaactcgctcatccgcgtccacgcgggtctgctcggccgcctatccgacgtacaccttcttctgcactcctcgggtactggggatcacgctcatcacctcgcacgcgagggcggggcgagtcgccggtgctcaatcactgttcgacggaatgcctgcaaggaatgttgtgcgccctgtgaacgggaagggaagcgctgggtgttctcaaatgcaggcaaaggccatanagataaatcnttgggctgggagcaatttaaatgattgccccggaattttttttttgganaaggagatnaacccggctctgagcgcacatcaatttanagantgncttgtcaacanaatttaatgag

SEQ ID NO: 98580 - DNA, 544 bp, Triticum aestivum
  unsure (1)..(544): unsure at all n locations
  Clone ID: PAT_TA_98580
ggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttgggtaatgtgggagcagtgctgtcagcaactaaaagcgatccccaagcagtcaagatgcgaggccatccacaacgttgtgcacgccattatttgcaacaacaacaacattggtacaagtacttcaaccaacctcaagcagcagcaacaacaagtcaacaacaacaacaggtctgggtctaaccagcacaacaacaaacacaacgggtnaaggttggttgcgtgatanggacatgggtgatcagacatccggnatn

SEQ ID NO: 98581 - DNA, 534 bp, Triticum aestivum
  unsure (1)..(534): unsure at all n locations
  Clone ID: PAT_TA_98581
caaatctcccaagcagttcatctcctcaaccctgagcccgccgcgcccgcctgcccgccccgatggcccgcacgaagcagacggcgaggaagtccaccggnggcaaggcgccgcggnagcagctggcgaccaaggcggcgcgcaagtccgccccggccaccggcggcgtgaagaagccgcaccgcttccgccccggcaccgtcgcgctccgcgagatccgcaagtaccagaagagcacggagctgctcatccgcaagctgcccttccagcgcctggtgcgggagatcgcgcangacttcanggaccgacctccgcttcaagagctccgccgtgtccgcgctccaagangccgccnaggcctactcnttggggctgttcgaggacacaacctctgggccatccaagccaagcgcgtcaacatcatgccaaagggacatcaanctngcccgccgatccgtggcnaaaaggcctaaattttgctcctgggggcctgntnngacttgtnaaaanggtacttcnctaacaantgttgng

SEQ ID NO: 98582 - DNA, 537 bp, Triticum aestivum
  unsure (1)..(537): unsure at all n locations
  Clone ID: PAT_TA_98582
gcggctcgtcattgcactagtcttgctcagatctcatcagccggcagctctctgctgactagaaacttgaggatggcctaggcccatgatggagctgtgacttcttcttctgttaatgtagccaccatgactcgggtgggtgggttgggtggcatggaattggagtcggccaccgcttcttgtgtcgttgcagtccccgggccaactgctgtagtccccgtgccgggttctgaagtctccggtccgggtgcgactacggcagtccccgggccagttgtcgaagtccccgtgccgcctgcgggttttctccagtcggatccggctgcatctggcgcaggcggtacgatagagtccgactctgggagacggcttgatggacggcttgaggagggcctggganggagacccaatccgtatggcttgtccggtggagccgattcgtgctanggatctgcttggccttgtcggcctgggaacttgaaggaaccgcacctnaaagtatcaactgattgctggacnaggaacnatacttgcant

SEQ ID NO: 98583 - DNA, 560 bp, Triticum aestivum
  unsure (1)..(560): unsure at all n locations
  Clone ID: PAT_TA_98583
cagacgcgacgcaaccctaagctagcgcggcggcggcggctggccaggtcgcgaggaccaggcgggtgactgacgacggcggcaggctgggggcttagagggctgcggcagcaagctccagcggtggctgcagcgcggctccagctaaggcagcaagcgacgtcttcagcggcggcagcaaccggtggctccagtggcggcagcaagctccattgggattttcctggcaattccttggtaattactcagggtccgaaccagagactagttgcagccactttgttagattactagaagatggatagaaaggggaatggactancaaatccaaagaaaaggggaagagatttgaagaagtattttgaagtgcttggtagtggcagcaactcaaaatcaaatccaagcaccgtgaaagtgtcaatatttcggcacatgccattgaaagctcattatccggtgggtncggaatcaagcattctgcancgagaatcaccgtgttccaagggcagccagngaaagaaacaacatccggggnacaagatttgttggcctnganaaaa

SEQ ID NO: 98584 - DNA, 559 bp, Triticum aestivum
  unsure (1)..(559): unsure at all n locations
  Clone ID: PAT_TA_98584
tttttttagagaaaactttatttgtattttattccagaatttaactactagtttgcgggtcacacatgacgtttgtgtgacactttatttgtcaccgctacatcgacatatccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccaagcaacaacaaccgttggattcaagcatatctacaacaacagatgaaccttgcaaagaattactcttacagcaatgcaacctgtgtcattggtgtcatccctcgtgtcaatgatctgccacgaatgattggcaagtggagcaacaacaatgttgcaacaactagcacagtcctcgccagtccagtgtgcagcatcatagcgcntgatcancgcatgg

SEQ ID NO: 98585 - DNA, 534 bp, Triticum aestivum
  unsure (1)..(534): unsure at all n locations
  Clone ID: PAT_TA_98585
gttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacancaactatttcctcaacaaccatcattttcgcagnancaaccaccattttgggcagcancanccaccattttctcagcaacanccaattctaccacagcaaccaccattttcgcaagcaacaacaactagttctaccgcancaaccacattttcacagcaacancaaccagttttacctccacaacagtcaacttttccacaancaacaacaacaccagcagcngggggcaacaacaaaccccngttggtcanncatccattttgcagcaggctaaaccaagcaagcattcctccagcagaatgcnccctgnggaatgcacaagtctggcaagtccaaatttgcagaaaacaattg

SEQ ID NO: 98586 - DNA, 539 bp, Triticum aestivum
  unsure (1)..(539): unsure at all n locations
  Clone ID: PAT_TA_98586
ctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtngcccatttgctgatatgtctttctccggtcacaggtggtgcaacatagcagctgcttgggtaatgtgggagcagtgttgtcagcaactnaaagcgattcccaagcaatcaagatgttgaggncatccacaacgtnctgcacgccatccttttgcaacagcaacaacaattgggtacaangnatttcaaccaacctcaagcagcaacaacnacaagnccaacaacaacaagncanggttctaaccnagcacaacaacaaacacaacgggttaaggttgggttgccgtgataaggacatgggtgattcagacattccngaatgttg

SEQ ID NO: 98587 - DNA, 574 bp, Triticum aestivum
  unsure (1)..(574): unsure at all n locations
  Clone ID: PAT_TA_98587
ctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttggtgcacgccattattttgcaacaacaacaacaattggtacaagctacttccacccaacctcaagcagcagcaacaacaagtcaacaacaacaacagggtctgggtcctaaccagccacaacaacaaacacaactgggtnaaggttggattgccgtgatanggacatggggtgatcaagacatcccggcattgcgacgtgcatgttcaacatacgctacacacat

SEQ ID NO: 98588 - DNA, 455 bp, Triticum aestivum
  unsure (1)..(455): unsure at all n locations
  Clone ID: PAT_TA_98588
cgccgccgtccgccgccgctcgctcgccatggacgccgccaagcccgccccggcccccgcccgccccgccggncccgggctntangccgacatcggnaagaanggcanagatttcctcaacangggactacaccannggccagaagttcancttcancaaacaacgccgccaaacgggggctacaaatactanttntagcacaaaagaaaaatnaagctatcgtgggtgacctccaaacncacntgnaagatntaaaatttnacantggatgtgaaagcaanttctgnctcnaatgttntactacaaanaacaggtccngactgtaaacacgggctttaagggagttcttcccctnccttccccnacaaaaagtctaaccctgggaaaggtggaccccatacttgaaacccaacttgggaatnaaagggaatntttggcccgaattaaaacccct

SEQ ID NO: 98589 - DNA, 526 bp, Triticum aestivum
  unsure (1)..(526): unsure at all n locations
  Clone ID: PAT_TA_98589
agcgctcccccctcctcaacaacctcccggcgcatctccgactccatggcccgcaccaagcagacggcgaggaagtccaccggcggcaaggcgccgaggaagcagctggccaccaaggccgcccgcaagtccgccccggccaccggcggcgtcaagaagccgcaccgcttccgccccggcaccgtcgcgctccgcgagatccgcaagtaccagaagagcaccgagctgctcatccgcaagctccccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcacatcatgcccaaggacatcagcttgcccgccgcatccgtggagaganggcctaagccgcaatctgtgcccgtgagtgttaagncaacttancctttgtcaacgttggaatgtatgctgctatgttt

SEQ ID NO: 98590 - DNA, 543 bp, Triticum aestivum
  unsure (1)..(543): unsure at all n locations
  Clone ID: PAT_TA_98590
aagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaagagtccggcaaggcctaaacagtcactcancacgggccacatataaagtgccattgcggtttgtcaactccgacattgctttggggtttcctccnccattancttcctgttgttccnaaganatgtgtangtccaatgtcaagtncaacattcccgagaaacatgccctnagtgaatgcaaaaaaaggggggcccgtacca

SEQ ID NO: 98591 - DNA, 555 bp, Triticum aestivum
  unsure (1)..(555): unsure at all n locations
  Clone ID: PAT_TA_98591
taagtagagcgcatcatttaagccaagcaagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattccgcagccacaaccatttcgaccacaacaaccatatccacaaccgcaaccacaatattccgcaaccacaacatccaattcacagcaagcagcagcagcaacaacaacaacaacaacaagaacaacaatactcaacaaatttggcaacaacaangatccaagcatggtgttgtattgcancaacacaacatagcgcatnggaagtcacaagnttgcaacaaanactncaagcggttgn

SEQ ID NO: 98592 - DNA, 526 bp, Triticum aestivum
  unsure (1)..(526): unsure at all n locations
  Clone ID: PAT_TA_98592
cgaagccaccgcgatggcccgtacgaagcagaccgcccgcaagtccaccggcggcaaggcgccccgcaagcagctcgccaccaaggcggcgaggaagtcggcgccgaccaccggcggagtgaagaagccccaccgctacaggcccgggaccgtcgccctccgggagatccgcaagtaccagaagagcacggagctgctgatccgcaagctgccgttccagcgcctggtccgcgagatcgcgcaggacttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccaactcgcccgccgcatccgtggcgaaanggctaaaccgtctccccgtcaacccgttagtgggttcggaagtggatgtttgcttccggttgtatttgttccnattgccgtgctangtcanctctttggtgtaaaaaaa

SEQ ID NO: 98593 - DNA, 215 bp, Triticum aestivum
  unsure (1)..(215): unsure at all n locations
  Clone ID: PAT_TA_98593
cgcacacgccgatccatcgattatccatcgaggtcaggtcaccatgagagtggccgtgcccctcgcctcgctcctcgccgtgctcctcctggtcgccgcggcgtgcgcgggggaagggaggaggaggaggaccnggaggtgacggcntgcaatcagcagtgcccggggcancggnagttcggcncgnaggagcggcggtactgngtgncggcatg

SEQ ID NO: 98594 - DNA, 551 bp, Triticum aestivum
  unsure (1)..(551): unsure at all n locations
  Clone ID: PAT_TA_98594
catcatttaagccaagcaagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacaatattcgcaaccacaacatcaatttcacaagcaagcaagcaagcagcaacaacaacaacaacaacaaagaacaacaaatacctcaacaaaantttgcaacaacaactggattccaatgcatgggtgttggtntggagcaacacaacattncggcatggganatntacaagntttggcaacaaagtacttacc

SEQ ID NO: 98595 - DNA, 542 bp, Triticum aestivum
  unsure (1)..(542): unsure at all n locations
  Clone ID: PAT_TA_98595
cctgcccgcgccgccgccgcctccttccgcaggagctccctccccgcgggcgcgatggtgtacatcaagaaccagaagacaagggcgtactccaagcgtttccaagtcaagttcaagagaaggcgccaggggaagaccgactacagggccaggctgaggctcacgaaccaggacaagaacaaatacaatacccccaagtaccgttttgttgtgcgatttaccaacaaggatgtcactgcacaaattgtctatgctaccattgctggtgatatcgtgatggccgctgcctactcccatgagttgcctcgctacggtcttgaagttggcctcaccaactatgctgcagcctactgcactggtctgcttttggctcgtcgtgtgctcaagaaccgtgatcttgatgaggagtatgaaggcaatgttganggcacangtgaaggacttctctgttgagccttctgaatangangangcctttcccgtgcgctcctgggatgtttggccttattaggacaaccaattgggaaacgccntntttggtg

SEQ ID NO: 98596 - DNA, 552 bp, Triticum aestivum
  unsure (1)..(552): unsure at all n locations
  Clone ID: PAT_TA_98596
gccgcccgccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaagggcatgccgcacaagttctaccacggccgcaccggccgcgtctgcaacgtcaccaagcgcgccatcggcgtcgagatcaacaagcaggtcggcaacaggatcatcaagaagaggatccatgtccgtgtggagcacgtgcagccatccaggtgcaacgaggagttcctccagaggaaactcaacaacgacaagctgaaggcggaaggccaaggcccgcggcgangtcatcaagcaacaaaganggaaccaacaaggggccaaanccgggggttaatggtttaagggaacaaccatncaagacggtcaacccccatcccgtttgaacgtcgtcaaacat

SEQ ID NO: 98597 - DNA, 534 bp, Triticum aestivum
  unsure (1)..(534): unsure at all n locations
  Clone ID: PAT_TA_98597
ctcgagttttttttttttttttttcaatcaacccgcttgcttgggtgcttctccactagttttcaaaatcctacaactttcatctgattttgtgagcaagtctaaccccgacaaaaagctactgctcggcctgcctgcactccctaacctctcctcccttgtcagctacgacctttttgagcaactattacagtcgtcatgagcaacgactaggtgaactacaacttatgcagaaatttaccaattcagaagcacgccagccgtgaacgcccatgcttatccgctcgaagagcaaatgcagtcgacccatagcctcgggtgcaccctgatggacacacacaccgactcatttgccacgaccagcagcgtggcgtccctgaagttgactcgttcaccccgaccagcagcacggcgtcgctgatgtcgtatgtctccttccattgcgctccatccagggaccctcaacttgaacgacaacgtccgccggcggcgccacccttccgtggcctggcttagactccttgagcacaacan

SEQ ID NO: 98598 - DNA, 520 bp, Triticum aestivum
  unsure (1)..(520): unsure at all n locations
  Clone ID: PAT_TA_98598
cacaagatagcgtcgatacaaggagaaaaaggaaaatttcactcgatcaacacacaaattaatcaagtaaaaagcttcactgcgactcttatagaaccaactacttaaactaattagccctgtagcctgcaaagaggttgaagagcgcctcgtcgccgaggtggtgcgcggcgtagatgaggtcgatggcggcgtcgtgcgtcagcccgcggacgaactcgccgtcgaactcgccgccgtccgcgccgcgcgcctccgcctcggcgcgggcctggtagtacgcgaccgccgtggcgaggcccttgccggagaccccccgcggcagctccaccacgctctgccccgcctccagcgccgccgcgacgctncccgcccgccgcgccaccgacgccggcaccgcgaacttggcgaggtccgcgcaacgcaacaagcaacgtttgctctcccccgcatcgatacatnctcgccgagttcgttgccngagcttcccttgcgcngggcttgcaaaactgtttgacan

SEQ ID NO: 98599 - DNA, 537 bp, Triticum aestivum
  unsure (1)..(537): unsure at all n locations
  Clone ID: PAT_TA_98599
aaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataacccttcctacgtgcatgcatggacgcgcttgtgtggagcttaatgtctatgttgatggagtgctcatacatactgatgagctactaaaaaaataaaataaagttgcctgcatgtgttattcaataatng

SEQ ID NO: 98600 - DNA, 544 bp, Triticum aestivum
  unsure (1)..(544): unsure at all n locations
  Clone ID: PAT_TA_98600
tccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctccgccaagctccagtgtggcaagccatccatagcgtcgtgcattccatcgtcatggcagcaangaacaacaacaaggnatacaagattctccgggcaatggttcaagtcgtccaaggtcaaggcatcatccaacctcaacaancaactcaattagg

SEQ ID NO: 98601 - DNA, 529 bp, Triticum aestivum
  Clone ID: PAT_TA_98601
gtggaggggtatgtatagcctccacacaaaatctagctgttacacacattttaccaaactcggtcagaccgaatagcgaaactccggtgagaccggtctagttcaaaatgtgaatgttaggaatctcggtgggaccgacatgatcaactcggtgggggatgtgctagggttagggcaaaacctcatctcggtgagaccgatttcaacaattgatcaaacagagagttggtcagacaaactcgatgggaccgattgcacatttcggtaagaccgaaataattgcaataggcaacagagagtttacagggccatctcggtgagaccgagatccatatcggtgtgaccgtattgattagggtttctggcagtggctatgtcaatgaactcggtggcgctggatagatcaaatcggtggggtcgaatttgactttaggttttggacatatgtggaaatgataaagtggttaaggttttggagtaatatcactaagcactttgagcaagcaagccaataagcaacaactcaatc

SEQ ID NO: 98602 - DNA, 539 bp, Triticum aestivum
  unsure (1)..(539): unsure at all n locations
  Clone ID: PAT_TA_98602
accaccattttcgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacagattcctcagcagctccagtgcgcagccatccatggcgtcgtgcattccatcatcatgcagcaagaacaacaacaacaacaacaacaacaacaaggcatacagatcatgcggccactatttcagctcgtccagggtcagggcatcatccaacctcaacaaccaagctcaattggaggtgatcaggtcattggtaatgggaactcctccaaccatgtgcaacgtgttggtccaactgagn

SEQ ID NO: 98603 - DNA, 538 bp, Triticum aestivum
  unsure (1)..(538): unsure at all n locations
  Clone ID: PAT_TA_98603
gctccccacctgctccgctcctcccctctcctctcgccgactcaccttcctcgatccaccgcgccggcccatcccagcgccgcgccagcgccaccatgatgaggtggtggtgggcgggggcgttcggcgccttcaagaagcgccgggccagcagccgcgcccgcgccgccgcggaggcgccccagaacaacgtggccctcgtcgtcggctccaccggcatcgtcggcgccgcgctcctcgacatcctcccgctccgcgacacgccggggggcccgtggaaggtctacgctctctcccgccgcccgctcccgccgtggtccgcgcccctcccgcccgacgtcttccaccaccacctcgacctcgccgacgccgccgccgtcgccgacaccctcgcgcccctcaccgacgtcacccacctcttctacgtcgcctgggacccccgcccgacgcacggggaagggccgcaaggcaaacggcgccatgctccgnaacgtcctctccgngctcgtcccaaactgccccggctgntcaagtctgt

SEQ ID NO: 98604 - DNA, 514 bp, Triticum aestivum
  unsure (1)..(514): unsure at all n locations
  Clone ID: PAT_TA_98604
ccaccgcgggcgtcgggcactggagttggccgccacgcgcgtcgttcctgtagccttggaagcgagccgggcactggagttggccgcgggcgtcgggcactggaattggccgcctcacttatccgatcttgattgagttattcaatcttcgatcaatggatgccaacttccctgttctttcttctttttgttgttcttggaggcctggtacctcgtttcatcccagatcgaggggcctcaccgcgcctgcctggtgaacgcctcgggctggtgcgtgaggttgaggctacgcgaccacgtaccggcaggagacctgtgccgccgtgccactttgcaaaggcgtggactaccgccggttcggtgtttctcgcgggcgaacccatcgtgaaaatcgctccgctggagagcgacggcgctgggcaagggctgcccttcgggaagttgcccggctcttcgcgtcaaggcnaatggaannctccgccgggaacctgctganaacttgttgtaaanaaan

SEQ ID NO: 98605 - DNA, 536 bp, Triticum aestivum
  unsure (1)..(536): unsure at all n locations
  Clone ID: PAT_TA_98605
accaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcacctttttccacaacaacaacaacaccaacagctggtgcaacaacaaatccctgttgttcaagccatccattttgcaagcagctaaacccatgcaagctattcctccaagcagcagtgcaaccctgtgggaatggcaacaaagtcctgncaaggcnncaaatggtgncacaaaag

SEQ ID NO: 98606 - DNA, 544 bp, Triticum aestivum
  unsure (1)..(544): unsure at all n locations
  Clone ID: PAT_TA_98606
attatctaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgatccccaagcagtcaagatgtgaggccatccacaacgtcgtgcacgccattattttgcaacagcaaaaacaattggtacaaggtacttcaacccaacctcagcagcagcaacaacaaggtcaacaaagaacatggtcanggntctagccaagccacaacaacaacaacaacaacagcaactgggttaagggttgggttntngcgaataggganatggtggntcaaacgt

SEQ ID NO: 98607 - DNA, 219 bp, Triticum aestivum
  unsure (1)..(219): unsure at all n locations
  Clone ID: PAT_TA_98607
gncctgacctcccncctctcccncctcttgctcttcttttaatggnttctctgtcccctcggtcncctgcctcagctcgctcacctgcgtantagcagtagtaggctggggttgggttgggtgtggcttcagaacnagaatcgagaganagagagagagcacatgcctctgagctattccttccacttccagcgagtgttccaganattgggcacatca

SEQ ID NO: 98608 - DNA, 540 bp, Triticum aestivum
  unsure (1)..(540): unsure at all n locations
  Clone ID: PAT_TA_98608
atttccaccacaacagccatatccgcagccgcaaccgtttccatcacaacaaccatatccgcagccgcaatcatttccacagccacaaccatttccgccacaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggncacaaagcgattgccaagtgatgcggnaacaatgctgccaacaactagcacaagattcctcaaaaagctcccagtggcggaagccatccataagcgtcctgnaattcaatcaaccatngcangaaacaagcaagnaaccaacaacaancaacaagggnng

SEQ ID NO: 98609 - DNA, 527 bp, Triticum aestivum
  unsure (1)..(527): unsure at all n locations
  Clone ID: PAT_TA_98609
caaccacaacaaacatttccccaacctcaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgcnaacaactagcacaagattcctcgccaagctccaatgtgcaaccatcatagcggtcgtgcattcaacgtcatgcagccaggacaacaacaagggattn

SEQ ID NO: 98610 - DNA, 512 bp, Triticum aestivum
  unsure (1)..(512): unsure at all n locations
  Clone ID: PAT_TA_98610
ctcgaattgtatgcaccgcttcccagaaacactcgaagtcgtaggggatgcttgtcctctactgaagcgctttcgattgagccaaaggtccttctacagtgaatgcgtagatgacagcgcagccatggcgattgctaagatgccggagttgcggtcattgcagctcactgctaattcgctcaccaacagtggtttggaactcatccttaatggttgcccgctccttgagtctctcgatatccggtcttgttaccatgtttgcatggatgatgaaatgcaagcaaagtgtgctaggatcaagactctgaggcatcctgaagactccatggatgattatgacatgtcgtttaattataaaattccgagaccatgctggtctactgaaccaatcgaatactctatgggttgtcaaagtccttactaagtgttcaaggtatgtaccggtagaacatcaacccgacatttgcttgaaantcntgtaactgtgaactgcaatccaatttgtanttgtt

SEQ ID NO: 98611 - DNA, 567 bp, Triticum aestivum
  unsure (1)..(567): unsure at all n locations
  Clone ID: PAT_TA_98611
ccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttccccatcagcatgtccaccaactgcaacaatgtcaactagttcatatataatccttcctacgtgcatgcatggacnccttgcgtggactaatttcncnttaatggattgncaacaatnttnnctactaaaaantaaantaanttnccgggtgttttttcan

SEQ ID NO: 98612 - DNA, 468 bp, Triticum aestivum
  unsure (1)..(468): unsure at all n locations
  Clone ID: PAT_TA_98612
gatgaggccgacgtcgcggtggagctggcgcgccttggcgcggagcagggcctcgcggagcttggcgcggatgaggcgcgggatgaaggtgaggagcgagagcgcggtggccagggagacgagcgcggcgaggagctttgcggcggtggaggcgaggaggaggccggaggagtgcgggtggtggtgggtgaggacggcgagcaggtggacggcgccgccgagcacggcgaangcggngagctggagcagcagccacttgacgggcgcgaggtcggcgcaggaggcgaagtatagcagctccagcgggatggagaggtangaggccgcgatgaggaagtcgctcaccttctggcactgcagcatggcgtccaccgcgccgtcgcacccgtcgccgcaccgccgcatcttctgatantccatccggccccgattangcgantcaaccgagcgcacgttcngtgcatggga

SEQ ID NO: 98613 - DNA, 531 bp, Triticum aestivum
  unsure (1)..(531): unsure at all n locations
  Clone ID: PAT_TA_98613
ggagctcctggacgcgcgcagcgccgcacgatgcacggcggtctcccgcgcctggttcggggtcgccgccgacaaccgcctctgggcacccaagtgtgctgaactgatggccggaaaggcacatattcctcgtctgacaatgatccgtactgcatcaaagttgtctacctattcaatggccatcatggatggcaagcggaatcggatcacaaaagaggatctctgtgatcatgcatgggaatatcgtttcactattgcagcaccagagtactggagtaatctcgatncgtcctggaagcgcactggtccacccatgcgacgattcttccaacatgatggttaacaacagtgcanattctcaagacgcttntctggggtgggcaanaagtgtnagtacaacaattataacaaagctttgtcgggtatgggaagaatcagagataataagtnaaggattaaccggtgggcaacgattaaagtgtcnagaaaggaagantggagctgggagctatccaancaactctacgctaa

SEQ ID NO: 98614 - DNA, 455 bp, Triticum aestivum
  Clone ID: PAT_TA_98614
gacggtagcatcatccatcttgctagcacactggcaatctgcacaggcactagaaaggagacgatcctatccactctcacaatgaaacaagagaaacaatttgcagtcatctataagcctattctttaatccgttcaattacagaatttatgattatgtaaatggagtatgggatctgagaagaaaaaaagctgaagcgaaaaagacaacggggcgatgggtgccgggagcgggaaccgatggtcggtggatggaaccgtggaggtgctcgctgttgatagtctaacacattgagttgcatccgattcaaggaatataatgaacaagtacattggtatgaacaggtcatcgactttgacagaaaatgcatacagattatcagttcctgctgagttgtactattatgctacagaatacacatcagctattatgctacagaatacacataattagtt

SEQ ID NO: 98615 - DNA, 572 bp, Triticum aestivum
  unsure (1)..(572): unsure at all n locations
  Clone ID: PAT_TA_98615
gccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaacaacaacntnttcaacaanttttgcaacaacaactgatncatgcanggatgtttcctgcaacaacacaaccgtcggaagcantgtcanacgttttgcacaaagtanttncaactttgnngcatcgtttn

SEQ ID NO: 98616 - DNA, 540 bp, Triticum aestivum
  unsure (1)..(540): unsure at all n locations
  Clone ID: PAT_TA_98616
cttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtcatcaacatgggcaaggtctccgggcgttgcccggaagttgcggcgtcagcttgcccttcccaatcagcaatttcaacaaacttgaacaatttcaactnagttcaataatatnaaccctcccaacttgaatgcaatggaccccccttgcntggnccttaaatttccaactttnangggntggncccanacaaat

SEQ ID NO: 98617 - DNA, 341 bp, Triticum aestivum
  unsure (1)..(341): unsure at all n locations
  Clone ID: PAT_TA_98617
ccgcctcccgttcgnctgnangcagcggagccaccntctccgtcgccgcctcngaccccggcgcccgtcaccatgattatctncaagannaaccnccgntagatcngcaagtaccncttccatcgagggagtcttgtacnccaatgaaggantacaacctggccaagcacccccaggtcgatacctcgaatctcgaggtcatcaagctcatgnagagcttcaagtcnaangagtangtcagggagaccttctcgtggnagnactantactggtacctgancaacgtcggaatttngttcctccgcaccttcctcaacctgcacggtctgagatagtgccca

SEQ ID NO: 98618 - DNA, 532 bp, Triticum aestivum
  unsure (1)..(532): unsure at all n locations
  Clone ID: PAT_TA_98618
agcaaaagcagacagcatcctacctgcggtccgatacagattttcccccgagctacaacccaaagcaacatcgacaatgtcgatcgtgaggcggagcaatgtgttcgaccccttcgccgacctctgggccgaccccttcgacaccttccgctccatcgtcccggcgatctcaggcggcaacaatgagacagctgcgttcgcgaacgcccggatggactggaaggagacgcctgaggcacacgtcttcaaggccgacctccccggcgtgaagaaggaggaggtcaaggtggaggtggaggacggcaacgtgctcgtcgtcagtggcgagcgcacaaaagganaaagnagacaagaacgacaagtggcaaccgcgtggagcgcaacaacggnaantttgtgcggngcttccggctncccgaagaaccccaaggtggangaaggtnaaggccggcttgagaaaagggtgntcaacgtcaacgtntcccaaggcccaggtaaaaaaccccanggnaaaggcaacngatttccnggn

SEQ ID NO: 98619 - DNA, 538 bp, Triticum aestivum
  unsure (1)..(538): unsure at all n locations
  Clone ID: PAT_TA_98619
aacaacaacaacaacaacaaaagcaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgtcaggccatccaaaatgttgttcatgctattattctgcatcaacaacaaaaacaacaacaacaaccatcgagccaggtgtccttccaacagcctctgcaacaatatccattaggccagggctccttccggccatctcagcaaaacccacaggaccagggctctgtccagcctcaacaactgccccagttcgaggaaataaggaacctagcgctacagatgctacctgcaatgtgcaatgtctacatccctccatattgcacaatcgcgccatttggcancttcggtactaactgagaagaaaataactctgtactagatntatnaaacaacgtttcncagtccat

SEQ ID NO: 98620 - DNA, 534 bp, Triticum aestivum
  unsure (1)..(534): unsure at all n locations
  Clone ID: PAT_TA_98620
aagaaactgaagcgaccgaggttttgcccccaaatccccccacccccctcacgcgcacctcgccgccgccgccgcccccgtcccctccctccctccaccaaaccctcgtcgccgccgcagcgcagcgcagcgcagcaccgcagtcgccccccgatggcgaccgccgccggccccgtcggcgggctgtcggcgaaggacgagattagggaggtggagatggagatcatgaacccgccggaggaggcggcggagcgggccgggctgaagagggcttggggctacgcgaacgccggcgcttctcatggttttattggagtgactactgctgaaaaggagccaacactcctgcctcataacaatgtcaaatatctgaagaaagctggcagtggcaatcttctacgtccggatatgcaaatactaatgcntggagatttatanctcanctcctggtggaaatttggggaagaaaaaccaagaancctacngggtnaccttaaagcccaagggcaattncaagaaagggaattatttntg

SEQ ID NO: 98621 - DNA, 540 bp, Triticum aestivum
  unsure (1)..(540): unsure at all n locations
  Clone ID: PAT_TA_98621
cgacgctcaagcccccagacgccgcagcgccgccactccacccgcagcggcaaccatggcggtcggcaagaacaagcgcatctcaaaggggaaggaaagggtancaaaaagaaggccgtcgatccgttcaccaanaagcagtggtatgacatcaaggcgccgctgctgttcaccagccgcaacgtcggcaagaccctcgtgtccaggacacagggtaccaagattgcctcanagggtctgaagcacagggtgttcgaagtatctctagctgatcttcanaacnatgaggaccaggcctacaggaagatnanactccgtgctgangatgtncaagggatgaatgtcctcacaaacttctggggcatgncttancactgacannctcaagtctcttgtgangaagtggnanacatcattgagctcattngatttaagacactgacaactacatgctccgcatgtcacattggcttacganagaccccaaacaagtnaanncattctatcccatncantcanttanacantcgccnaagattg

SEQ ID NO: 98622 - DNA, 422 bp, Triticum aestivum
  unsure (1)..(422): unsure at all n locations
  Clone ID: PAT_TA_98622
agcatccagattccacactccagagcaactgtttcaggctgagttgagtttttttggggttgccaatggcggacatcgcgatgctggtggcggaggagcacgagaagaggatgaagcgaggggcgccccgcacggtcgccggcgccggcgangagntcccgaaggggaaggttaacttccgggcggttacaaggtttggggctccctgggccnattctgcccgccgnccgccgcgttccgggtcaaagggcaacttcccgtgctccttcaagtccaactttgttggcggccganccaaaanaccccgtttccccggcaacctttcaangnttcttcccngctttataattttgatttaannnattccgaggagtttacntntttgagtactccccccttaancaanttaaaaaatcccgttt

SEQ ID NO: 98623 - DNA, 412 bp, Triticum aestivum
  unsure (1)..(412): unsure at all n locations
  Clone ID: PAT_TA_98623
aaaaataatggaaacaatagggagaaggagacgaacaaagagttcggcgctaggcatagaatcttcagagtctggccgcgttccaggggttcggctctaggcgattgtctgatgcatcacgcaggtggtacgctcctccagtgagaacttcgtcaatgatgaagggaccctcccacttgggcttgagtttgtcctttttcttctccggcaagcgtagaacgagttcaccaacattataagtcttggcccgcacttctctgctttgatatctgcgggcctgctgttgataaaatgcgaaacgggttttgcaacgtcgcgctcctcctccggggcatctcaattgtcctgccgattnaactcggcctctctctctcgtacatgcgcatccnagggggggcccggtaccaattcg

SEQ ID NO: 98624 - DNA, 438 bp, Triticum aestivum
  unsure (1)..(438): unsure at all n locations
  Clone ID: PAT_TA_98624
ctcgcgcccgcaccccaggaagctcaagaggctgtcctgagaagctcaaatggctcccaaagttgctgttgccaagaagggcgatgccaaggcccaggctgccaaggttgccaaggctgtgaagtccgggtcaatcaagaagaccgcaaagaagatccgcacgtctgtgacatttcaccgccccaagaccctgtccaaggccagggaccccaagtaccccaggattaagcacccctggcangaacaattagaccantaccaagataccaaagtacccgcttacaactgantctgcgatgaaanaaattgaagacacanaccttgtcttaatcgtcaacctgaaggcagncaaaaaaaattnaanggtgccgtnaaaaaaatnttcnaaatccaagccaaaaaggttaacccttttaaggcctaatggnaaaaaaaggt

SEQ ID NO: 98625 - DNA, 553 bp, Triticum aestivum
  unsure (1)..(553): unsure at all n locations
  Clone ID: PAT_TA_98625
agcctatttatcctacaagagcgctagggagcgcaaattttggtaaaaccgaacataagttcacatgaaccccttcactagtttgtgcacttgtaaactcagaaaaattcatagtattataaaatgttaattcaggcacatgtttcaaaaaaaatcatatgcatggcgtagcaaaatgacaggagtacaagttataccacaaaattttgcttccgtacccccccccccctaaagtttgcacnaatcttaaaattacttaaaaaggatatcaccatattancctgcagatccaacatatacaaaatactatattatcctttttgattgaaggggtaccttccaatctccaactttaatccgcttcgaaaccgtaaactttctaagggggtgtaccaaagcaaaatcccnaaattttttacgtanagaacaaatatgatcataattcnaatcgagatttgtatanagcctaaactaaaattgtcagcataagttttganaactganaattcggactatanccagaaggggacatatggcataatcacgtcatctt

SEQ ID NO: 98626 - DNA, 303 bp, Triticum aestivum
  unsure (1)..(303): unsure at all n locations
  Clone ID: PAT_TA_98626
cggagaagttgggtagtaccaatggctgcaaccagganaagggnaacaagggtactacccaacttctcngcaacagccaggacaagggcaacaactangacaatggctgcaaccaggacaagggcaanaagggtactacccaacttctctgcaacagacangacaatggcagcaatcangacaagggcaacaangntactacanctcataccatgttancgtngancaccagncggncancctaaaggtggcaaangctcatcatctctntgcacagctgccggcaatgtgccngntggatgg

SEQ ID NO: 98627 - DNA, 550 bp, Triticum aestivum
  unsure (1)..(550): unsure at all n locations
  Clone ID: PAT_TA_98627
gtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgactctgggaggggcgcatttattaagataaaaggctgacgcgggctctgctcgctgatccgatgattcatgataactccacggatcgcacggctttcgtgccggcgacgcacattcaaatttctgccctatcaactttccatggtaggataaggggcctacaatggtggtnacgggttgacggaaaattaggttccnncccggnaaaggaacctgaaaaacgggtacanatccaaggaaggaacaagggccaaattaccaanctgacacgggaagtantgccaataaatacataccgggncataatgtcgggaattggaagggtaaatcaaancctaacaggntcattgggggaatcgggcaaaaccgggtantcanncaatactan

SEQ ID NO: 98628 - DNA, 390 bp, Triticum aestivum
  unsure (1)..(390): unsure at all n locations
  Clone ID: PAT_TA_98628
gcancaacaaccaattctaccgcaacaaccaccattttcgcaacaacancaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcangcagagcagttgccatgtgatgcaacaacaatgttgccaagcagttgccgcaaatcccccancaatcccgctatgaggnaatccgtgctatcatctaatccatcaacctgcaangaacaacaacaggtttcaagggtccatccaatctcancagcancaacccaacagttgggcaatgttttcccaacccaacagca

SEQ ID NO: 98629 - DNA, 532 bp, Triticum aestivum
  unsure (1)..(532): unsure at all n locations
  Clone ID: PAT_TA_98629
ctcccaatggctactgcaaggtcacatgggttgagcatactgaatacgatgaggcatctgtccatcagttctaccgaccacttctccgatctggtcttgcctttggcgccagccgttggctcgccactctgcagcgccagtgtgaatgcctggccatcctcatgtcctctgctacagtgtcacctaatgaaccaacagctatatcgcaagagggtaagcgtagcatgctgaagcttgcacgcaggatgacggagaacttctgtgcgggggtgagcgcatcatccgcgcgtgaatggagcaagctggatggtgcaacaggtagcatcggtgaggatgtgcgtgtcatggcacgaaagagcgtgagcgagcctgnggagccaccacgggtggtgctgagtgccgccacttctgtatgggtgcctatngccctgagaattgtccacttctgcgtgatganagctgcntgcgantgggacacctcanaatggaggccatcagaatgtncaantgaaagggatcanatggaatcgga

SEQ ID NO: 98630 - DNA, 520 bp, Triticum aestivum
  unsure (1)..(520): unsure at all n locations
  Clone ID: PAT_TA_98630
cccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattgggtgtcatccctcgtgtcaatgatcttgccacgaagtgattgccaggtgatgcagcaacaatgttgccaacaactagcacagttcctcgccagtccaatgtgcagccatccatagcgtcntgcattccatcgtcatgcagcaagaacaacaacaaggatacaattctccggcactgtttcaactcgtcaaaggtcaagnatcatccaactcaacaacaactcaatatgagngataaggcattggnattgagaaccttcaaacattgcaactgtattccgactgacgntcaacatcaacggacaattgcaacatatcgccggcatantggcatgaaaatggaaagtttgcn

SEQ ID NO: 98631 - DNA, 544 bp, Triticum aestivum
  unsure (1)..(544): unsure at all n locations
  Clone ID: PAT_TA_98631
gcaacaacaaccaattctaccgcaacaaccaccattttcgcaacaacaacaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggtcagggttccatccaatctcagcagcagcaaccccaacagttgggccaatgtgtttcccaaccccaacagcagtcgcagcaacaactcgggcaacaacctcaacaacaacaattggcacanggtactttttgcaaccacacaagatactcaacttgaggtgatgacttcaatgcgctccgtacctacaacgattgcgtgtaagtgcgttgttagaacacactagtgg

SEQ ID NO: 98632 - DNA, 555 bp, Triticum aestivum
  unsure (1)..(555): unsure at all n locations
  Clone ID: PAT_TA_98632
acagcaacaacaaccacaattttcacagcaacagcagccaccatattcgcagcaacaacagccaccatattcgcagcaacaacaaccaccatttttgcagcaacagcaaccaccattttcgcagcaacagcaaccaccattttcgcagcaacaacaacaaccaccatttacacagcaacaacaaccaccgttttcacaacagccaccaatttcacagcagcagcagcagcaacaacaacaacaacaaccatttacacaacaacagcaaccaccgttttcacaacagccaccaatttcacaagcagcaacaaccaccattttcccagcaacaacaaccaccattttcacagcaacaacaaatactagtatcatccatctgttttgcagcagctaaaccatgcaaggtatcctccagcagcagtgcatccctgtggnatgcagcgatgtcttgctaagtcacaaatgtggagcagacattgcatgtgatgcacaacatgttgcngcaatgcggaaatcccgagatccgcatgagtcatccgtgtctgtcnatcaang

SEQ ID NO: 98633 - DNA, 573 bp, Triticum aestivum
  unsure (1)..(573): unsure at all n locations
  Clone ID: PAT_TA_98633
caacaacaaattcttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaaaaacaacagttggcaacaacaacaacaacaacaacagcaactgcaacaacaacaacaacaacaacaacaacaaccgtccgagcagtctccttcccaacagctcaagcagcatatccatccaagcagtctccttccaaccatctcaactaaaccacagctcaanggtctgtccaacctcaaacaacgccccattccccnggaataaggactancgctacagacgctactgcaatgtgcatgtctacatcctcancatgctcgacacaatgcgccaattgcaactcggtacaactgagaagagaagaactcatactagtaatgaacacgttt

SEQ ID NO: 98634 - DNA, 543 bp, Triticum aestivum
  unsure (1)..(543): unsure at all n locations
  Clone ID: PAT_TA_98634
tctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggctgtgctgcgacggcgtcaagaacctccataaccaggcgcgattccagagcgattcgccaaagcgcttgcaactgcctcaagggattgctcgtggatccacaatctcaacgangacaacgcccgcaacatcccccccaagtgcggtgtcaactcccatacacatcattctcaacatcgaacgcaacaaggtgtaatggggactttcgtcaactggngtcaactnacatcacttggatttaaaccccaactctatcctantatanggcacaattagcaanttatactgatataataagaatcctcactgcttgctggnnncctcggagga

SEQ ID NO: 98635 - DNA, 537 bp, Triticum aestivum
  unsure (1)..(537): unsure at all n locations
  Clone ID: PAT_TA_98635
accattgcctagagcttttagtctaaatcatcccatcctcaacattctttcatagccatgccctaactgcatttattgtccatagtttttagtctaaatcatcccccatatccaacattctttcatagccatggactagctacacaaaatgtccatgagttcctaagtttttgatcagtattgttcatctgttggagagtttgttgtgtgtgattaagggtgacaatcatggaactgggacatgtataaaatggtggcacangcgaacggcgangtcacgtaccaactgaccgacccgacgacatggggcgcgttgggcgcacgaagggcaccggntctgggggtccatgccaagaaaattccnggtatacnagtacaaggngcggatntgcccgcaaccgtacaaccatgacngganagctgccctaacgccaaaaaggacaaccgcgaagccgccgcnaccgggccgcttaatangtngcanctccngccggatacgttnaancnccgcgaagccantcgggtcccgggctgggn

SEQ ID NO: 98636 - DNA, 534 bp, Triticum aestivum
  unsure (1)..(534): unsure at all n locations
  Clone ID: PAT_TA_98636
actcttggctgaaattcatgccggtttcggtggccaccacaccgcggctcaggcccttgtaagtaaggccttccgtataggtttctatttgccgacggcccgagcagatgcacaggaccttgtccaacattgtgttggatgccagcttttcgccaacaaaagccatatgccacccaccgccctacaaacaatccccatcacttggccttttgcggtctggggcttgatatggtcggaccccttaaaggaggaagccataagaaaaaatatctgctggtcatggtagataattcactanatggatanagccaaacaattaccaatgatatacttcatatatggtgtcccgcacattatggtgtcccacacagancatcaaccgatnacggtccaatttcacagccgatnaggtgaaactggtgtgctaaccggggattaactcnataccctcntcataaccgcaaacaaacgnaagttgaacgagcaantgtctaatataacggataacctagacaatgcggccttaagaacaaa

SEQ ID NO: 98637 - DNA, 366 bp, Triticum aestivum
  unsure (1)..(366): unsure at all n locations
  Clone ID: PAT_TA_98637
gattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaattctttgcttttgggtatcaatgccgagaacaaccaagaggaactccttggcaggttccgaaagacaatgtngataagccaagatacctaatcaagtgcaagacttgcgttccctgggtcctgcaaaaatatttgagaacctaataaagaccaaagtganccctacttttgtggatctcaacctcagaa

SEQ ID NO: 98638 - DNA, 530 bp, Triticum aestivum
  unsure (1)..(530): unsure at all n locations
  Clone ID: PAT_TA_98638
tccgcctcctcccgggtcgcccccgctcgggcggctccgaaggctccccaaaccccagccaaaaagcaccccagtgctagagatctccggccgctgccgccgccgacctcggcagcggtggcggcgccctgcccgtcaaagacggagggctgagggcgggccagcggggcagggacgctcgtctcagtcgccggtcgcgtggaacggagctgcgcctagcggcgggaccctaggagcggtggggttccgtcggcatggaagacagctaaagcggaggggctgcggcaccaagaaactgggcggcggcgccctggattttgggcacgaagcggcgcatctgggcctgattgggcccgattttngctcaancgggcccgctcgtccaagatgccgaccgactttgccgctgctcngcaaggcacctccgcgcaagtgatggtgctgctgccttnangaacaaanttcnaagtggtggtgccttgggaaaagatnggcncaacttctgtggtgttgatctctgttgtaagccg

SEQ ID NO: 98639 - DNA, 462 bp, Triticum aestivum
  unsure (1)..(462): unsure at all n locations
  Clone ID: PAT_TA_98639
agaagaggacatggagcagcgtaactggcggagcagctgcaacgtcgagcggcctcagtgaaccaagagagtcgtggatgcagtgagagttgggtgtcgtgtccgattgagcggcaagccggaactgcaagttgttgaacatgtggtgctactgtgacttgtgataaagatcacgagttggctgcgcacatgcttgctggctggaaggantttgatcattacttngatggcctcaaaaatgggatacaggattctgttgggatcaaagaagccttaaaggcgaaccttacccactgcaatccgcaattgttggtgctttggtgggtgttcncattgcctggcaangtccaactcccccttgtggttnttggggttaacnggcaaagccccaacggaaaaatcctggncccccccancttgagtccanatcnaataaggggttccgacnatggggnanaaaac

SEQ ID NO: 98640 - DNA, 530 bp, Triticum aestivum
  unsure (1)..(530): unsure at all n locations
  Clone ID: PAT_TA_98640
ggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattgggtacaacaacaacaatttctaagggcagcaacaaccatttccaccacaacaaccatatccacagccgcaaccatttccatcaacaacaaccatatctgcagctgcaaccatttccggcaagcgcaactaccatattccgcaagcacaaccatttttggaccacaacaaccatatccacaaccgcaaccacatattcncaaccacacatccattttcnncagcaacaacagcagcaacaacaacaacaacaacaagaacaacaatacttcaacaattttgcaacaacaacgattccatgcaggtgtttgtattgcagcaacacaacatacgcatggaaattaaattttgcacaaattctnacaactgttgcaaaatgntt

SEQ ID NO: 98641 - DNA, 528 bp, Triticum aestivum
  unsure (1)..(528): unsure at all n locations
  Clone ID: PAT_TA_98641
tttgagctgagtaaaaaaagaataggtcgtgcgtgcggccgaggcgccgttcgtcggcgtggcgccgttcgtcggcgtggtgccgttcgtgcggcatggcgttcgtcgcctgaaaaatccagtgtgttgtactccttcttctacctctgttcgagcaggtgaaagagagagaggtccgtccgccgttccgtgccgccggagcctactcggcgttccgttgccggactgggttttgtcccaacaattgggtatcaagaccttgtccattccgctgatccgccgcgtncggcaaggaggccgcggaatcctgcatggtgngccggatccgcnaaaggcgccgaacggcccggcggcgtttgcggcctgcaacggcggatggatggcgtttgccccccggaacatattcttttttgngcatccatcaatttaaaacccccggnggccgtcatgtnaggcttcaaccntacaanacgacacttttttngnaaaattagggtttntcaatgggggaaaagacccacttncccc

SEQ ID NO: 98642 - DNA, 520 bp, Triticum aestivum
  unsure (1)..(520): unsure at all n locations
  Clone ID: PAT_TA_98642
cccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttngagaagcgccagcaaggaacttcactggactccgcacattnnagagcatttcaattggtggaaggctgctggctgattttctcctcncccttganaatnttggnaaacctaagggtaatccctggnanggcaaagactggattctacatnaggaactccaanaanaanaaggnanggtgcaaaacttaagctnaaaactctcatttactcnntggtttcctaaaatntgctccattcaagtttgcaaacatactgaaacatt

SEQ ID NO: 98643 - DNA, 523 bp, Triticum aestivum
  unsure (1)..(523): unsure at all n locations
  Clone ID: PAT_TA_98643
aacaacaacaacaacaaatcctacaacaaattttgcaacaacaactgattccatgcagggatgttgtattgcaacaacacaacatagcgcatggaagctcacaagttttgcaagaaagtacttaccagctggtgcaacaattgtgttgtcagcagctgtggcagatcccccgagcagtcgcggtgccaagccatccacaatgttgttcatgctattattctgcatcaacaacaccaccaccaccaacaacaacaacaacaacaacaacaacaaccgttttaccaatctcccttccnaacagctcaagcaacatatccatccaggccaagcttctttccaacatctcaaacaaaccaacagcccaggtctttccaacctcnacaactgcccattttttaggcaataaggcctacgctnaaaacctacctgcaatgtcaatgtgtaatccctccatattgcacattctccatttnnatcttccgtactaactgagaaanaagacctagtntaatatatgaaccnt

SEQ ID NO: 98644 - DNA, 537 bp, Triticum aestivum
  unsure (1)..(537): unsure at all n locations
  Clone ID: PAT_TA_98644
cgccgccgcgcctcctcctcgcccaaggtaggagcttgtgaaagttctctaaggctgagaagatggttctgaagaccgagctctgccgttttagcggccagaagatttaccctgggaagggtatcaggttcattccgttccggattccgcaggttttcctctttgccaactcaaaaatgcaagcgctactccacaaccgcctggaagcctgcaaagtttggctgggacagcaatgttacaaggaagcagcacaagaagacatcccatgcctgaagctgccaagaaagaggcgcccgcaccaccaagaagccntatcacgtccattgtttggtgccaccctggaatttatccannaagaaanaggctngagaacctgaanccccttnatgctgccccaaaactgtcncccttaaatttaaaggacgcatcnaagaaaccaaggatnanaanaaggcaaanaggaanngggaccattccaanatccaaaggggcaanggcccttcnaaaggttccaaggccnaaaattgnggtgggggg

SEQ ID NO: 98645 - DNA, 499 bp, Triticum aestivum
  unsure (1)..(499): unsure at all n locations
  Clone ID: PAT_TA_98645
cacaagaattcctcccacccccaccgtctcgccgccgccaccacagctagataagaaaaaaagagagagcagaactcgttgggagtgctcgagatggtcccggggagagggggaattcttgagatcggaatcggaacaagcggggcgcgctcgggatcggggttaccatacaatttttcccaaggaacctttaagtgaatgtgctaatggagtcaaaggggtggcaaaaanctagcagtagtagttccctggatgtacgaactcccctccggctacagcattgaagacttcgacctgctggaggcgccaagaantctctgctgcatactcnaacgcgcnaagaagcatcctgaanccgtttttgggacccttcccgtattaagattttaancatttatccngancctttctccaacaactctccnggctgctnaacnataacgacatttcnatctanncctcggtcctcccggtccgcttctgancaaacggaanatng

SEQ ID NO: 98646 - DNA, 509 bp, Triticum aestivum
  unsure (1)..(509): unsure at all n locations
  Clone ID: PAT_TA_98646
agatgcgaggccatccacaacgttgtgcacgccattattttgcaacaacaacaacaattggtacaagctacttccacccaacctcagcagcagcaacaacaaggtcaacaacaacaacagggtctgggttctagccagccacaacaacaaacacaactggattcagggttggattgcggtgatagggacatgggtgattcaagaccatccccggcaatgtgcgacgtgcatgttccaccatactgctacaccaccatatcaccatccnagtgactcactaaccgacatggggcggtactgagaagacgagagtcctanttcccgaaaaatggccacatgtttaatcnatggccnttccatgttaccggtgaaaataaattcaatcattacatgttttggctaactggcactanttcaactttggaataaaagcaaactattatttcaaaaaaggggcccgtaccattcccctanatgatcctttaccncctcaatggcttctttanacg

SEQ ID NO: 98647 - DNA, 497 bp, Triticum aestivum
  unsure (1)..(497): unsure at all n locations
  Clone ID: PAT_TA_98647
gtaatgctcatggccgtcgccttggtgctgatgctcgcggcggtcccgcgcgctgccgtggccatcgactgcggccacgttgacagcttggtgagaccctgcctgagctacgttcagggcggccccagcccgtctgggcagtgctgcggcggcgtccaagagcctccataaccaaggcgcaatccaagagcgattcgccaagccgcttgcaactgcctcaagggattcctcctggcatccacaatctcaacgangacaacgcccgcagctcgccccaaannccgtgtcaactccccatacacatcatctcgacatcgacngaacagtgtttatgacacattcgtcaagctgggtcaactcaccatcacgttggtttaacgcgcacctctancctagttataagggactaantatccatttatacggaatatgataagannctcctgctggctgctggtanccccggaggagataatacgtgtacnanaatgaaattg

SEQ ID NO: 98648 - DNA, 549 bp, Triticum aestivum
  unsure (1)..(549): unsure at all n locations
  Clone ID: PAT_TA_98648
ataggcgagaaaaggtccggtaatgttggccgcattaggattacccagcgggaagctacagctaaggttgatacaaacaaaacagggaacaatgagttcagtcaggatgaagacgtgaagaatgtaaagctaatcccaacaatccgtcaacaagcgaaagaatacttccaaacggcacgaacagcatcgaaagatgatttggacagcattcctcccaaactggancctgttgctccctccccatgttttggaagaagatacgaaaggggtgccgccaagaatttgcaagaccttgatgatgaataacaatgcacggcacaaatttccttccttgggactgttccctggggtgctgcacatttagtttatgatcctttagntccaaacaancccaatatttaccattccnttccgttganacttcccttggnggtgaacaatatntccgccaaantngagaatgggtttaaactaacaattgtgtgttacacaacaatgtcgtcggtttgcctggaagcnaaacnccgttgattaaggtgtcaatgtttn

SEQ ID NO: 98649 - DNA, 391 bp, Triticum aestivum
  unsure (1)..(391): unsure at all n locations
  Clone ID: PAT_TA_98649
atcaaatccaagtaagtattagttaacgcaaatccaccatgaagaccttactcatcctaacaatccttgcgatggcaacaaccatcgccaccgccaatatgcaagtcgaccccagcggccaagtacaatggncacaacaacaaccattcccccagccccaacaaccattctgccagcaaccacaacaaactattccccaaccccatcaaacattccaccatcaaccacaacaaacatttccccaaccccaacaaacatanccccatcaaccacanncaacaatttccccagacccaacaaccacaacancatttcccagccccaacaaacattcccccaacaacccaactacaatttcccaacaacccaacaacantcccccagcctcaga

SEQ ID NO: 98650 - DNA, 458 bp, Triticum aestivum
  unsure (1)..(458): unsure at all n locations
  Clone ID: PAT_TA_98650
ggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcaagcacaagaacatcaatttcacatcaaaagttgaacccatgcaaggatgcctcctacaacaatgtnacccatttgctgatangtcatcctcccgtcaaaagtnngtgcaacataacaactgcttggnaagtnggaacaaggtgtcnacaactaaaagcgtttcccaaacattcaagangcaaggcatccacaaagtttgtgcaccncattatttngcnacaacaacaacaattggnaaagtacttcaaccaactcaanannagcacaacaagngaanaanacaaaangnctgggt

SEQ ID NO: 98651 - DNA, 527 bp, Triticum aestivum
  unsure (1)..(527): unsure at all n locations
  Clone ID: PAT_TA_98651
gcgcaccctactccgcgaccaggcggcacccagcgcgtccgcccccactggccgctccgcctcgcaggcgacgggggacgaggccgcggctaaagtcgaattatcaaaaaggagttgtgtctcatgcaattcaaaggatttacaagccatgtcaagaagattctgctaaaacgttgctaagagcaggtggctgggtngggaggtgaaaaatgagggtggcattctgaaattgcacaaggcatggaaggtgaaaaacttgccaaaagggcttgattccttcaacttgttgctgctgttgcccaaggaagaaggcaccaccaaatnttcaacctggttgggtggganaatgtgaaaattaagtgtgncccacccaatcaatggtttaacaaanaagattcanccttgccgnaaagntnaatgacncaantaggaaacttttntgcaaaaaaaagtactgccaagaatantccctgaacaaaaanacctttganttgncaattgaaatccntcaaaacaggatctcantn

SEQ ID NO: 98652 - DNA, 304 bp, Triticum aestivum
  unsure (1)..(304): unsure at all n locations
  Clone ID: PAT_TA_98652
caangtcntgcatgtttntatccngattgtcaaagtcgtctcnaccaaatcaatnnntatcatctcatcgaaagattgggaccctctcctctatcaagtggtatcagttttcaggttctcggtgataattttcttacctattgtccatcgaaanagccacaattnanagttagatctattcatccttggtccaagcaaatctgagcctttgaaatttcctttccattgcttgaatcattttaantaaccgntttnaancgncctnttcatttnngggccttangtnccaattncctttaagttt

SEQ ID NO: 98653 - DNA, 252 bp, Triticum aestivum
  unsure (1)..(252): unsure at all n locations
  Clone ID: PAT_TA_98653
gtgctttcggcgtccccagctcacacgcacgcagagacaagaacactgccgctgccgctgcaccaaccgatcgccatcgatcccctccagccaccggaaagaaacaaaacaaaagctccacaatcgccggcgctttgtgccgcaagccttgtccttgctttccggccacagcaccggccagcaagcaatcaaatcccatcgccacacctccggctgatcgattaaactgctctgtccaanaaaaaaccggaa

SEQ ID NO: 98654 - DNA, 499 bp, Triticum aestivum
  unsure (1)..(499): unsure at all n locations
  Clone ID: PAT_TA_98654
gcgacaagtgccattgcacaaatggagaatagccacatccctggtttggagagaccatcatccatcgttcacacaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagcattatcccaagcaaccacaacaaacatttccccaacctcaacaaacattcccccatcanccacaacaacaagtccccaagcctcagcaaccacancaaccatttctcaagccccancaacattccccancanccacaacaaccattccccnagactcaacaacacancaacattcccaagnancacancaacattccccagntcacancccaacaccattcccaacaacacacaacattccccat

SEQ ID NO: 98655 - DNA, 330 bp, Triticum aestivum
  unsure (1)..(330): unsure at all n locations
  Clone ID: PAT_TA_98655
agcagccgagatgcagatcttcgtcaagaccctgacgggcaagaccatcacgctcgaggtcgagagcagcgacaccatcgacaatgtcaaggccaagatccaggacaaggaggggatcccgccggaccagcagcggctgatcttcgcggggaagcagctggaggacgggcgcacgctggccgactacaacatccagaaggagtcgacgctgcacctcgtgctccgcctgcgccgggggatcatcganccctcgtccaaggccctcgcccgcaagttcaaccaggngaagatgattctgccgcaaagtgctacgccaagnntgntcaaagg

SEQ ID NO: 98656 - DNA, 501 bp, Triticum aestivum
  unsure (1)..(501): unsure at all n locations
  Clone ID: PAT_TA_98656
catcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggcccggcccgtctgggcagtgctgcgacggcgtcaagaacctccataaccaggcgcgattccagagcgatcgccaaaagcgcttgcaactgcctcaaggggatcgctcnttggatccacatctcaaacgaggacaacgcccgcagcatccccccaaatgcggtgtcaacctcccatacacatcagtctcaaatcaatgcanaaggtgtaatggcgacnattcgtcaactggggctcaactcatcatccagttgagtgnaacgccaacctcancctatgtntatgncncaattntcaagttanactaatataaaaaa

SEQ ID NO: 98657 - DNA, 506 bp, Triticum aestivum
  unsure (1)..(506): unsure at all n locations
  Clone ID: PAT_TA_98657
cacacactactgtcctacaaagttggaattgcagaagaagcgaaattgttcaagaggaagttatgccagcaaagagaaattccctaatgtctttgcatggacaagcaatagacacgattaacatacagaaccaccagcttgcattgcaaaatgatggatatgatgagaaatcatgcttttgtataaagttgctaccgcggaaagagcgcgttggacgaaagtcagcccggataactaaaggcagaatgacacatcaactatctgcattgaggtttttgaaaacaagatgttctagttgccggtatatcaagccatatcaagtgcatgcgacaagggacttccgccctcaagtatattgccaagagtacaaacaagacaaattgtcatcacaaacttaacagttnagtacattcatttgctatacttgcaacgcttaatcaatctaaataanatgtaacgcgntaanattggttttgtgacnanataaggttcaaagcncgctgggn

SEQ ID NO: 98658 - DNA, 302 bp, Triticum aestivum
  unsure (1)..(302): unsure at all n locations
  Clone ID: PAT_TA_98658
gaaacccatagaaaatggtgaaaagtagaaaataatcttgttttagaaatccgggtgattggccctctcggtggatggatcatgtttagagcatgatggagccgtagcaactggcatggttttgcgccatggccatggttctatcatctttgcagcctatcgagtaatcttcaattgcaatgaagcgctanaaggttaaagtacatccattatncaanggattgnaactnggcaatccaaaattnaggtttgccgnccttggccaanccgntnaatcaangggcctttaatccgnccaattg

SEQ ID NO: 98659 - DNA, 499 bp, Triticum aestivum
  unsure (1)..(499): unsure at all n locations
  Clone ID: PAT_TA_98659
ctcatctctccacccaatcatcactagctaatacggtgcactgttanctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgattccanagcgatngccaaaagcgcttgcaactgcctcaaaggggatngctccgttggatccacaatctcaaannaggacaacgnccgcaagcatccccccaagtgcggggtcaactccatacacaatantctcaacantactgcanaaggttaatgggcnacattcgtcanctggnctcaactaancatcaccntggnttttancngcaactctatccnngtatangggcatatttt

SEQ ID NO: 98660 - DNA, 361 bp, Triticum aestivum
  unsure (1)..(361): unsure at all n locations
  Clone ID: PAT_TA_98660
ccacaacaaccattcccccagcantcccaacaatcacaacaaccttttcccgggccccaacaattatttcctgaactccaacacccaattccccannaaccacaanaaccattccccctgnaaccgcaanaaccattcccccagcaatcncaacaaccattcccccagcaaccacatcaacnattccccctgcagccgcaanaaccattcccccancaancacancanccattcccccaanaancacaacaacctttcnccctacnncnacaacaaccattccccctaccaccgcaacaancattttccnagcaactccannaatcacangcntcatttncccagccccaancccaggaac

SEQ ID NO: 98661 - DNA, 487 bp, Triticum aestivum
  unsure (1)..(487): unsure at all n locations
  Clone ID: PAT_TA_98661
tcgagttttttttttttttttttttatgacatattcacaagagccatgacagtctacaggaatattcttttacaaaactacccattcatgagcatgtatgtagtcaattctgatattttatcaataaattaattgtcataatcaaaattgtttgctgcatgcagtggtcatattcctttgtgaaaccattagggtattttttttcttctctgaactatttggcaatgccactgttttctatgttgctttcactatttccagcagtagatataatcccaaacataacttggttctacggtttcantactcacaagtttactcaagcacagctgatttgacnaaactaanttcnaaatgctttgttcagctncaacaggcaacattatcacatgtccnactttgggggtgcaatcctgagcctcatttggccctttggccaatntctaaaaanggaacaagggttccggctanaccaagaancctggga

SEQ ID NO: 98662 - DNA, 502 bp, Triticum aestivum
  unsure (1)..(502): unsure at all n locations
  Clone ID: PAT_TA_98662
actagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcaagcaacaacaactagttctaccgcaacaaccaccattttcacaagcaacaacaaccagttttacctccacaacaatcacttttccacaacaacancaacacaacagctgggtnaacaacaaatccctgttgtcaagccatccattttgcaacagcnaaacccancnagctatccncaacaagcaatgcagcccgtgggnaatgcan

SEQ ID NO: 98663 - DNA, 407 bp, Triticum aestivum
  unsure (1)..(407): unsure at all n locations
  Clone ID: PAT_TA_98663
agcaatcccgctatgaggcaatccgtgctatcatcttctccatcatcctacaagaacaacaacagggttttgtccaacctcaacagcaattcccccaacaacaacagttcccccaacaacaacaattaacgcaacaacaattcccccggccacaacaatcccctgaacaacaacaattcccccaacaacaattcccccagcaaccaccacaacaattcccccaacaacaatttccaataccatacccacnccagcantcacaagaaccttccccataccaacantatccacaacancanccatctgggaagcnacattacaantatcantggcctatnaaatgaatagatgttatactngncgggtnatcatccgttgttagtcaatggngcataatgtnaaccatg

SEQ ID NO: 98664 - DNA, 381 bp, Triticum aestivum
  unsure (1)..(381): unsure at all n locations
  Clone ID: PAT_TA_98664
ggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcaaccatttcngcagccgcaactaccatattcgcagccacaaccatttcgaccanancaaccatatcacanccgcaccacaatattcgcanccacaacatccatttaacagccagcaacagcagaacca

SEQ ID NO: 98665 - DNA, 498 bp, Triticum aestivum
  unsure (1)..(498): unsure at all n locations
  Clone ID: PAT_TA_98665
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggcctcctcaagcaagtcgactanctgattcgcccaagtgggtgcctgcctccnagttcagcaanggttgggttnacttccgtgagcacaaacgcatctcctgggtactacatggccgtattngcaatgtggnaactgcctatttcnggtgcactgacccacaaagtgatnaacaagtggaggagtcaanaanggntaccctgaccntanttcgcatcatcggattcnnnacatgctnaagtgaatgngtcagntcaacncn

SEQ ID NO: 98666 - DNA, 339 bp, Triticum aestivum
  unsure (1)..(339): unsure at all n locations
  Clone ID: PAT_TA_98666
tctcatccttgcactccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcaggcatttccgcagccgcaactaccatttcggannccgcatntacaanntccgangccngnaacaatttcnaccaacancaaccaatttcaacaccgcnaccancngttttccca

SEQ ID NO: 98667 - DNA, 441 bp, Triticum aestivum
  unsure (1)..(441): unsure at all n locations
  Clone ID: PAT_TA_98667
atccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcgggngacttcncaaagggcaacggnaccggnggggagtcatctnnggcgaaaagttcnccgancaaaaatttcntccacaagcnaaacaancccggggatttcccaatggcnaacncgggcccaaaaacnaagggtcccaattttaatttgaacgtnccct

SEQ ID NO: 98668 - DNA, 497 bp, Triticum aestivum
  unsure (1)..(497): unsure at all n locations
  Clone ID: PAT_TA_98668
acctcaacaatcattttcccatcaacaacaaccatttccacagcaaccatatccacaacaaccatatccatcacaacaaccatatccatcgcaacaaccatttcccacaccccaaccacaatttccccagcaatcacaacaaccatttccccagccccaacaaccgatccccctacaaccacaacaaccattcccccagcaaccccaacaaccacaacaaccttttccacagccgcaacaaccatttccctgggcaaccacaacaaccatttcccaagacccaacaatctttccctctgcaaccacancaaccattcccccangcaaccccaacaaccattttccaagcccnaactacaattcccccagcaaccaagacaaataatccccaagaaccccaancaaccatcctccctggaatcncaacaacaatcccccannaacccaacaacattttncnagcccaacacgattccatncacannacaccatccctg

SEQ ID NO: 98669 - DNA, 402 bp, Triticum aestivum
  unsure (1)..(402): unsure at all n locations
  Clone ID: PAT_TA_98669
tgctctttcctttccaactagtgctgccatctcttggcccggcgatggttgctcctgcttttgcctgggcatgaagagcacgacgaggaggcgtcggcggctgcttcttgccagagtgacagcgctggcgatcaacacggcctagccgacccagctgacgacgaaaggcgccggacgtgactccgaaggacgcccacgcaagtcaacaccaggccggcatgggtgaagttgctggcaacggtgggcgccgtcgcaagaattcgacccccagcaagcggnntcctccgggcccaagtcgtcgtaataatcgtcatcttcnncgtcctnggnaaaggttccttctgccgccggaacncaaggttgttaaatcaaacccatccatctaacctnaaaaaaaaaaaa

SEQ ID NO: 98670 - DNA, 490 bp, Triticum aestivum
  unsure (1)..(490): unsure at all n locations
  Clone ID: PAT_TA_98670
ggcgagatggctcctccccgcacggtgatctgcgtgggtgacgtccacggctacatctccaagctggagagcctgtgggcgaacctccagtccgcgctccccgccgacgccttcgccgccgcgctcgtcatcttcctcggggactacaacgaccgcggcccgcacacccgccgcgtcctccgactcctcctcgcgctcccggcccgccacccggtcaacgccacgtcttcctctgcggcaaccacgactcgccttccgccgcctttcgtccggagcgctgccgccgcccccgacggtcccctttncgccgcaacttgggccaataatcnaatnacgaagccaagaaggctggtcccnccgggccngggacnaagatatcactnncaaggggaagganattggggcnggntcatcaaggaaagtnggacccaanaaggctcccttnnaaggttctatcnannatcgcaaccacttncatcctaaggttncn

SEQ ID NO: 98671 - DNA, 488 bp, Triticum aestivum
  unsure (1)..(488): unsure at all n locations
  Clone ID: PAT_TA_98671
ccctcagactcaacaaccacaacaaccatttccccagcaaccacaacaaccatttccccaaccccaacaagtagtacaaataaatccccagcaaccccaacaaccattttcccagtcacgacaaccatttccccagcaaccccaacaaccattcccactgcaaccgcaacaaccatttccccagcaatcagcacaaataattcctcagcaaccccaacaaccattccctctacaaccacaacaatcattccttcggcaatcacaacaaccgttcctccaacaaccacaacaaccatctccccaaccccaacaagttagtacaataattccccaagcaaccccaacaacattccctcctgctggcaaacaaccntaagaaacttttcacacanaacntcaggattaatggtataaggatcnggggcaanggaatgaatagcatagtctaacccggngtnatcnttgtttagncatngaatgtcaatgtt

SEQ ID NO: 98672 - DNA, 450 bp, Triticum aestivum
  unsure (1)..(450): unsure at all n locations
  Clone ID: PAT_TA_98672
agagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaatatccggaagctggtgaaggatggtttcatcatcaaggaagcctcagaagatccactccaggtctcgtgcaaggagggcacatgaggccaagcagaaggccgtcactctggtatggtanncgtagggtacaagggaagctagttcccancaagatctngttgnttcggagatccttncctaaggcctttncgccatnccntttagncaaaaaatttacaacaattttcatncatttccttaaggcaaggacatttnaanaaaanggcccanggattccnnattcaagntanaagganaanaacccccttacanttt

SEQ ID NO: 98673 - DNA, 446 bp, Triticum aestivum
  unsure (1)..(446): unsure at all n locations
  Clone ID: PAT_TA_98673
aggagacctggctcgatggttgttgttgttgtttttgttgttgacgcagaataatagcatgaacaacattgtggatggcctggcactgcgactgctcagggatctgccataggtgctgacaacacaattcttgcaacagctgggtaagtactttgttgcaaaacttgtgatcttccatgcgctatgttgtgttgctgcaatacaacatccatgcatggaatcattgttggttgcaaaattggttgaanattgttgtcctggtgtgttgttgttgttgctgctgctgctgctgtgaattggatgttgtggnttccaaaatgttggttgcggttggtngaaatggttgttgttgnccnaatggttgtngctgccnaatatggaantttccgctgccggaatggttgcaactgcaanangttgtngtgaatggaaangttccgctgttg

SEQ ID NO: 98674 - DNA, 461 bp, Triticum aestivum
  unsure (1)..(461): unsure at all n locations
  Clone ID: PAT_TA_98674
attctgctctgctcctccctccccctgcatctcccgccngcntngcccgaccctctctngcnncccttccnagccgccggtgatggngangctganatgcaccaaccacacactcctcagctcgccgacctgcctcgcgcncncgcgccgggccgtggngcgcgccnccgtcgccgtccangccgaggcgcagcccaaggtctccctcatccgagattgacacgcgcggnantctcttgctcttgcanaaacccgtaaaaccnttgacgaactgaaagtgcacanacgganttanccaagatggcnattggaattnccaccttaagccnaaaggnaaaattttttggaaaccccnggtnggaaaaagnaggcaagggtnntaccaagggantncaatcccnttggagggaacttgaatnnattcaacnnagnaaagttccnnaatntccaaaaggaatttt

SEQ ID NO: 98675 - DNA, 475 bp, Triticum aestivum
  unsure (1)..(475): unsure at all n locations
  Clone ID: PAT_TA_98675
gtaacttcgtgttcaagcaaaacatacatagggttttgtttaaaaatatacgtgcctttaaaatcatgagtgctttggcccatacacatagtagaatacaaagaggcctggggactacatatcaactcctatattgctcttaaaacaaaacaaaaaaacctaaaaaaataaaatgatcgggtttaaagcctgaaagagaaggtaccactacatttcttaagagcacgaattgctgggtacaaattatgttgcaaatgcaagatgcctaaatacatttatatagggaatgacttgcctncaaaaactgaatntcaatagtggaccatgaaaaggagagtgggaagaatccaaagaaaatacgcctccaagagttanccttccnccaagtnaaaagaacagcatcattgtcccntaangaaaacagttcacttgttgaaaagatcatgcatgtaaagaccnagatttancttggtng

SEQ ID NO: 98676 - DNA, 157 bp, Triticum aestivum
  unsure (1)..(157): unsure at all n locations
  Clone ID: PAT_TA_98676
cccgtgctcacgtccggcgatcgccgcggcggcaaccccaactcgccaccccgtttgtgacgcggatgcggcgccgccataggatgacgccggagacgggaagcatcctcccgcctcatctcctccgcgggctccagccccctcgagcannctccgg

SEQ ID NO: 98677 - DNA, 485 bp, Triticum aestivum
  unsure (1)..(485): unsure at all n locations
  Clone ID: PAT_TA_98677
ctctcctatcgctcgatctcgctcggtcctctcgttcgccgcccgccaccgtccccagccgccctgctccgttgttgctccctccgcctgcctcgcccctgatcccccaagcgagcctccgtcctcctctccaaccccgacctccactccaccgcgcaccgccggcgacgactcctctcccaggccgtggatccacccgagcagccgaggcagcggtcagatccgcccgccctccttcactccctattagcgctggaaaccctagccacccgaccatgccgaacgaccgcaggcacgaagaatctgctgtccanggacgccgcccgcnaccgccgccgccgcgatcccccgangacgccgccgccacgccgnggttcccaagggntggncctttgccctgattggaggaacngtgctgcctccttgttnggaggacnaaacaggaaatggaaggangatgaacaantaaaaatattnaagggggg

SEQ ID NO: 98678 - DNA, 478 bp, Triticum aestivum
  unsure (1)..(478): unsure at all n locations
  Clone ID: PAT_TA_98678
tcgagccctccgccgccgccgcgccttcagctctctccttccttcaccgattcaagatgaagttcatcgctgcctatctgcttgcttacctctctggcaacgccagcccctctgcagaggacctgacatccattcttgagtcagttggttgtgaaatcgacaatgagaagatggaactcatgctgtcccaagtgaagggcaaggacatcactgagctcttgggctgctgggtagggagaatttgctgcggtacatctggtgggtggtggtgttngctgtttcaagccgctgctccctgctgctgggtggtgctgctgcccctgcagctgagtcaaaagaaagaaagaagccnttgganaaaggaanaaaatgattgatacatggcttnatccggttccacnatncctgggnacttgttctgcatatcnaccttgggcaangaaactaaatccatgatgtttaaccttattaacnagtt

SEQ ID NO: 98679 - DNA, 290 bp, Triticum aestivum
  unsure (1)..(290): unsure at all n locations
  Clone ID: PAT_TA_98679
ccccgctccgctaaacctcgcaacaacccccgtgggcgaccancccagcccagccgcccccctctcctcaccaacccccgagccggaagcagagccgcnatggccggcaccgtgcccaagctcgccgccccnnggccggcggccgcggggncgctcccctcgcancccctcngcnccgccgcgctcgccttcgccccntccgcccgacgcttcctcntctcnatcgccntgtcgcnccagtagccccgtcattgcgatggcttccgcnacgggngggaanngtgcggtga

SEQ ID NO: 98680 - DNA, 273 bp, Triticum aestivum
  Clone ID: PAT_TA_98680
gtagcgttggtttttagccctcgctacaactaagtggtgccatagtagtagcgagggggtaaaaaaccgcgctactactaaaggtcccattttcaaactctaccccccccccccgtggatcgccttttcagttttaaaaaaaataaaagaaaatgatgaaaatgtcgaaaaaataaaagaaaataagtttcccatgtgatatgtggtctagttgttgggaaaatttgcaaatatgaattcgactttatttgcaaatctctccgaggggggggc

SEQ ID NO: 98681 - DNA, 475 bp, Triticum aestivum
  unsure (1)..(475): unsure at all n locations
  Clone ID: PAT_TA_98681
ttcctccgccgccgcgactagagtttcctcgctagggtttcgtctcccggtccggatccagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcactccaagccaagccgccgatggggctgccgccgggagccggagccgggagctcggacccgccccgccgccccggccgaggactcnaagaactgggacccnattcctcaaggtcaacaagcaacctcttcactcatctgnngccaactactgaaataaaggntgctggcctgacttgcaaaatgttctgnatga

SEQ ID NO: 98682 - DNA, 460 bp, Triticum aestivum
  unsure (1)..(460): unsure at all n locations
  Clone ID: PAT_TA_98682
cccaagcaaaacttctccgcggggcacggaggaggcggccatgcaccggcgacgaggtgggccgactgagatatcaatcagatagggagggggtgccgctcggcgtgagactcctcgtcggcgccgaggcgcagccagcgccatccctccaagtttggctggggacgctgcggccttcctcgcttgccggttcgcctgctcgggactctgtcctagctggagttgcggcgaaagancaaggccagcatctgcgcggaggaacgccaccggaccatccatgggacgaccacgncggagatggggccgggctgctcttccttgccggagatncttgcnagacggagacnaggcaggcggcggcgccgaaggactccagcggtcccaacatcggaccacccaagcatttttgctccccgacatgtcacgaacgcaacttccccgctcccgcccgggggctttg

SEQ ID NO: 98683 - DNA, 539 bp, Triticum aestivum
  unsure (1)..(539): unsure at all n locations
  Clone ID: PAT_TA_98683
aggacaacaaccatatccgcagccgcaactatttccacagccgcaactaccatattcgcagccacaaccatttcgaccacaacaaccatatccacaaccgcaaccacagtattcgcaaccacaagaaccaatttcacagcagcagcaacaacaacaacaacaacaacaaatccttcaacaaattttgcaacaacaactgattccatgcatggatgttgtattgcagcaacacaacatagcgcatggaagatcacaagttttgcaacaaagtacttaccagctattgcaagaattgtgttgtcagcacctatggcagtccctgagcagtcgcagtgccaggccatccaaaatgttgttcatgctattattctgcatcaacaacaaaaacaacaacaacaaccatcgagccangtctcctttcaaacagcctctgcaacaatatccattaggccangctccttccgggcatctcaagcaaaaccacaggacaagctctgtcaagcctcaacaacgcccagttcgaggaaataaggactanc

SEQ ID NO: 98684 - DNA, 554 bp, Triticum aestivum
  unsure (1)..(554): unsure at all n locations
  Clone ID: PAT_TA_98684
cgcacctgcaggtggtgcgccattagtaattttgcagaaaagtaaaaaaaaattatattaatggcacacttttacagggtgcgccattagtagtttaaaatagtaatggtgcactgtgaggcggtgcgccattagtagttttgcaaaaaaaagaataaaaaaatgcagtactggcgcactccctgtctggtgcgccattactagttagaactagtaatggtgcacttcggtaggatgcgccattagtatgtatgtaaaaatgaaaaaaaattatcactaagtggcgcacctattttctggtgcgccattagtgtcttccacactaatggcgcatcaccaactggtgcgccattagtatatatatagtagtggcgcactacttacctgggtgcgccattagtgtcaatcctatctatagcccttttcctagtagtggtacaagccttttaacangctttgaggtaattaaagaatgttcaaataatgttaccgcatagacataaccctgagcctgttggggcgttcgggaagaaaagcgaatagaggtcaaagat

SEQ ID NO: 98685 - DNA, 470 bp, Triticum aestivum
  unsure (1)..(470): unsure at all n locations
  Clone ID: PAT_TA_98685
gcacaagcagaaaatcaaagtacgtagtagttaacgcanatccaccatgaagaccttactcatcctgacaatccttgngatggcaataaccatcggcaccgccaatanccaggtcgaccctagcggncaagtacaatggctacancaacaactagtcccccagctccaacagccattatcccagcaancacaanagacatttccccaacctcaacanacattcccccatcaaccacancaataagttccccagcctcagcaancacnacaaccatttctcnaggcccaacaagcattcncncagganccataanaaccattcccccagantcannaaccacnacangcatttcnccagcaancacancanccntttcccagnctcagcagtcacancangcggncatttccacatgancactntttnngcactancgccaactatttccncagcaancatnagtttcgca

SEQ ID NO: 98686 - DNA, 484 bp, Triticum aestivum
  unsure (1)..(484): unsure at all n locations
  Clone ID: PAT_TA_98686
gaagttgctccccacttctccctattctctcaacatgcagcccgtccacatcatcatctagccatgtcagcaattcttttgattttcctcgcctatttcaccttaactatcgcgagcataagtgcaacaaatagttagcaaaaaactgaacgcaagcgtccatgcgtcccttgcttgccatgcataataaacggtaatcaaaacttgcatgcgttggttctctgtccatccacctctcgatatttcaatggggcggctcggtggccagatttgcgttcaactcccgcactccgtcccgttcgttggtccacttccttgatcctcggtccaaaaaacgctagcacaacatagccgctaatcatggcagtgctagggtcaaccgacgaatccggggaaatatcggtgcagcctcgtcgttccccaagnctaaatagtcacgcaactctcncttgatgacacaantcgccggtttgnttcaaanaag

SEQ ID NO: 98687 - DNA, 492 bp, Triticum aestivum
  unsure (1)..(492): unsure at all n locations
  Clone ID: PAT_TA_98687
gccctcctcgctcttgcggcggcaagtgccgttgcgcaaatttcacagcaacaacaagcaccgccattttcgcaacaacaacaattcccccaacagcaattcccgcaacaacaatttccccaacaacaacaattcccacaacaacaacagttcccccaacaacaacaattcccccatccacaacaattcccccaacaacaacagttcccccaacaacaacaattcccccaacaacaattcccccagcaaccacaacaacaattcccccaacaacaatttcccataccatacccaccccaacaacaatcacaagaagcttccccatacaacataacacaacaacaactatccgggaaccangttttagtttcantgggccattaaatngaagagtgntatactagacnngggaaccaccntggtannccatggggcacanagtgtaccgggtanattaagggntgtgccccacntgtgnnccccgcnctgtaa

SEQ ID NO: 98688 - DNA, 395 bp, Triticum aestivum
  unsure (1)..(395): unsure at all n locations
  Clone ID: PAT_TA_98688
gttcccctctcctccctcccctgctccctcctctgttcctccgccccctcaccgcanccgtcgctcgcccccantccagaaaancccnagctanctagacncaccccanccatggtgancatccccananncggctccgcctccctccgcangggccccgctgccctccagagggaccggaggtcanccattgtcgtcggtaggcggccatgccgctccccgggcgccgcgcgcgctcggtgtcggtggtgcncgcctccnccaaggacatcnccttcgancangnctcgcnctncgccctncatgcngcgtttaaaagctcgccnncgccgtcggggtcanctttnnctccnacangaacgantgnncttttggnnccgttntgnatcnccata

SEQ ID NO: 98689 - DNA, 467 bp, Triticum aestivum
  unsure (1)..(467): unsure at all n locations
  Clone ID: PAT_TA_98689
aacaacagatccttcaacaaattttgcaacaacaactgattccatgcagggatgttgtattgcaacaacacagcatagcgtatggaagctcacaagttttgcaacaaagtacttaccagctggtgcaacaattgtgttgtcagcagctgtggcagatccccgagcagtcgcggtgccaagccatccacaatgttgttcatgctattattctgcatcaacagcaacaacaacaacaacaacaacaacaaaaacaaccattggagccangctcctttccaacaagctcaaacaacatttcaatcaaggccaagggtccttccaagcaatctcaaggnaaaccaanaggccaagggtctntcaancntcaaaantngcccaattttngggaatagggccctagcctnaanaccnccggaaaggtgaaggncaatccccccnaattggccaatgcccaatggactttcggg

SEQ ID NO: 98690 - DNA, 450 bp, Triticum aestivum
  unsure (1)..(450): unsure at all n locations
  Clone ID: PAT_TA_98690
aaaacatgacctacaactgattgatggtgcatcaataatagtcagcaaagacttgcagaactgtcacacattcaccagtcgcatctatggcaattgtggagcagtggacttcaccgcatcacgccttgaaaatgcagttgaggcgactctagaagttgtcatcttagaagtgcaaaacagtttcaatttgtgtctcagctgttttaccagtgggttgaatgaagaaatccggctcttcaatggcaccattggtgagtcatgtggcttaaagaggctgtggttgctgtagttatagcttcttgggatgacgttgaantcaattggggtgcggancaccagttctgctgaacacatgtccttcatagccaacaaccatgggattttacncaaaagatgaagacggactttgcgcaancncaatgaaggggacttgggccacttgccccnggg

SEQ ID NO: 98691 - DNA, 505 bp, Triticum aestivum
  unsure (1)..(505): unsure at all n locations
  Clone ID: PAT_TA_98691
gtgaaattaaaggaaggcgatccccagtccgatccctccaatccccacttccatccaccctcaaagccgcgagctttccctcgcccgtgctccagggcgcgtggtttccggatggctttggagctgcggctggcgccggcgggcngggaggaggagaggngcctgtccgaggaggacgagctgctgttccaggacatcncgagggaggtggggnggctgagcctccgcgagcccgaggttgaggcccaggggcngcgccagggcgacgcggccgcggttgacggactcctccctcttcanggcggttcctgaacaccctaagcaacangggggcctgtaaccngcctcccttaaccatgaacganggttctgtcgactcgtggtgcaaggaagccggnccggtgccgtcnacgttctcgccgacnacgacgggggtaccggnggncgtanggtggtccangaaaggacntccggggatatctcgncgtggtngaccccngcnaca

SEQ ID NO: 98692 - DNA, 527 bp, Triticum aestivum
  unsure (1)..(527): unsure at all n locations
  Clone ID: PAT_TA_98692
gatagaactacccccatacaacttattctaacaattcgagctaatctactcacctagtgtgactcttaaaatagattttcatcttgcattataaataaaatcgttattatgctcgtacaataagttcaagtgtaaaaaataaaatggaaacactaaaaatccaacgtcagatttttaggtatgacaaatcgaaagtttttcataaaatattatattgggtgtgatgatgataaatttaagtgtgcaagcatgacatttttctggacaaaaactggaactaagacggatttgccatgctcgtcaagtaaacttgccatcctaaaagaacataattttcatgaagaaacgttccgattgccgtggnnaaaaaccccgacatcagatatatagtgggagccgaataaaatagcctcaagggacctaaacgtagatatgcgcaaaaaacaangaaaagaatatataanncaaanaaaanaaaaagggggggcccggtaccattcgcctatagtgancgtattacgcgcgcc

SEQ ID NO: 98693 - DNA, 528 bp, Triticum aestivum
  unsure (1)..(528): unsure at all n locations
  Clone ID: PAT_TA_98693
cgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttggggccaatgtgtttcccaaccccaacagcagtcacaacaacaactcgggcaacaacctcaacaacaacaattgggcacaaggtactttttgcagcacaccagatagctcagcttgaggtgatgacttccattgcgctccgtacctgccaacgatgtgccgtgtcaatgtgccgttggatagaacaccactaatgtgcatcggtgn

SEQ ID NO: 98694 - DNA, 522 bp, Triticum aestivum
  unsure (1)..(522): unsure at all n locations
  Clone ID: PAT_TA_98694
atcaccggttttgcagatccaaagaaaaagcgtgcaatccttctcaatgacgatgcagaggttccgatccttggtctgaccaatcttaaattttgggtataccactctcaagggcggaggcagatcaattcgagagaactgaaaggtgtctgtgttgagcaccaaaatgtactcgctgagagatacctcgttcagggacacgaattcccaacagataaacccatccaccaccgtgctggctgcgtgcctgggagccctcgggcagcggcgtcgcggtctccgggaacatctgccactccatggtgtcggatgagaggacggcgacgcgtacccaagcccacgagtatccgtgacggacatagaccacacgggacggctctgatctctttcgggagagagtatgtgggattcaagggactgcccgttaggatgtcntggcctccttggggcggagaacaaggcaactgtttggggattgtacaaaactgctgcttgggtggccggtttcnatcaaatgaaccg

SEQ ID NO: 98695 - DNA, 518 bp, Triticum aestivum
  unsure (1)..(518): unsure at all n locations
  Clone ID: PAT_TA_98695
gcatctgatcgaatctattatggataaattgtaggaatccaacacttttctcctagtagaagaaatataagtgctattttagctgcacatagagtctatgctgcgtttaatgtcattcgcaatgttcttagcatccatggcaataccggccaatccccttctccctaacccggcacaatagagcccatttgcccctttccaatgattagggaattgcttcttgggcacgccgtcgctattaagcatgtcctcatcattcttggagccacaaatttgttgtgcttttgtatccggttgcaaacacaatgggcgtcaaaggaggctccttcccaccttcaaattcaattgtcctcctttgatcttaataaccttccatgaacttaatttgccttccttgataaccctatggngccaacatcaacactggggatnngcatttccgagtttaagggcaaatggaccttttctggccngtgntnccangctanagagcccccnntcngatttncannacaaan

SEQ ID NO: 98696 - DNA, 520 bp, Triticum aestivum
  unsure (1)..(520): unsure at all n locations
  Clone ID: PAT_TA_98696
cagcaacaacaaccaccattttcacaacaacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagtctaccgcaacaacaaataccatttgttcatccatctatcttgcagcagctaaacccatgcaaggtattcctccaagcaagcaatgcagcctgtggcaatgccacaaagcttgctaggtcgcaaatgttgcagcagagcattgccatgtgatgcaacaacaatgttgccagcantggccgcaancccccagcatcccgctatgaagnatccgtgctatcatctatccatcatcctggcaagaacaacaacaggtcaagggtccatccaaancctcaacagcaacc

SEQ ID NO: 98697 - DNA, 522 bp, Triticum aestivum
  unsure (1)..(522): unsure at all n locations
  Clone ID: PAT_TA_98697
ctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaagggggagctccggcgggttcgagatggccgggcggggagaccggcggctgcgactgcaccacctgcaagtgcggcaccgcgtgcggctgctcctgctgcagctgcaactgagccggcgcacaaggaggccggccgggcanaaggcnacacgaaggatgaggaaggaagaacaagnaatcatcatcaacaacaacaacaacccaagcgtacaattacaactaaccgccgcatgcgctcgcgcgcgcgctaaataaataaacctcatgtgttccttaattcngtacacatgtcctcctcaatctccaattctaaaggann

SEQ ID NO: 98698 - DNA, 246 bp, Triticum aestivum
  Clone ID: PAT_TA_98698
cactaacctaacatctaatgcactaacctaaatcagagaatgttcaaataaagtagtattgcttggttttttaaaagaaatgtccaaatagaaaatttagtcaaaaagtaaaggttttgcctaatgcattcttcacatagaaaaaatacatatacataattactagtatctatacatggaaaaatacataataatctgcgtgactatacataattactaagtatatatacatggaaaaaaaaaaaa

SEQ ID NO: 98699 - DNA, 260 bp, Triticum aestivum
  Clone ID: PAT_TA_98699
ctagtctcgagtttttttttttttttttgaatttatattttatacatttatttatctcggtcaaaatccatgtcaacaaagaaatgcaacacatcacgggagaattttgagccgggagggctgaagccccggtccatatgatcagtaaagactattaattcaccttctttgggctcaggaggagtttcggtgcctggaaccctccaatggatgacatatttttttggataaaacgccagtgtgaaagggggggcccggta

SEQ ID NO: 98700 - DNA, 547 bp, Triticum aestivum
  unsure (1)..(547): unsure at all n locations
  Clone ID: PAT_TA_98700
ccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagtgtcgcgcattccatcatcatgcaacaagaacaacaacaaggcgtgccgttcctgcggccactatttcaagctccgcccagggtctggggtatcatccaacctcaaacaaccagtcaattgggagggtncaggccattgggattggaaaaccctcccaaccatgtgcaacgtgtatgtgccacctggacgctcccacatcaaacataccatatgccaacatagacctgggattgggtgggcaatggaaaangcaantnatcgttgcttaactgatgcacaaccgttggtacgatgacaaataaanggggtgcacatcang

SEQ ID NO: 98701 - DNA, 535 bp, Triticum aestivum
  unsure (1)..(535): unsure at all n locations
  Clone ID: PAT_TA_98701
cacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccaagcaacaacaaccattgattcagccatacctacaacaacagatgaacccctgcaagaattacctcttgcagcaatgcaacctgtgtcattggtgtcatccctcggtgtcaatgatcttgccacgaagtggattgcaanggtgatgcggcaacatgttggccaacaactagcacaggattctcaagcaagtccagtgcgcagcatcaangggtctgcattcatcatcaaggaagcangacancacacacaacaacaacacaggng

SEQ ID NO: 98702 - DNA, 513 bp, Triticum aestivum
  unsure (1)..(513): unsure at all n locations
  Clone ID: PAT_TA_98702
aagcaatactagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacancaacaacaacaacaacaacaacaaccaccattttcgcagcaacaacaaccagttctaccacaacaaccacattttcncaacaacacaacacattttcggagcagaacaacatcttcacaacaacacttttccanacaacacaacagtttcaaaacaacana

SEQ ID NO: 98703 - DNA, 529 bp, Triticum aestivum
  unsure (1)..(529): unsure at all n locations
  Clone ID: PAT_TA_98703
aaccattcccccaacaaccacaacaacctttccccctacaaccacaacaaccattccccctacgaccgcaacaaccattttcccagcaaccccaacaatcacaacaatcatttccccagccccaaccccagcaaccccaacaaccatccatcctgcaaccacaacaaccatttctgcagccccaacaacaattatcccagcaactagaacaaacaatttcccagcaaccccaacaaccattcccccagcaagaactaccaccattttcacagcaacaatcaccgttttcgcaacaacaacaaatagtactacagcaacaaccaccatttttgcaacaacaacaaccaagtctaccgcaacaaccaccattttcgcaagcaacaacaacaactagttctaccgcancaacaaataccatttgttcatccatctatctggcagcagctaaaccatgcaaggtattcctcaagcagaatgcagcctgtggnaatggcacaaanctgctngtcgcaaagttgcagcagagagg

SEQ ID NO: 98704 - DNA, 538 bp, Triticum aestivum
  unsure (1)..(538): unsure at all n locations
  Clone ID: PAT_TA_98704
gcagctgcaaccatttccgcagccgcaactaccatatccgcagccgcaactaccatatccgcagccgcaaccatttcgaccacaacaatcatatccacaaccgcaaccacagtattcgcaaccacaacaaccaatttcgcagcagcagcagcagcagcagcaacaacaacaacaacaacagatccttcaacaaattttgcaacaacaactgattccatgcagggatgttgtattgcaacaacacagcatagcgcatgggaagtcacaattttgcaacaaagtactttaccaagctggtgcaacattgtgttgtcaagcagctgtggcaagttccccgagcantcgcggtgccaancatccacatgttgttcaatggctattatcctgcatcaaacaacaacaacaacaacaacaacaaccgtttgancaagtctgcttccaacancctccaacaacatnccatcaaggcaaggtcccttcaancanctcaagcaaaaccacangccaaggnctnccaanctcaacaacggccaatttg

SEQ ID NO: 98705 - DNA, 516 bp, Triticum aestivum
  Clone ID: PAT_TA_98705
gtttggtttgattgctgggcttgtaaatgtatgggttggtctgggtttggtttggattacaaactattgccaggttgtcttaatgtgctgaatattttcaaatgttgtggcagctgggatactaaattgtacttagttatttgatctactcatgttcatgctgcttcttaagtgattatgtttatgttcttgctactagtaggatggtcaatacatgcttgttatgtaactttagatctttcgtggaactcctgggtccttcatatctaaagttattttgacattctgcatagattctaacattgcttggattgcttatatcttccttcctgaacctacaaaccttggatgcataattagttaattacacactttggatatgtccaactggaaccaactttgttaattacacacacaagacacacacacatatatatatacaccccacacgtcaaatatatggtgttgtataatgctaatgctacttgtatcactaggttcccctggtttttaagg

SEQ ID NO: 98706 - DNA, 524 bp, Triticum aestivum
  unsure (1)..(524): unsure at all n locations
  Clone ID: PAT_TA_98706
gaaagaatggtgtgcgtacagagcatgggacggtcgcagccgggtacccaaggtgccggcgctactggctgacaaagccgcgctatgctgcacatgaggaggattggaggaacacccaatcaatcggagggcgggtgggctgagcagccggacggcgctgccatgggggcaagcggtgagcacgtgacatgtatctgccactgctggcgaacgctcccggcgctggagacggccgttcttttccgcagagctctcacaaatcagtcaacctacgaagtggccagatggaaggggctattctacttgaggtatgtgctatcaagaacaacgcaggctccagtgtgctctgattttatgattcctcactactatattgttagacttgggtactggagctgtancactttcaaggtaattctggacaaactcatccattcagtaaatgcatatatagaaacatctgtgacttctgcctcactatggnatgaantgctcccgaatcatgtnaggctaaantatanttn

SEQ ID NO: 98707 - DNA, 526 bp, Triticum aestivum
  unsure (1)..(526): unsure at all n locations
  Clone ID: PAT_TA_98707
ccacaacaacaagttccccagcctcagcaaccacaacaaccatttctccagccccaacaagcattcccccaacaaccacaacaaccattccctcagactcaacaaccacaacaaccatttccccagcaaccacaacaaccatttccccaacaacaaggcatgcatatcctgctgccactatctcaacaacaacagttgggtcaaggtactctcgtccaaggccagggcatcatccaacctcaacaactagctcaattggaggcgatcaggtcattggtgttgcaaactcttccaaccatgtgcaacgtgtatgtcccacctgagtgctccatcatcagggcaccatttgccagcatagtcgcggggattggtggccaatgaaaaaagcaagatctatactaatagatagatggatcatcgttacttagcagatgcaccaantcgatgtaacgatgacaaataaagtggcgtgcaacatcatgtgtgacccgacagtgctagttcaagcttgggaataaaagacanc

SEQ ID NO: 98708 - DNA, 525 bp, Triticum aestivum
  unsure (1)..(525): unsure at all n locations
  Clone ID: PAT_TA_98708
cgtcgccaagaactgcacccgccggcagctcaaccagatccatggcctcctcctcacctcctccctccaccgcctcccgggcctgcccgccctcctcgtccgccgcgccgccgacgtcggcgacatggcccacgccgacctgctcttctcctcgttcctccggtcgggggcgccgcctgacgccgccctctacaacgccatgatccgcgggcgctcctaccacggcccccacgagcgcgcgctggagctgttcgacgagatgccgcgccggggcctgggtggctgacggattcacctacccgtacgtcctggacgcgtgcgcgcggctccgggcgcggcggcgcggcgagggcgtccacggccgggtcctgaaggaggggctcgaccacgtgccgtccgtcgggagtcgctggtcgcattctacgtctccgtcggcggcggtcgctgggcgacgcgcggaggtgttcgacggattgcgctcagtccgtgggcctgtcaaacacatatancgganacgccaaggcg

SEQ ID NO: 98709 - DNA, 598 bp, Triticum aestivum
  unsure (1)..(598): unsure at all n locations
  Clone ID: PAT_TA_98709
acataatgagcttctgggatcgcctgtgcaaggtgctgcatgtgaggaaggtcactgtcatggacatatccaagaagcaaggaatggactataggcttctgcatgccatcacgactgggcatccatggtatggtgaatggggatacaagtttggcgccggtagctttgctcatacctcagatacctaccaggaggcggttgatgtgctctccggtatacacctggcgttgtactcctcacatcgcagccccatcagaacccctttgcagaacacaattgctctatattggtccctttctgatcgacagcttgtgactgtgagggacctcttccgggttcataatgcacctgcttcatcaagctcgtaaggacgctgagacgtcaaaaccaaccatgggatgagcacagagaattgaatcgaacgtgctctgcatgtgggacaaatgaagatatcaaccgagcaaaactgcaatgctcaagncctccgggctgtcaaactggggcgctgggtgtcctggcgccactgaagggaactgcatcgaaggtgttgatcacaggaacgctgataccncctcaagtcgcnggggaaatgatggnn

SEQ ID NO: 98710 - DNA, 573 bp, Triticum aestivum
  unsure (1)..(573): unsure at all n locations
  Clone ID: PAT_TA_98710
tttaagggtttcctaattgtttactgtactgtataatttcttaaaactatttgaacaaattttgaaaaaaaggagaatgttttaagcgatatgaacaaattatgatatttctgtacatttttttcgtaaaaaggggaaaatgaaatgcgaaagttggaattatttgaacaatttgtttttgaaaaatgtgaatttctattaaacaccaacattttttaaaattccttgaacattttctgaattaggggacaaattttgaaaatatttgttgaatttgtgtagtttgggaaaaaatgagatcattttttagttcctaaaagaaattaaaaatgattttttttggnaaaacaccaacactttaagaaattatggataaattnttaaaaaaagaacattttgtgaatcccccgaacatttttggcattttggnattttcccnaaaatangangatttaaattcccgattttgggggggaagtgaatttaanttgaancnccaacattttangattnatgaacaaattagaattcaacatttgggaanattacaatttggaatacactgttggaaan

SEQ ID NO: 98711 - DNA, 580 bp, Triticum aestivum
  unsure (1)..(580): unsure at all n locations
  Clone ID: PAT_TA_98711
gctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcagccgcaaccatttcgaccacaacaaccatatccacagccgcaaccacagtattcgcaaccacaacanccaatttcgcagcagcaagcagcagcagcaagcaacaacaacaacaacaacaacaacaaccgttgagccagnctcctccaaacagcctcancacatatcatcangcaaggntccttcaaccatctcagcanaaccaaaaggccaaggctcgtcaacctcaacaacggccaattngnggaatanggactacgcngagngtactgcaagtgnatgccattcctcaaat

SEQ ID NO: 98712 - DNA, 410 bp, Triticum aestivum
  unsure (1)..(410): unsure at all n locations
  Clone ID: PAT_TA_98712
cttataacgtaaccctagtcggctagagcaaattctactctccaagcttcaccgaagagcccgtggattcgcctctcctctgctgccacttcagtgaccggtgacgggaaggggaatctcagtgcctccactccggctagtagtttaggttaggatttttagtccttgaaggtacggctcgagttagactcccgccgtctcttgggaccatgaggttagtgtttctccgtcatgtgacaagacactagtaaaaaacagggctttgggtcacagctcaatgtacacattatcccggttgcatcacgaaccgggactaatgtgagcattccgtcccggtttgagcggctaaggcggtgatgagggtgattagagtgggtgattanagattaaattgtcaaataattcaagaa

SEQ ID NO: 98713 - DNA, 591 bp, Triticum aestivum
  unsure (1)..(591): unsure at all n locations
  Clone ID: PAT_TA_98713
caagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcagccgcaaccatttcgaccacaacaaccatatccacaagccgcaaccacagtattcgcaaccacaacaaccaattcgcaagcaagcaacaagcagcagcagcaacaacaacaacaacaacaacaancctacaacaantttggcaacaacaacgatcccatgcanggatgttgtattgcaacaacacaacatagcgcatgggagtcacaantttgcaagaaantcttacaacngggcaacatgtgttgtcacaatgtgggaagtccccgagaanncgggcaagcatcacatgtgtcat

SEQ ID NO: 98714 - DNA, 596 bp, Triticum aestivum
  unsure (1)..(596): unsure at all n locations
  Clone ID: PAT_TA_98714
aaggtatcttctctctctctctgcttttactattttagttttcgttttctattattctgtagtctttagggctttattaaaaatgccagggcatttccaaaaatcatgaaactaatcatggctactgtttagaatatatccaacaataaacattttagtttatgattatttgagcatttaaaatattttatagcatttaaatgcccaaatgcgaatactatatgatttaattcaatgaccaaagttgtcctagaaaaatgtgaaccatttttgacagaggttctagaccaaggcaaagatgatgaacattttaagaagggcatttcgggttcattgaaaaagtatttagtaaacctagttggtttaagtggtgctgggggtttctgtcatccccatttcaactttcctgagaaaatttaacatgntgacatgatgattatgcaaggacaagcaaaggctaagctanggctgtgacaactcaaccccactaaacaagaactcgtccgagatcaggactgaggtngangacagaggggaccaaanctaacacaatctcacgatcagttgcactcanaagatcgttgatcgttnacncg

SEQ ID NO: 98715 - DNA, 529 bp, Triticum aestivum
  unsure (1)..(529): unsure at all n locations
  Clone ID: PAT_TA_98715
gccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaagggcatgccgcacaagttctaccacggccgcaccggccgcgtctgcaacgtcaccaagcgcgccatcggcgtcgagatcaacaagcaggtcggcaacaggatcatcaagaagaggtccatgtccgtgtgggacacgtgcagccatccaaggtgcaacgaggattcctccaanaggaaatcaacaacgacaagctgaaggcggaggcaaagcgcgcggcgaagtcatcagcaccaaagaggaaccagcaaggcccaagccggggtcatggntntagggaacancatcgagacggcaccccatcccgtttgactctcaacnntn

SEQ ID NO: 98716 - DNA, 510 bp, Triticum aestivum
  unsure (1)..(510): unsure at all n locations
  Clone ID: PAT_TA_98716
agaaatctcaagcttagcacagcaccaatggcgtcggagcagaccttcatcatgatcaagcctgatggcgtccagaggggcctcatcggtgaggtcatcagccgcttcgagaagaagggcttctacctcaaaggtctgaagctccagaacgtggagaagtcgttcgccgagcagcactacgccgatctgtcctccaagcccttcttcgctgggctccgtggagtacatcgtctccggccctgtccgtcgctatggtctgggagggcaagagcgtcgtctccactgggacgcaagataatgggcgccaccaacccctggnctctggaccccggcaccatccgtggtgacttgccgtccgacatccggcaagaactcaccatgggaagcgaccaattntagangcgaggaaggagtncccctgtggtcccctggaaggattgcagatgggaggagcaaccaacacaacggttctatgaggctaaattgtcatgatgggtttangcaagttca

SEQ ID NO: 98717 - DNA, 433 bp, Triticum aestivum
  unsure (1)..(433): unsure at all n locations
  Clone ID: PAT_TA_98717
cttgcatatatccacggatanatcaatttantttgttaccanaagcancncgtggcatgcatcatgctacgtncagcggtgacgcgccggcgggtcgccgcnccacgttttattacatctcctgacagnggcggnnagtgggtacatggtanttaagacttangatacatacgtggcttcgtttgacagacggcgccatgganggggcgggggtggggganctcncgcgcggnncgtctgccctatcactccctctggcaggtgcancgcctgattttgcaggtagccggncgtccantttgcgccntgctcnctgaggcacatcttggtgcanctcttgtccgagacacacgggaacgantggtgntggtcttccccgtgcaaatgcgcgcctcccgccacgccgatgccaccncgccnctgtaggaagaaa

SEQ ID NO: 98718 - DNA, 513 bp, Triticum aestivum
  unsure (1)..(513): unsure at all n locations
  Clone ID: PAT_TA_98718
gaggattgatctaatgcaataaaactgggtagtagaaaaggtatgatcaaagtgttacttgccttgctgatgatccaagaaacctagagattcgaagtaacaagcggcgcactccgggtattctatcacagacaaacaaacaagcatacaataagtactcatctaataagagatctaaccagaaggttcaacttaagaactccggttggcaaaaagaatcaaatcgaacgaagcaacgaaagtcaaatggcgaaataaaaacaactttattctactaatctgggatctaagtgcaaattttacagtagcaaaatcttgtttaagttggttaaacggatagagggattcngagacaaaactccaggcgcttgaatcgcctgattccggataaacgagcgaaaattaaactanaaagaaaatcngtncaggaacncgatnnagaaaaaccgcgatttaatcccgagaaaaagaaaaacgacnacgttcnctangaacgaacgaatggacgaacgc

SEQ ID NO: 98719 - DNA, 496 bp, Triticum aestivum
  unsure (1)..(496): unsure at all n locations
  Clone ID: PAT_TA_98719
caacgctgccaccgccacctcgtaccgcacgctcgcaacctaccgaccggccgaccaacgccgcgacagctctccgttcaccgccgatgtccggcggcgtgggcccnacggnggggggcggcatcatgctgccgtcgatggggcagccgccgccgccgctgcacccggagcccacctcgccgacggngcgcccgcaccaccactactacctcttctccatcaagcagctcaanacgctgggcgccgccgccgtgctggccttctccaccaccgtgccgctctcggagatcgccttcgccgtgctgctcctcccctacctcntcctcctcgcgtcgctcgccttcccggcagcgccccgggaaacccaanccgtccacgcncgtcttctcggcaccgcgcgcntcctcctctccgcgcaagacgtggggcggggtnctcgtcgggagccggccttcccggnggtcnacntcntcgacgggcngtcggctngcgggga

SEQ ID NO: 98720 - DNA, 563 bp, Triticum aestivum
  unsure (1)..(563): unsure at all n locations
  Clone ID: PAT_TA_98720
gttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctggtgcaacaacaaatccctgttgttcaagccatccantttgcagcaagcnaaacccatgcaagctattcctccangcagcagtgcagccctggtgggcaatgccacaacntcctggctaggncncaaatgtttgcnagcanangcaattggccatgtgaagcn

SEQ ID NO: 98721 - DNA, 576 bp, Triticum aestivum
  unsure (1)..(576): unsure at all n locations
  Clone ID: PAT_TA_98721
gcagccaccaaccaagcacctcgccttctcgcagctctccgccggccggccgcgcttcccctcccctccctcacctcaggcagctctcgaatcctcccccatgaaacacccaaccctctctccctcccacgagccctctcactctccatctctctcccaagagatccctctctgcagccacaaacaacggtcaattctatccaggtatagtgtccatggccggcatgcagcacatccccgagctcgcctccctctgttgtgccgtctactccggccagatccgtcactccctgtctccatagcttgtgcccaaaccctccccatggctagggttttcggcacggcgtcgcctccgtcaccggcgcggctccaatgttgctagtggaatagcagaggatgatgaggatgaagacgagctcacgccctagcccgacgagctgtagaccaccatgatttccacacaaggtctcttcctctttctctgtttaattttcctaataattgattgatggctcngcnttgntatgcaaatctaagggganaaacgttactgggaatataccannnttcatatng

SEQ ID NO: 98722 - DNA, 566 bp, Triticum aestivum
  unsure (1)..(566): unsure at all n locations
  Clone ID: PAT_TA_98722
cgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagnaaccacaacaaccatttccccagactcaacaaccccaacanccatttccccaacaagcacaacaaccattcccccaagactcancaaccccaacaagcatttcccagctccagcaaccacaacagnnttttccccagcnccgagancaattgccgcaggcccanngagcgggnnnaatcgttcccccaanaacnaaggggaatcaatcaancntttctacancaacangtgaaccatggaa

SEQ ID NO: 98723 - DNA, 565 bp, Triticum aestivum
  unsure (1)..(565): unsure at all n locations
  Clone ID: PAT_TA_98723
accgccacaactgcagttagagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacaatattcgcaaccacaacatccaatttcacagcagcagcagcaagcaacaacaacaacaacaagancaacaaatacttcaacaaattttgcaacaacaactgattccatgcatggatgttgtattgcagcagcacaacatagcgcatggnanatnacaagttttgcgncaaagtacttagcagctgttgcaaagaattggtgttggcaagcacctaaggggagnttcctgagcaatccgcaatggcaaggccatccccnatgtttgttcaanccaattaatccggcgtcaannn

SEQ ID NO: 98724 - DNA, 567 bp, Triticum aestivum
  unsure (1)..(567): unsure at all n locations
  Clone ID: PAT_TA_98724
ctggcgcccacctacctggcccagctcctccagccggcccagcccaccgccgcctccctcccctgtcgtcttcctccctgccaggaggacgggcacgcgcccggcgcgcgcggccacgcgccctggccacctcctccctgcctggctgcctcctcctccccctggacgtctcccgagcgccacgcactcgccctcgaccctctctcactctcccgtgtctctccctccgtccctatccccctcggctccctctccctcccgcgaccgaacggagctcgtcgccgccgctcgccgtagccacgcctaccggccaccccacgccttgcagacgctccggaaagcttcgcctcgtctccctcttcatcctcacccaagacgaaaggcgccggaatgtcacatccctagcttctggtaatgctctgagctagctagtcatgtgttgcatcatgtttaaattttgcctaaaattgaaatggggatgttcaaaccctancantanatcaactcanctanggtaagttnaaatcttttaataaacccaaaaggccctaaanaaagntaatgntt

SEQ ID NO: 98725 - DNA, 463 bp, Triticum aestivum
  unsure (1)..(463): unsure at all n locations
  Clone ID: PAT_TA_98725
tgcaaccgcagcanccattcccccaacaaccacaacaaccattcccccaacaaccacaacancctttccccctacaaccacaacaaccattccccctacgaccgcaacaaccattttcccagcaaccccaacnntcacaacaatcatttccccagccccaaccccagcaaccccaacaaccatccatcctgcaaccacaacaaccatttctgcagccccaacaacaattatcccagcaactagancaaacaatttcccagcaaccccancaaccattcccccagcaaccacaccaacctcaacaaccatatccacancaacanccatatgggagtagtcttacaagcatcggtggccantgaaatgaagactgtnatacangacggatgggtnatcgntgtttaagtcaatgaagtgttcnaatgtnacgatgataaatanngtgatgtgcaccatcctagtc

SEQ ID NO: 98726 - DNA, 574 bp, Triticum aestivum
  unsure (1)..(574): unsure at all n locations
  Clone ID: PAT_TA_98726
atcatggcccgcgctcaggtaatgctcatggccgtcgccttggtgctcatgctcgcggtggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcaagctcatccatccacgtggagttgaagcgcgcagcctctatccctatgtagtatggtcactanttatgcgagtttatactgaatatgaataaagaactctctccaactggcttgctggnaatcctcctggaggagatnagtanccggtgtnnctgaaaattgaaaantttgttccaatgggcaacncccan

SEQ ID NO: 98727 - DNA, 568 bp, Triticum aestivum
  unsure (1)..(568): unsure at all n locations
  Clone ID: PAT_TA_98727
ccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacagattcctcagcagctccagtgcgcaagccatccatggcgtcgtgcattccancatcatgcagcaagaacaacaacaacaacaacaacaacaacaaggcatacaagatnatgcggncantatttcagntcgtncanggtcaaggnatcatccaacctcaacaancaagctcanntggnggtgatcangncantggtattgggaactccttcaaacatgtgcnaagtgtttggtccacctggagtgcccnnc

SEQ ID NO: 98728 - DNA, 532 bp, Triticum aestivum
  unsure (1)..(532): unsure at all n locations
  Clone ID: PAT_TA_98728
cccagcaaccacaacaaatcccccaacaacaacaaatcccccagcaaccacaacaattcccccaacaacaattcccgcaacaacaatttccccaacagcaattcccgcaacaggaattcccacaacaacaacaattcccgcaacaacaaatcgcccggcaaccacaacaactcccccaacaacaacaaatcccccagcaaccacaacaatttccccaacaacaacaattcccccagcaacaatcaccccaacaacagcaatttccccaacaacaattcccccaacaacaacaattaccgcaaaaacaattcccccagccacaacaaataccccaacaacaacaaatcccccagcaaccacaacaattcccccagcaacaattcccccaaacancaagcaatttccccaacaacanggattcccccaacagcaattcccgcaacaacanttccaccaancaacaattaccggcaacaacaantttcccaaacaanaattcccccaaccagcaattcccccaacancnagagtt

SEQ ID NO: 98729 - DNA, 518 bp, Triticum aestivum
  unsure (1)..(518): unsure at all n locations
  Clone ID: PAT_TA_98729
gccgtcgatgcagtcccgtcaccctttcctcccttcctctcccgtcgccaagctcgtcgtcgttgctgctccccgatcaggcgccatcggcagtgcaggacgcctctcgcgtcgggggattcggcagcaggaggaggaggaccagcggatccagtctggcactctgctgctcgtgtcagtcgtcgtcgacgacgcgaggagggagacagtggatggagatcgtgcggtccgccgccgcccgtggatgcgtggggtgaggctggggatgtcatccccgcggtgctggtggccctggtgctgatggggaagatgggcgcccgccagatccgacccgaggtcggaatcggagctgccactccaggcggctgggaccgtcctcgaggtcggncatggaggtcctttttgtgttggagcaagaaccgtacagcttcttgggtctccttccaagcagtgtcttgcctgangctancctccccangatgccatctcgcacacaaaatcctgtttgccaanaattg

SEQ ID NO: 98730 - DNA, 508 bp, Triticum aestivum
  Clone ID: PAT_TA_98730
ggaatattgtcgaatgcatttcgtggtagcttgtatacgaccatgcattacatggcatctgaagataaacttgttgctggcatgggaaatggatctatcagatttattgatatctctcgggatcagaagctgcatttatggaagagtgattcggctgaaatctccttctcatcactcgtgtcaactatttgctcgtctggctcagacaagccgaggaatggaagccttgtggcttcatcatcctggattgcagcaggtctaagctctggttattgtcgattacttgacgagcgtagtggaaaaatcattgcagtttggcgagcacatgatggtcacattacgaagttggcatcaccagaggaccacttgattgcatctagctcccttgacaagactcttcgaatttgggatctaagaaggaacctatcagtccagtcaaacattttcagaagccattcagatggcatctttgacttctccgtttggggtcaagacctgttatcaatgg

SEQ ID NO: 98731 - DNA, 254 bp, Triticum aestivum
  Clone ID: PAT_TA_98731
aaaacaccaataatttgaaaaaaaaatatgttttgacattctaggacattttttgaatttgagatttttgttgtaaaaatgaacattttttgaaaattctgttttttgaaagaacatacattttttgaaaattgctatctctttttgaaaacaaagtttttttttgaagtctcacacaaaacttgaatttccaaacaatttccaaaagaatgaacattttttgggtttatgagcaaaatttgaaaaaaaaaaaa

SEQ ID NO: 98732 - DNA, 432 bp, Triticum aestivum
  unsure (1)..(432): unsure at all n locations
  Clone ID: PAT_TA_98732
aaccacaacaaccattcccccagcaatcccaacaatcacaacaaccttttcccgggccccaacaattatttcctgaactccaacaaccaattccccagcaaccacaacaaccattccccctgcaaccgcaacaaccattcccccagcaantcgcaacaaccattcccccagcaaccacaacaaccattccccctgcaaccgcaacaaccattcccccaacaaccacagcaaccattcccccaanaaccacaacaacctttccccctacaaccacaacaaccattccccctacgaccgcaacaancattttcccangcanccccaacaatcacaacantcatttcccaagccccaaccccaggaancccaacanccatccatcctgnaaccacaacanncatttctgcagcccccaacaacaatttatcccaa

SEQ ID NO: 98733 - DNA, 232 bp, Triticum aestivum
  Clone ID: PAT_TA_98733
gataaatctaagtgaagcatgagagcatttcttcaaaaatactaaagcacaccgtgctcaaaaatatataagtgaagcactatagcaattccatagctaaaaaagatttaagtaaatcatagagagcaattctaacaagtcatagcataattttgtctctctcaaataggtgtgtccagcaagggttcatgacacaaaataaaaaacaaaacaagaaaataaaaaaaaaaaa

SEQ ID NO: 98734 - DNA, 517 bp, Triticum aestivum
  unsure (1)..(517): unsure at all n locations
  Clone ID: PAT_TA_98734
gcaaaacctccctcgcgctccgctgcggggaggcagttgcgctcacctgtgcgcacctgttgtctgcccaccacctgccgatttcttcccattcctcacctcgcaccacacctcgctgaagactaccgccacccacacctctccgggcaacacatcttcgctccccaacgcactcgattcaagcctccctcctcccattgttgcgaccgtgcccgataggtgcttcaaccaacgccgccggagcgccacgacagtcaccggggtattgcgatggcgggtcccacgccctgcggtgctgcaaccagggcggccaatcactagtagaaaacagggcaaaggtcacagggcagttttcacattagccccggttcaagtcacgaaccgggacccatgggggcattcgtcccggttcgtgagcccaaggggccggccggggcctcgtgggcattggtcccggttcgtatggaancatttgtcccggtttgagccacgaaccggggactaaatggtcctccgn

SEQ ID NO: 98735 - DNA, 557 bp, Triticum aestivum
  unsure (1)..(557): unsure at all n locations
  Clone ID: PAT_TA_98735
ctcatctctccacccaatcatcactagctaatacggtgcactgttagctacagaccaagaagtgatcatggcccgcgctcaggtaatgctcgccgtcgccttggtgctcatgctcgcggcggtccctcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcanggtgtaatgggcgacgattcgtcaagctggtgctcagctcatccatccacgttggagttgaagcgcgcagcctctaaccctagttataaggncactaatttatgcaagtttatacngaatatgaataanaatcncnccangtgggttng

SEQ ID NO: 98736 - DNA, 538 bp, Triticum aestivum
  unsure (1)..(538): unsure at all n locations
  Clone ID: PAT_TA_98736
caaccattcccccagactcaacaaccacaacaaccatttccccagcaaccacaacaaccattcccccagactcaacaaccacaacaaccatttccccagttccagcaaccacaccaaccttttccccagccccaacaacaattcccacagccccaacaaccgcaacaatcattcccccagcaacaacgaccgttcattcagccatctctacaacaacgtttgaacccatgcaagaatatcctcttgcaacaatgcaaacctgcgtcattggtgtcatccctctggtcgataatctggccacaaagcgattgccaagtgatgcagcaacaatgctgccaagaactaagcacagattcctcagcagctccagtgcgcagccatccatagcgtcgtgcattctatcatcgtgcagcaagcagcancaacaacaacaacatcaagcancagcancaacatcanggcatgcatatccctggctgccantatctcagcnacaacaggttggggntcangggtacnctcggtccnanggcaaggg

SEQ ID NO: 98737 - DNA, 234 bp, Triticum aestivum
  Clone ID: PAT_TA_98737
gtaattccccgctaataatgccacgtcacctcggttactgttgttatctgtgcgatgatccaaaaccgtttcaaaattcaaatttaaattaatgccgatagtaaaagtttttcaaaaattgaaacaaaaatgttcggtgggtgccaaatattacaagggtaattataataaagaaaacatattttttagaaaatgcctaaataaattaaattgaaataaaacaaaaaaaaaaaa

SEQ ID NO: 98738 - DNA, 542 bp, Triticum aestivum
  unsure (1)..(542): unsure at all n locations
  Clone ID: PAT_TA_98738
tcacaacaacaaccaccattttcgcagcaacaacaaccagttctaccgcaacaaccatcattttcacagcaacaactaccaccattttcacagcaacaatcaccgttttcgcaacaacaacaaatagtactacagcaacaaccaccatttttgcaacaacaacaaccaagtctaccgcaacaaccaccattttcgcagcaacaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctaatccatcatccctgcaaggaacaacaacaaggntcaagggttccatccaaaactcctcaagcaacaaccccaacagttgggggcaatgtgtttcccaac

SEQ ID NO: 98739 - DNA, 533 bp, Triticum aestivum
  unsure (1)..(533): unsure at all n locations
  Clone ID: PAT_TA_98739
ctttgctctcctcgccantgnggcgacnanngccattgnagaannggtgagtnnccacatccctggnttggtgagaccntcgcagtaacaaccatttccaccacancacccatntccacagccgcanccatttccatnacaacagccatatctgcagctgnagccatttccgcagccgcaactaccatattcgcagccacaagcatttcgaccacaacaaccatatccacaacngcagccacagtattcgnanccacaacatccaanttcanagnagcancagcancaacaacatacaacaacntcatgnacaacagatacttcaacagnttttgcaacaacaactgantccatgcatgngatgttgtattgcagcaacacaacatngcggcatggngagatcacaagttttgcaacaagagttcttaccaagctgttgcaaganttgtgttgtcagcaactatgggaanttcctgancnatcccantgcaaggcaatcccatgtggtcaagccctnttcccgntaanaaaaa

SEQ ID NO: 98740 - DNA, 549 bp, Triticum aestivum
  unsure (1)..(549): unsure at all n locations
  Clone ID: PAT_TA_98740
ggaccatatagactttgagacaaaacatcctttcacaattaagcaaatcttcattttggaactgacgccgcttgctggaagaatgacatgtaccagtaggctgaggaatgcccctccacgtgcttttgcttccctcagctgcgataacgatcgcctccttctctatgttggcttcgccactgatccttccagcaccacctctaaatggcaacatttccagtgatacagtttttgcatttagagatttagcacacctcgtagctccaaacaattggcaaacagagaagcaagcaggctgaattatccatcaacaactctttgttgtttcttgaagttctttgcactcggggccagctgatcctaactctccaatccgcaaaatgtagaccacagaaaaatgtcaacttatatagtaaattaaataaggatctgcgcctacagtacactaaccttgcgaaagtcctgggcaattgaactctanggcttcatccaataaagatnataagcatatcaacctttaacaaattgcagctaacatatanttcagtt

SEQ ID NO: 98741 - DNA, 528 bp, Triticum aestivum
  unsure (1)..(528): unsure at all n locations
  Clone ID: PAT_TA_98741
ggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccgggatcctctccatggccaacgccgggcccaacaccaacggctcccagttcttcatctgcaacgtcccctgcaattggctcgacggnaagcacgtggtccttcgggcgaagtcnccaagggcatggactcgtcaagaaanatnaanaaggggg

SEQ ID NO: 98742 - DNA, 260 bp, Triticum aestivum
  Clone ID: PAT_TA_98742
aaattgacggaatactataaaatgttctaagaatgtaaaagatttgttctagcggttttaggaaaatgtttgtacatttcaaaaagcgtcagtgacttttaaaaaatgctcaaacattttcaaatatttccatgtgataagaaaaaaattacacataaaagatgtttgaactatatacgaaaaatgttcaacacagaatatattttaaaatataaaggaaaaaagacaagaaaagaacaaatcagtagaaaaaaaaaaaa

SEQ ID NO: 98743 - DNA, 251 bp, Triticum aestivum
  Clone ID: PAT_TA_98743
atatttagaaacgaagagagtacatattataaaacaaaatacgaccaagctttgaaaactgcagggacatgcaaataaatattaactgcaaccaaacacatctagccaaacatttggtaacgatatgaagtcgccatgatgtaaaattcaagacatggttaaaaaatttgggtctatccagggcacattgagatgtgccttagttattacacatctaaatgactcaattaaccataaaaagaaaaaaaaag

SEQ ID NO: 98744 - DNA, 574 bp, Triticum aestivum
  unsure (1)..(574): unsure at all n locations
  Clone ID: PAT_TA_98744
aataaaaggacacgtggccctccaaaaaataaagctaagccctaaaaaataacaacacacaaaacataataacggcccactaaatatgttatatcggacctcaatgcatcacgagggacaaactgaaaacacgatgcaatgacaacataaatgactctcagaagcacatgtatctaacagtgatacgagttagataaaatattgttgactcttatttaaatgagaataagcaaatcaattcgaaacatgacccagaccgcgccgcaaaaatggcccaacaaattacgcacgtgtgaacaggtcgccaaatagacacacacaaacacacgaggcaatacagaatgcgtgtgataaaataacccacgatcaagatttgcacggcatttagaacanacatatgacagagtaaaaactagttcataaattttgaacaaataaaataaagaataaatggaaaaataaaaataactaaaaaatttaaaagagaaaatataaataaaaacaaaaaatcatgaattttaaaaatagntcatgatttataatgaaattaaatcaaaacttttaataaaaagaa

SEQ ID NO: 98745 - DNA, 544 bp, Triticum aestivum
  unsure (1)..(544): unsure at all n locations
  Clone ID: PAT_TA_98745
cctccccccgcgtcatctcctccgaggcgactcgggggttaccctacccgccgccgccaccctcctccctccccttccctgcccctccgccgccgccagaggtgtcctccggcttccgcgtgcgacaccaatgaaggtggcggcggggatctggcggctccaccttgagtggagggcctcggcagccggggcggcggccctgggcggtgtgcgcggtgtggcctttgcggcgggtcatgcccgcatgtgttggtgagccgtctcccctcggtcgtgtgggcgacgaggtgacggcggccgtcggttgctagtgtggcaacgtcccccgcaagcctgccggcatccttgtgaagattctcctccctctcgccccgatctgctccttccctcgccggatccgggctctggtggcgctagccactgactccgggtgctggttgcgggatgcttgttgggtgtgtgtggatttaaggaaaccttgaccgacgcngngggcacataaaattgacgccttgggcaacgattcctccatggaggtctggtn

SEQ ID NO: 98746 - DNA, 581 bp, Triticum aestivum
  unsure (1)..(581): unsure at all n locations
  Clone ID: PAT_TA_98746
caaccattccccctgcaaccgcaacaaccattcccccagcaaccgcaacaaccattcccccagcaaccgcaacaatcatttccccagcaaccacaacaaccattcccccagcaaccgcaacaaccattccccctgcaactgcaacaaccattcccccaacaaccacaacaaccattccctcaacaaccacaacaaccattccccctacgaccgcaacaaccatttccccagcaaccccaacaatcacaacaatcatttccccagccccaaccccagcaanccccaacaaccatccatccttcaaccacaacaaccattaccccaacanccacaacaaccatttcagcaagccccaacaacaattatcccaagcaaccagaacanacaatttcccagcaaccccaancaaccattcccccagcanccacaccaacctcaacaaccatatccacaacancaaccatntgggagntagtcttacaagcatcngtgggcaatgaatgaacacctgtantacaagacggatggtnatcgttgttagtcaatgagcgttaatggtaacgatgntaattaaagtgntg

SEQ ID NO: 98747 - DNA, 580 bp, Triticum aestivum
  unsure (1)..(580): unsure at all n locations
  Clone ID: PAT_TA_98747
gcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaacaacaacaacaacaacaacaaccaccattttcgcagcaacaacaaccaagttctaccacaacaaccaccattttcacaacaacaacaaccaccattttcgcaagagcaacaaccatcttcacaacaaccaccttttccacaacaacaccaacagtttccacaacaacaaatccctgttgttcaaccatccgttttgcagcagctaaacccatgcaaggtgttcctccaacaagcagtgtagccatgtggcaatgtcgcaacgtcctgccangtcacaaatgtggcaacaagagtnnttgccatgtgatgcaacaacnatgttgccaacagtgccgcnaatccccgaacaac

SEQ ID NO: 98748 - DNA, 259 bp, Triticum aestivum
  unsure (1)..(259): unsure at all n locations
  Clone ID: PAT_TA_98748
ccgccgcccagcctcctccgcccactcgacagctccgccgccgccggagctacgcgctcaaccccccccccccccctctcccgcnccaaggttctccgccgtgnnatcctgtcccttcncgccttctcctcnccgcgccgccggcacgctccaacccagctngcccncgtccgtgaaggctatagctgccaanagcngccngagtcganggagggagggangttcctctcanataaaggattgggcagtttggccgggg

SEQ ID NO: 98749 - DNA, 560 bp, Triticum aestivum
  unsure (1)..(560): unsure at all n locations
  Clone ID: PAT_TA_98749
catatgctactaccaaaatcccataattttgatggagactagaaagaattatttaaaagggttgtagtgcaaattgcactctggacagagaaggaaaaattgatgcagtgctcaaattattacataaataaaagatatttttgcacaaatgttattgaataacatcacatgacatctccaaattttggtgaaatttttagttaaatatatcaaatggttgtagttcaaaaagagctccaaattttaagacaagtcatttaatgaataaagctcagggtgaaataattttataaataaatctcctgattgagagatgtttttaaatgagagggaaaataagtccaatatgttttggaaggatccacttgggaaaaactccttaatattaaaagaaaagtgttgaaatcaacagggatattcttgcaggcaaaaattttaaactcttggcaaaattttantaactaaaacctggttaaatttttggggtgttacaatactaccccccttaagaaaatcccgtcctccaaggggggccggtnaccaantcgncctanagtgat

SEQ ID NO: 98750 - DNA, 559 bp, Triticum aestivum
  unsure (1)..(559): unsure at all n locations
  Clone ID: PAT_TA_98750
catccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatnaagactggatttgctgatggcaaggactgattctgtctgttatgtcgncatgggtnaaagaacaaatntgcctgtgaaggaaatccgtggtgggaat

SEQ ID NO: 98751 - DNA, 557 bp, Triticum aestivum
  unsure (1)..(557): unsure at all n locations
  Clone ID: PAT_TA_98751
atttgtttgcaatgccttgcttatcaaaataggcctttctgtaacctgaccttacgctgaaaaactgcacttgttggctctgcgtccactgaaacttatgaaaaagaaatgttattctatcgatatcttcaagagttccctaaccccctgactgagagtgctatgatgggctattgaagttcgtccctgcggcacggtggggcagtgcaaatcctttcattaatgaagttccgccctgacactcccattattggcttccttccctggggaccgctcgggcgaaggcagagcatggaatgatcgtaggggcatccttcctaggtggaaaagacgtgtgtgactaaaaccaggaggagaaatccattttcaaatggcgacagaaagaaaggaatcacgaaatagaagaaaaagtgcactgtgctggcaaatgtggagaataancatccatcctttcatcaatgaaattgttccgttatgggtaacaaatacacatatcaagaagaancaaaccgaaagcacttgcntcaaagaagcaacaattnacaaagaaattcctg

SEQ ID NO: 98752 - DNA, 567 bp, Triticum aestivum
  unsure (1)..(567): unsure at all n locations
  Clone ID: PAT_TA_98752
cttcgagtgcagatgatgtgaggccaaaatatggaggcagaaggaattgtgatgggcggcttaccctaactttccgaatgtacgatttaggagtcacactggctgaatgattaccatagggaggttgaataactggtgtagcaaattcagggctggtggggtggtctagaagaaaagtgaagggagttatcagagttgggaatgatggaaagaaatattatggggaaacaaaaaaagaagttatcaagagtttagaacagtaaattatcaacatgaagataatgatgttatcaaggttggcagtaggaaaaagtttgttaaataaaatcttcctatcagtaccttttacagacccgtattttgcttttgttctaacagtggcacgttcgacttcttcaacccacataattacatcagcgtcttcaacatacgcatcataaactcgaaatcgacgctcttcaaaaagttgcgatcangtcagtttgtgaactgactaaaaggaacactactacaaaaaaggctatagatggaatggccactaatngcgcacctgtcaagttgggcccc

SEQ ID NO: 98753 - DNA, 567 bp, Triticum aestivum
  unsure (1)..(567): unsure at all n locations
  Clone ID: PAT_TA_98753
cacaacaaccattcccccaacaaccacaacaacctttccccctacaaccacaacaaccattccccctacgaccgcaacaaccattttcccagcaaccccaacaatcacaacaatcatttccccagccccaaccccagcaaccccaacaaccatccatcctgcaaccacaacaaccatttctgcagccccaacaacaattatcccagcaactagaacaaacaatttcccagcaaccccaacaaccattcccccagcaaccacaccaacctcaacaaccatatccacaacaacaaccatatgggagtagtcttacaagcatcggtggccaatgaaatgaagacctgtaatacaagacggatggatcatcgttgtttagtcaatgagtgttcaatgtaacgatgataaataaagtgatgtgcaccataatgtgtaaccccgacctatactagttcaaacatgggaataaaagacaaaggaagttcttgtcaaaaaaaagnaaaaaaaaactccaagggggggcccggtaccaanttgncctaaagtgagtcgtattacgcgcgcncatng

SEQ ID NO: 98754 - DNA, 300 bp, Triticum aestivum
  unsure (1)..(300): unsure at all n locations
  Clone ID: PAT_TA_98754
aacnagtanatcgacaggactgggaagagatttgctccacangttcangaccaancaacgatgaagaacancacgcttgtggngatcctggtcgtcctccaggccatcatggncataagaatcctctcacacgccgccgntgacaatttccccaagtgctgcgaccactgcaactcctggtcggggtaccatttctgtgacnacgtcngcnccaggtgccgcgacggctgcttcaantgccacntggtgganacgagccccgtgaatacgttccggtgtgnagatggacgccccgtcctc

SEQ ID NO: 98755 - DNA, 569 bp, Triticum aestivum
  unsure (1)..(569): unsure at all n locations
  Clone ID: PAT_TA_98755
agccaacancaaccacaaccatttccacaacagccaccatgttcacagcancancaaccaccattatcgcagcancaacaaccaccagttttcacaacatcanccaccatttttgcagcaacaacaacccgttctaccgcaacaaccaccattttcgcagcaacaacancaatttccgcagcaacaacaaccacttttaccgcaacaaccaccattttcgcagcaacaaccaccattttctcagcagcagcancaaccaccattttcgcagcancancaacanccaattctaccgcaacaaccaccattttcacnacaccagcaaccagttctaccgcaacaacaaataccatctgttcagccatctatcttgcagcagctaaacccatgcaaggtattcctccagcagcaatgcagccctgtggcaatgccacaaagtcttgctaggtcgcaantgttgtggcagagtacttgccatgtgatgcagcatcaangttgcccggcaagctggcnggcaaatccccgaacaatcaacgctacgaatgcaatccggtggcaacatnctacnn

SEQ ID NO: 98756 - DNA, 578 bp, Triticum aestivum
  unsure (1)..(578): unsure at all n locations
  Clone ID: PAT_TA_98756
cagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgattcgtcaagctggtgctcagctcatccatccacgtggagttgaagcgcgcaacctctatccctatgtantatggtcactanttatgcgaatttatactgaatatgaataanaaatccctccanctgggttgctggtaanccccctggagggaatnaattanccgngttcccgaaaanttgaaantttgtnccaangggcn

SEQ ID NO: 98757 - DNA, 549 bp, Triticum aestivum
  unsure (1)..(549): unsure at all n locations
  Clone ID: PAT_TA_98757
ccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgaagccangtcctcctaacangcaagcctcaggggacaatatccatcanggccaagggctccttcagtcatctcaagcaaaaacccaaanggccaagggctctgtccaagcctcaaaaactngcccangtttcaaggaaattaagggacntnacgctggaaaacnctgctgnnatgttgaatggtccaaatncctccaaaatggtcgacaacaattggncaatttggatctt

SEQ ID NO: 98758 - DNA, 557 bp, Triticum aestivum
  unsure (1)..(557): unsure at all n locations
  Clone ID: PAT_TA_98758
ttcaccttcaaactagacctgttctctttggaaactcgtttctttctcgcagatggtttgatttctaagcaatgtaggtcataagttttgcgaaccttctcatctttttaacacgcactacggggatcatatgatgacgcgatgtcaagtttcaatattttgggagttcgtttgtattttttttgactcaagtcttggcaccctcatgtttggaattcatttcctttttctgtataaggcctaaacatagactccagaacacaaatatgagtttccaacccagttttgccaaccttttcacgcacatgcagttcaaatttggattatatatttcaaatgtctagaaatgcacattatgacataaatattgcaagccaactccgaaagatgccaaatttttacacagataatctaatggtgtatctttgagtgtagaaaaaatttcaaggccaacgggatgaagcatcgatcacattcanttatgtcctataaaagaaaataangcaataaaagnataagatagcataataaagaggaaacaaataatgtncaaaaga

SEQ ID NO: 98759 - DNA, 582 bp, Triticum aestivum
  unsure (1)..(582): unsure at all n locations
  Clone ID: PAT_TA_98759
ctaatcaaagacacatgccgcctaccaccctacaaaccatacccattacctgaccttttgcggtctgggggcttgacatggttggaccccttaaaggaggaacgcacaagcaaaaaaatctactggtcatggtggacaaattcaccaaatggatacaggacaagcctgtaaagacggccgaatccggaccggtgatagacttcatatccggggttgtacaccattacggcgtcccccacagcatcatcactgacaatggcacaaactttacggccgatgaagttaaactctggtgcaaaaacatgggcattaagctcgactacgcttcagtctatcacccacaaactaacggtcaagtcgagtgagccaacgattctcatcatgagcggcatcaaacccagactagtgcgattcctcaaggaatctaacacgcactgggtagaggagctttgactccgtactcctggggggctgcggaccaagccgaatcgcactancggattcacaccatccntttatggtatacgacgcacattcagtcctgcctgcgacataattcatgactcactcccgtgcgcatgt

SEQ ID NO: 98760 - DNA, 516 bp, Triticum aestivum
  unsure (1)..(516): unsure at all n locations
  Clone ID: PAT_TA_98760
ggggatcacaatcatccaaaagtggacttggttctaggagtggaaattctcacatggaaaagcaagagaggactaatcaggatatggtacctgagcaaaccaacaggtatgccagccgtagaaatcaggtgggaggtgacaaccaaggcagacccccgcaggacccgagaagaaatgagaatgaaggccgcaaccgtttcaacgacaatcgaaggcctttggaacagcctagcccgccaccgccaccgccaaggttcagccaaggcagacccccacaggacccgagaagaaacgaaaatgaagcccgtcaccggttcaacgacaagcagaggcctttggtacagcctagcccgccatcgccaaggttgagccaangccgacccccacaggacccgaagaagaaacgagagaggaagccattccccatcnaataacaaacaaggtgccgcgantccaacaatcnaatcagaacanttggaccactaacaggccnggacccaagggaatccngactcc

SEQ ID NO: 98761 - DNA, 482 bp, Triticum aestivum
  unsure (1)..(482): unsure at all n locations
  Clone ID: PAT_TA_98761
agtcgctcttccccaacctctgctctctcacaagatgggcaagccctagcagtccccgctgccggcaactccttttgcccatcacgtcactctacgccgatgagatcccgccagccccctcacgctccatgagctcgcctcctgccccccccccccttcttggcatggattaattgcatcaccacgacatcggcccctccaactgccctagagcccaccgttgttgcccttgcctttgtgactccactgtccgagtaacctttgctggctgcatccaagccgccccaaagcatactcttcgccctcttgtcttgctatgtctcttccattggcaatcccatatttgtccctttgacaacatatctatcctcaatcctaatctactttggtcccttgggaaccgaatgtttggttgcaataaggtgagttgantggcctggtttggcnaataattggagttgattcttgcaatcnatttacaa

SEQ ID NO: 98762 - DNA, 555 bp, Triticum aestivum
  unsure (1)..(555): unsure at all n locations
  Clone ID: PAT_TA_98762
catctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcaacatccccccaagtgcggtgtnaacctcccatacaaccatcaagtctcaaaatcgactggaacaangggtgttatgggccaacgattcgtcaagcctggtgctcaagctcaatcccaaccaacttggagntttaanccccgcaaacctccnaaccctaatgttntaangggcaactaagttnatgcnaagtttaaaactgaatatgnatg

SEQ ID NO: 98763 - DNA, 563 bp, Triticum aestivum
  unsure (1)..(563): unsure at all n locations
  Clone ID: PAT_TA_98763
aacangttccccagcctcagcaaccacaacaaccatttctccagccccaacaaccattcccccaacaaccacaacaaccattcccccagactcancaaccacaacanccatttccccagcaaccacaacanccatttccccagactcaacaaccccancaaccatttccccaacaaccacaacaaccattcccccagactcaacagccccaacaaccatttccccagctccagcaaccacaanaaccttttccccagccccaacaacaattgccgcagccccatcaaccgcaacaatcattcccccaacaacaacggccattcattcaaccatctctacaacaacagttgaacccatgcaagaatatcctcttgcaacantgcaaacctgcgtcattggtgtcatccctctggtcaataatctggccacaanngcgattggcaagtgatgcggcancantggctgccaacaactagcacagattcctcaacaagctccagtgcgcagccatccatagcgtctgcattcatcatcatggagcagcagcaggancaanaacatng

SEQ ID NO: 98764 - DNA, 181 bp, Triticum aestivum
  Clone ID: PAT_TA_98764
gtctaacatcgacctcattttgggtatggattgattgaaagcgcatactgcttctatagtttgcgccactaagaccgtccatctgctacacccttcagatgaaatagttgcttaccaagctcatctggtgcaaaatgccgaggcaaggctctatgcattgaatgcattgaacgctgcacca

SEQ ID NO: 98765 - DNA, 550 bp, Triticum aestivum
  unsure (1)..(550): unsure at all n locations
  Clone ID: PAT_TA_98765
gtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggaganggagcctgagaaacgntaccacatccaangaaagnaacaagcgcccaaattaaccaatcctgacaccgggaagtagtgacaataaataacaataccgggcgcantaatgtccgggaanttggatgagtacaatccaaatcccctaacnaaggttcattggagggcaaatctggtgcaacn

SEQ ID NO: 98766 - DNA, 562 bp, Triticum aestivum
  unsure (1)..(562): unsure at all n locations
  Clone ID: PAT_TA_98766
aacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccangtcatctcagcaaaacccacaggcccagggctctgtccagcctcaacaactgccccagttccaggaaataaggnacttaacgctgcaaacgctgnctggaatgtncaaaggtctaaatccctccaaaatggctccaacaacaattgcgncaatttgnaacctccngtactaactggggaaagagnagnactccnagtaccaagatnttttggaaaaaccggntttcttaaacccaaaagtttggttcnttgtagcngnng

SEQ ID NO: 98767 - DNA, 542 bp, Triticum aestivum
  Clone ID: PAT_TA_98767
ggtccatagatcgcatctaccttctcctctacacctatccgcgttgcagccctcacctcgccggtctcctggaccatggcttgtccatgatgcttcctgcaagtcatcgatagcctcgaccacggtgcggctgcactgccgccagtagcctcgaccctggggcgcccgtgctgtcgcctgcacgtcgccggtcgcctcgacgccggtgtggccacgcagccgcctgcacgttgctggtagccccgcccccggtgcgcccgtgctgtcgcctgcatttcatcggtcacctcgatcctggtgcggccgcgctgccgcctgcacgtcgcccgtagcttcgaccccgatgtgccggcgctaccgcattttcatctccattcgctccgctgctgcaggaacatgatatgagtgagctcaacaaaggctttttggcactatcacatggtccattggaaaacgtaacatgtgttactggctatgacagaaatagattcagatgtcgtgttcaaattcaagttagactcctatgcacacataccagtggg

SEQ ID NO: 98768 - DNA, 432 bp, Triticum aestivum
  unsure (1)..(432): unsure at all n locations
  Clone ID: PAT_TA_98768
gccacaacaaccatttccgctgcagcagccacaataccagcancaacaaccgtatcaacaacanccattcccccagcaaccgcagcaaccattcccccagcaaccgcaacaatcntttccccagcaaccanancaaccattcccccagcaaccgcancaaccattccccctgcaactgcaacaaccattcccccaacatccacaacaaccattccctcaanaaccacaacaaccattccccctacgaccgcaacaacgatttccccagcaaccccaacaatcacaacaatcatttccccagccccaaccccagcaaccccaacaaccatccatccttcaaccacaacaaccattaccccancaaccacaanaaccatttcagcagccccaacancanttatcccagcaaccagtacananantttcccagca

SEQ ID NO: 98769 - DNA, 554 bp, Triticum aestivum
  unsure (1)..(554): unsure at all n locations
  Clone ID: PAT_TA_98769
aaaactatcaagaggatatatgtgtgaatttgtcagataaactttattatctaagccactagttctgatccgcttaattgtacccgtattgcacaaccacatacccaccacgacgatgcaacattcatctgcagcacctatcctagtctataccatgacttgttaattaattacatgatagctgaaaggttttctgtcggtctatattagtgcaattaggatatgctaggtgtgacttatgtctcacattctaagtattatgattagtttagcactatccaggatgattggcagttatcaatattccaggtaacaaccacaattttttaacttatgtcaattataatattccttaccaaacatcccaggaaacttatgctccttgatttatccatgcaaaattgtgtttgatcctcttaagttagctaaatccattactatatccataantttagcagaaaagatnttgcaaacannataacacactaagtgcanaggtgagcntacctgaagcagtactaaatatcaagattgggttccaagatcacgttgnt

SEQ ID NO: 98770 - DNA, 540 bp, Triticum aestivum
  unsure (1)..(540): unsure at all n locations
  Clone ID: PAT_TA_98770
ccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgangacaaacgcccgcagcatccccccaagttcgggtgtcaacctcccattacaacatcaagtctcaaacaatcgactgcancaagggttgttaatgggcgacgattccgtccaanctgggtgnctcaagctcaaccaatccaacntggagttttaagccnngcangcctccnatccctaatgttnnaatgggcaactagttttgcgaattttaacct

SEQ ID NO: 98771 - DNA, 497 bp, Triticum aestivum
  Clone ID: PAT_TA_98771
tgatattatactgaaactggcggacatccttcaagctggcaatctccagaatattcaggcattaactcgagcaagggtcccaatagtgaagcttatggatccggatacaggcctttcctgtgatatatgtgtcaacaatcttttagcagttgttaacacaaaacttctgagagactatgcacaaatagatcaaaggttacggcaattagctttcattgtgaagcattgggctaaatctcgtcgtgtaaatgaaacataccaaggaacactatctagttattcctatgtaataatgtgtatccacctcctacagctgcgcagaatactcccgtgtctacaggaaatggaggcaacttgttatgtcactgtggatgataatcattatgcttattttgatcaaatggacaagctaagtaactatggggctcacaacaatgagactctgtcaagtctgctttgggccttcttccattaatggggcgtaccaacatgataca

SEQ ID NO: 98772 - DNA, 501 bp, Triticum aestivum
  unsure (1)..(501): unsure at all n locations
  Clone ID: PAT_TA_98772
cttctctcatcatctcaacacagccttaccaactacttctcttcactattactgccggccagttcctttaatcctctaccaaattctcaacaacaaagtcatcaagatgcctacttcccagatctccactcctctcaacggtgtcgacgccgccgtcgtcattgccgccctccacaaccacgatctcatgatcaagaccctctgcccagcgctcgtcagctacgctttcgagtccggcgacaagactacgtgcgctacctacactgtcaccgacaagaagcccattggtcagacaacctacaaactcaccctcaccaacgtctccgagggtgtcgactccctcgtcaacgccaaaccccccgttggtgtccttaccatcagcggcaagtggcgtgtgactggcggcaagctcagcgaggagattgacattgacgccaacttcatgatgaagaaggttgctaagaacaatgttgagaagactcaaccggnggaagcacatgn

SEQ ID NO: 98773 - DNA, 506 bp, Triticum aestivum
  unsure (1)..(506): unsure at all n locations
  Clone ID: PAT_TA_98773
gaatcacaaaaatatctgaagtggtaagtgtcgtaaataatgtgaatacatctgttggcaatacatccgtgggtgagcaagaatataccttgtacgggaaaccgaccattacagagatgttgagaggacttacattccagatatctgccaactcctttttccagactaatacanaacaggctgatgttctttataagcttattgaagattctgctgggcttaaaggagatggctctganattgttcttgacttgttttgtgggactggnaccattggggctgactcttgctaaaagtgcaaagcatgtttatggctatgaagttgtccccgaagccatcgcggatgcccaaaagaatgctcaagttgaatggnattaagnaatgctacatttgttcaaggagaccttnacaaaaatcaagcganacanttggcaaaggaatttccaaannctgntataatcatatcaagattctaaatccggncaagggatgcacatgaagnttaa

SEQ ID NO: 98774 - DNA, 500 bp, Triticum aestivum
  Clone ID: PAT_TA_98774
gacaccatgaagtggtcgagcattcttctcacgcttgcagcgacggttgctgcagcgccgcctaagccgcctaaaccatctggccctgcaggccctccaggatacccgccattacctccatccaagccaggacagcttcccagcagtttcaaatggacctccaccggagttctagttaccccgaaagatgacgaacgcaagattgcaggtgtgaaagacccttcgatcgtcttctacaagggtgcctatcacgttttcgccagctctgcaaaagcagagggctacaatctgctatacttcaacttcaccgacattgccaaagccaacgatgccccattcttctaccttgatcaagccccacttggaactggttatcgagcagcacctcaggtattttacttcgcacctcagaagctttggtatctggtctaccaggacaacaatgctgcttacagtacaaacccggacatcagcaatccaactggatggacgcgccgaaa

SEQ ID NO: 98775 - DNA, 151 bp, Triticum aestivum
  unsure (1)..(151): unsure at all n locations
  Clone ID: PAT_TA_98775
ncggaaccgtagacgaagcctcggacggaacgatacagcagagaagccttgggcggggagcgatnggaangtacatancaagctancacgatggggcagcttagcaagaagcttctgntggcgtncatggtggcggccgtgctggccgtgg

SEQ ID NO: 98776 - DNA, 285 bp, Triticum aestivum
  unsure (1)..(285): unsure at all n locations
  Clone ID: PAT_TA_98776
ctcgctcgctccacccaccaccaccaccaccgcaccctcntccctcctccctcgtttcccccgcgtccgcgtgctgtagcagcttancgccaacccacganntcaatccccaatccctgcctcntccgcccgccaaccctagccccgcgccctcccgcatggacgacgacgannccgggggnggnggcgacgcgtccncgcagnangagggcggtggcngtgcggtggtgatcgagcgcggggnnggggcganngcgcccgcgcgggacgccgnggcggnctcgc

SEQ ID NO: 98777 - DNA, 497 bp, Triticum aestivum
  unsure (1)..(497): unsure at all n locations
  Clone ID: PAT_TA_98777
cccaaatctcctcagcctccctgccggcgcatctccgactccatggcccgcaccaagcagacggcgaggaagtccaccggcggcaaggcgccgaggaagcagctggccaccaaggccgcccgcaagtccgccccggtcaccggcggcgtcaagaagccccaccgcttccgccccggcaccgtcgcgctccgcgagatctgcaagtaccaagaagagcacggagctgctcatccgcaagctccccttccagcgcctcgtccgtgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcaccatcatgcccaaggacatccagctcgcccgccgcatccgtggnnagaaggctangctgcaatctgcaatccatgcgtccgccnggtagattcctggtn

SEQ ID NO: 98778 - DNA, 513 bp, Triticum aestivum
  unsure (1)..(513): unsure at all n locations
  Clone ID: PAT_TA_98778
ccacgatccatccaagttcaccagcgcagagtttgagaaaccaagcacagcatccgcctgctgcttcttgcttgcttgcttgcttctctttctctgcgaccagatcctcccaccgtctcgtctcaatggccgccgtctccgccaagtccattgctctcctcgccgcggtggtgctcgtggcgctcgttgcgtcggcggcggggaggattgtggaccgggaggaggagttcttcctgggcagcctcgccccctcgctcgccccggcgcccgcgccggcggcggcggtcggcgcagcaggcgccgtcgcgcccggggcgtgggccgtggccgccgcacgtctcgctcatcgccttcctcgctcactgangcgtcnctgcgctgcggncagtcatggntgcctantgagagatggnatcctgcactctgaattgcggngaagtcccagtctgtttgnttcgttcagttaantggctggntagactacantagtantggatctattcaattgnngnt

SEQ ID NO: 98779 - DNA, 514 bp, Triticum aestivum
  unsure (1)..(514): unsure at all n locations
  Clone ID: PAT_TA_98779
ctttcctccctcagaaaccctaatcctcccctcccctcacctctcctcccttcccctctaaagacgncgctcgcagcgatgacgccgcccttccgcccgtcgccctcctccacngcccccgccccgcgcggctgcngcggcgagcgctgcgcctcnggncgcgacgcctggncgctccaccacgtccgccacaacgacgtcntctgncgcctctgntcctcctgcgtcctcctctaccaacccgcctccttctgctccgcctgnctcctcctcctccaacacggacggacgncgccatcgncgctcggacgccgccgggcangacccccaattcgaccccgccgtcgcnccgncgggccccaacgccnagtgctccaattgcgggctcttcggacggccaagtngcctgngtcccggggaccgtctccttcgactggccgtcgtgcgncncggagggacgaggggcggcncctnaactangngccnggccggtcggcgagttaanggacaacgg

SEQ ID NO: 98780 - DNA, 178 bp, Triticum aestivum
  unsure (1)..(178): unsure at all n locations
  Clone ID: PAT_TA_98780
atcactctcgcttgactccttggaagcagagagaggaggaggatncaatnaatcatgaaannctcaaagntgtngatgcncagtanaatgncagtcacctaatnacacaaagagaggctgtgagcacagatatnacgaatattctgacagngagggcgaaccacttcancatngctct

SEQ ID NO: 98781 - DNA, 510 bp, Triticum aestivum
  Clone ID: PAT_TA_98781
ctcctctctctcgatccaactcctccctgctcgactcctcatccccctgactaggatttcagcggcggcagtgccctcttaggaaccctaagcgtgaacccgcaaacccacctagtgagcgacatgctcccgtgtagccctagatggccgccgctaccaccgtttgctcttccccgcccccttgtcatccttcagtgccgcctctaggtcaccatcgccgtcacgactatgaactccaagcgtgcccgtgtgaggcctccagcaccacccgccgcagtccccctgatcctttcctccctccctgtctgccgatgcagacggagatacaaaacatgggatggagatcagatggtgggctctcgctccacatgcgcggcggtggacttttccgcagtaagggcacagagatagttgaagcaattgaggaaccgtcggtgcgaagccggggcttttgaattctagacgtgggctaccactcaaaagtaacaataactgaaatgaactgtatgt

SEQ ID NO: 98782 - DNA, 505 bp, Triticum aestivum
  unsure (1)..(505): unsure at all n locations
  Clone ID: PAT_TA_98782
ccgcagccagcccagctccgatggcccgcaccaagcagactgcccgcaagtccaccggcggcaaggcgccgaggaagcagctggcgaccaaggcggcccgcaagtccgccccggccaccggcggcgtcaagaagccgcaccgcttccgcccgggaaccgtcgccctccgggagatccgcaagtaccagaagagcacggagctgctcatccgcaagctccccttccagcgcctcgtccgggagatcgcccaggacttcaagacggacctccgcttccagtcctccgccgtctccgcgctccanggnaggnccgaggcgtacctcgtcggcctcttcgaggacaccaacctctgcgccatccacgccaagcgcgtcaccatcatgcccaaggacatccagctcgcacgccgcatccgcggggagcgcgcctaagctgttcgtccggccgccaacgccacggttccatcctggttgatcctgattggattcattcgtctgttantcta

SEQ ID NO: 98783 - DNA, 505 bp, Triticum aestivum
  unsure (1)..(505): unsure at all n locations
  Clone ID: PAT_TA_98783
cttctctagaagaactgactgacacaataaagcgcgccgccgcccaggtctcctctccattgcagttgcagcctccgcctggctctggctggatcctcagcccaccgccgcttcgacccggaagcgaatttctctccttcttctgcgttgctatcggagaacggttaacatcagttgacactctatcaaggtgcagacacagctgctgaccaataatttgggtcatgtctacccccgcttgcaaagacagggctaatcttgacgacaaccatcccaacgggcgacgtgccaagtccaagcatggtcacacagatgatcccaataacccgtttaaccccaagaaccgcggaccattcatcatgtgtgccttcttctttacatttataattttcctctgctgcatgattgtgatcgcagctgtcaacgaggcccaaccacctggcgttggggatctcctcgtccgacttataagcaaaagtgggcntgatnctggaactccnccngc

SEQ ID NO: 98784 - DNA, 241 bp, Triticum aestivum
  unsure (1)..(241): unsure at all n locations
  Clone ID: PAT_TA_98784
gaggagagagagagcgagcgagaggagcctcggccgccatgggattcatcatggagttcgcngncaagctgatcctgcnnctgatggncgncccggagcagcgcgacnaggagcancgngcgcacgtctancggatgaangngcggtgngagngcaccaangcggtctgagngctcgcgctcngccnctacngcttctggaccttcganngcttcaactcccagctctcctgggacaccca

SEQ ID NO: 98785 - DNA, 301 bp, Triticum aestivum
  unsure (1)..(301): unsure at all n locations
  Clone ID: PAT_TA_98785
gctccggcggcatggagatggcggccgagaacggnggctgcggctgcacccaatgcaagtgcggnaacaactgcgggtgctcctgctgcaactgctagatnattgatcatccatnatgcatgcaacgcgcgtggaacaaccgtnaatatcgattctaactactaacataccaatgttaaccgctacctgattcgaagggccttatctatgcacctgacctgcatcaagcaagtcaggtgccatgccatgcttgttgtaaacaaggccccctaaataaaaatctccctggnttanctaaaaa

SEQ ID NO: 98786 - DNA, 237 bp, Triticum aestivum
  unsure (1)..(237): unsure at all n locations
  Clone ID: PAT_TA_98786
tgtggtggcgaagannncaatggtggaactggcntccatttggcatccctaaggttctnggaataaactnctncaaattctgnggaggtgaaggtaacngcgctccgaaggcccggncaacnaccgtcggctgggtccgaaagncccatggcgccttanaagtnagggcatgggaagttccggtctccaaccngatnccacagnntgcctngtgnccgcctgggtggcatggtcctg

SEQ ID NO: 98787 - DNA, 461 bp, Triticum aestivum
  unsure (1)..(461): unsure at all n locations
  Clone ID: PAT_TA_98787
ggattattgtctacatacttggcagnggtagctacagcgttctttcatctaanaatgctatcaattacatttgacaanggagtctcatttttaagtttgactgactttttgaccnttanaccccgtatgccnacagnagannttacggagggccctngtngataaagtttggtnaatcaacaancaacctttanctttcggttttccnaattnaggacgtcancaanggattaatacaaggatttnaaaatttggcaggggataanaaagcactgatgaangantaatggcaattgnattcccacatcaaccctcngcaatttttgaatccngtggggtcgcctaatacgggaaccgaacgggcaacaagnttgnattaagttaanttaaggaatttcccaaaactcnatggaactncgcttggnaagttaaanttccccggttcncaaaanggaaanttg

SEQ ID NO: 98788 - DNA, 510 bp, Triticum aestivum
  unsure (1)..(510): unsure at all n locations
  Clone ID: PAT_TA_98788
gaaaggagacaatgcgcttgataaagcttgtcatgagataatgaaacaatagtgtttattttgtcaccaagcangatgatgatgtgaagaatgnctatttgcgcattcaagagnttccaccattaantagtttcccaaaaacagaatatttgctaataatggtaagctaaanatgagatacttatgctggntgaatgccttccctttttaaaagtaacaaccaatgttgtccaagcatncgtagaatcattagnattttccttgggctngtttattggangtncgtncttagggtttgggaaaatcctttagctatatnccttgcctcaagcgagcatgagcaatancttctttattccgcgtggccgccaagttnctcnattttagatggttgaacctttncgcttcnaaaanggataggnatttattaaccngacaanactttgnggaaggtaaaaccngaaggntgttctgaggtaacaaccngnttggaaattttgaattcnaaac

SEQ ID NO: 98789 - DNA, 267 bp, Triticum aestivum
  unsure (1)..(267): unsure at all n locations
  Clone ID: PAT_TA_98789
atctgattctgccccctttcntcctcccancgatcctgaagagctcgcaacgncggcggnganagccangangancggcggggangtcaaatccttcctccgggaacaaaanggccaatccggggcngggggcggcaacaagcccgncgggggggncnccaagaanggggggnaacaacaacaaaagcaagcngnggcgggggggnaactcctccggccgatacnaactgngggaaattancgcgacggggctgaanccngggagga

SEQ ID NO: 98790 - DNA, 601 bp, Triticum aestivum
  unsure (1)..(601): unsure at all n locations
  Clone ID: PAT_TA_98790
acagggataactggcttgtggcagccaagcgttcatagcgacgttgctttttgatccttcgatgtcggctcttcctatcattgtgaagcaaaattcaccaagtgttggattgttcaccancaatanggaacgtgagctgggggtagaccgtcgtgagacangttaagttttaccctactgatgacagtgtccgatagtaattcaacctagtacgagaggaaccgttgattcacacaattggncatcgcgcttggttgaaaagccagtggcgcaaagctaccgtgtgccggtttatgactgaacgcctctaagtcagaatccaacntagcatgcgacgcctgcgcccgccgcccgccccgacccacgtttagggggcgcttgcgcccccaagggccccttgcaattggctaagccggtccggccgaaattgccnccggtcggccgcctccaaagttcccttccnaacgggcggtgggcttaanccntttgaagncgaanttaaatacccnaacgggggaatnttaantgggaaaatgggcctttcggcaaanttcaaatgggattcaancccattntcaacgggttcccccccaaanaaaaa

SEQ ID NO: 98791 - DNA, 650 bp, Triticum aestivum
  unsure (1)..(650): unsure at all n locations
  Clone ID: PAT_TA_98791
agattagccaagcatcatcaaccccgggaccaacgcaagcctcaaggtcgcccaanttggccttcctccctccccaatcggccggcaacgaactggnaaccaaaccgaagancaagagggggaatggggatgggcagcggcgaaggaagaagcctcctgaaacaactccggggngcggtggggcggccccccgtcggaagggggaaaacgtcccgttcgcaangctccctggtccttcaaactcggaagggggntaaagggtcgntcctcnacaaagggcgaaggccccccaccggctcctcctccgtcatcaagaactttcanaaanatttgggncctcccaanggggnccccnaaaagngcaantttccaaaagggcctcgggctgggnaaancctgggcantgncccaaattttcaaagggccnttttggggaanaantcaaantttccgaatttcccngnaaattntggnaangaaaanttgntcccacaaanttcgggaaatcgnattttaatggcccccaaaccccaaaccaaanttaaaattncntttaaangggtttcttgggtncccccnttggaananaanttttcccaaaaaggaaggncccccnaaaagnactgntntttcccaannggggaaanttn

SEQ ID NO: 98792 - DNA, 592 bp, Triticum aestivum
  unsure (1)..(592): unsure at all n locations
  Clone ID: PAT_TA_98792
tccaaacattccaagctcgaagagagtgtgtggtcaacacttgggccacgcatatagtaacttcccaccatcgttgttgttgtcaccgacagtatgaaacgaggacggnaagccttccttggtgacgaccagggggccacagaagagacatccttcatagtgatctcgattgtaaggcgcggaaataagcaaggggcttttgtcttctcttccgccaccggacaatggcgaactagtatatggactgcaagagtttggnttcctcttcanggtttgggnacacaatgggatgcttccnatggggtgaccaaaatgcatgaaaaaagttgctaacactttgcacccagaggatggaggtcccaacttccngnctccaacccgaanccgggaatttttggaaaaaaccnnaagtnccttggaancaattnnggatatannccatgtggangcaaagggaaaggatcactgggatgttttgtgctctcaaatgggacanctnncatcanatntctcatttnggngacaaaggggggngntcccccacngggacntttgaanacaatcccncaggggtctcctcnnncaattttnn

SEQ ID NO: 98793 - DNA, 622 bp, Triticum aestivum
  unsure (1)..(622): unsure at all n locations
  Clone ID: PAT_TA_98793
gctgttcggtctttacgcaaaatgtcggtaaccgacgacaacaacggcgacatcatgtccatccccggcgncgagggacaaatcganccgggcacgtttgagcaagattctcgaaatgggacgaggacgaaggttgaancgccaagttaatcaaaaagcatccgtctacgacttcttcggncaaggccgancaaacctttcangaaggatgggncaanggaactcnagggcgaanaaanggaacgnaaaatactcannagagcttaacgagcttggggcanttcctcaagggctcgtccgccacacttgggctcaccaaaagtcaangnctcctggcaagaagattcancactacgggcaacttgaagggcgatncaaggaacaaagggcatcncaagaaagagcaaggnacaaggggaacctcccccaagattatcanngcaaggcaaaaaccnnaattttntgatggttaccgtcatcccccaaaaaatttctacgccgattcaaatattcccttccctggcgnccctggccctgtggccccctgttgccanaaccacncccacaaaanggcacgacaacgtttaaggcttgcaaaactggngctacngggcgaaganct

SEQ ID NO: 98794 - DNA, 635 bp, Triticum aestivum
  unsure (1)..(635): unsure at all n locations
  Clone ID: PAT_TA_98794
ggcacgagcacaccccaccccaccacaccctcgaatcaccaccaccagcagcacccatggcacccaaggcggcggagaagaagccggtggccacggccgagaagacgacggcggggaagaagccaagggcggagaagcgggcgccggcgtcaangaaggccggcgggcgaagggaagacgaggggcaagaagaagggcaacaagggcaagaagagcgtggagaacgtacaagatttacatctttaaagggtgcttgaagcaaggttgcaacccaagaacgttggggatcctccctccaaaggccaatnttcaatcaattgaactcctttaatcaaacgaacatncttcgagaaagcttcgccggggaagtcggcaaagcttggcccgcttacaacaaagaaagccaacaatcannttncccggggagntcaanacttcgttcggctnctccttccccgggaacttcgcaancaaggcgtttncnaaggnaacaaaggcgtnaacaagttnaactnctcctnaaaaacttnagcnttgttctcntcccttcaagcntcnggttgttcctaatttggaatatgngttcaancccttttaaggatnggttcctnctccccggcntttaaaaaanaatt

SEQ ID NO: 98795 - DNA, 427 bp, Triticum aestivum
  unsure (1)..(427): unsure at all n locations
  Clone ID: PAT_TA_98795
agcgancgccgcgagcacgagcacggcangggnangcggagcgaggaagaggacgacgaccagcggcatnaacgccgacgncncggctccggctccgagtccgagtccgantccgaggaggancaggaccagcagaggtacgagacngtcngcgcgcggttgtcgcgcggctcggcgttcgtggtgccgcccggccacncggtggtgganatcgcctcntcccgcggcagnaccaacctccangtggtgtgcttcgaaatcaangccgagaggaacgagcggntgtggntcnccgggaggaacaacntgatcggcacnctgganaagccccgcccaaganctcaacttcggnangcccgccaaggaagtgcatgaggtgttccgcnccaaggaccagcaagncnanggcttcgtcgccgggcccgag

SEQ ID NO: 98796 - DNA, 559 bp, Triticum aestivum
  unsure (1)..(559): unsure at all n locations
  Clone ID: PAT_TA_98796
canaagggctcatcccaggcgctcgtagacatgatgaacaccgtcagcaacaccttccccgacccatctgctctcggtaccttcttggncaaccacgacaacaagcgctgggtcaacgtgaagaacgatnaagaccctggtcaagaacgccctggcttaacgtcatccttggaacganggtattcccaatcctcctaactaacgggtaccgnaacaaaggataccctgggcgggtgacgaaccaagccaaccgagagggaccttatggcgaaacgggtttcaacaacaaacgcgaacctctacnaggccatcaagaagttgactgccgcgaaggaagtctgcaggaggtcttgccgctgatgacaangttcacttgtatgtaccgggcaacgcctangcctggaanccgttcaagggggnaacccttaacggtccttacaacnaaatgccgggagnaaatttcaancaagnangaattgnntnaaaaacccaaaangggcaaaggggnaatggggaaaagtcctacggggaacngggcccccgggnntgnccccggaaa

SEQ ID NO: 98797 - DNA, 229 bp, Triticum aestivum
  unsure (1)..(229): unsure at all n locations
  Clone ID: PAT_TA_98797
atgtaatattattatgcaactgctgtagcacttctgtatcctgccattgcgaagttgggtaatttcttgtggcagctgcaaaaaaggacgccagccagctcttgtggcagatcacagtgaataattttctcgcccaatcaagctaaacgaagaagcggtcttccaagaaaaaaaaaaaaaaaaaaaaaaaaaaaaaaaaaaaaaaaaaaaaaaaaaaaaaaaaaaaaan

SEQ ID NO: 98798 - DNA, 523 bp, Triticum aestivum
  unsure (1)..(523): unsure at all n locations
  Clone ID: PAT_TA_98798
aatttctacaacaagggattgtctgtttctcatgttgcctctagcaacagcagcaatactgggaagctggctactagaagctcagttatgcccaattcacttcaaaataatgcaaaacccttgcaggctgctcaggtcgcatcgaaaagaggcgcaggtcttaccaagtacaagcaatggatcgcagaacaaaaggaagcagctgagcacaccagcggcatcagttggaagtagccagattagaggatctatgcacatatctgcacccacaagtgcaagaagtagcagcagcggcatccgaccttacaaagctgcaaaggcaccccggatttcgaacgggaggaacgcagcgggttaagactgaaatgatgcaagaagtccacaacatatgaaacccattctgttggaggaaggnatgctttgtcaagaagttactgtaaacgggaacgancaanncagaaaggnaatccttgccncgtgatggcaaaaggggcaacctggcgtgtaagagcaagccaagaca

SEQ ID NO: 98799 - DNA, 521 bp, Triticum aestivum
  unsure (1)..(521): unsure at all n locations
  Clone ID: PAT_TA_98799
agctccctcctctcctcgcgcgcagggcccggcgaaagggaagcaagatgtacaccgccaggaagaagatccaagaaggacaagggcgtcgagccctccgagttcgaggacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcangaagatccatgtcaggctcgtcagggagctggagaagaagtttagcggcaaggatgtggnctttgttgcaacaagaangattgtganggcaaccaannaagggttctgctgttcagcggcctcgcacaaggacctgacagttgtcaatganggaaccttgngggtttctggtccaactnnaaatnttgggnaacgngtaaaaaccgttggttgggcaaaggcatcaaaatttnnttggcccaaaggggggaa

SEQ ID NO: 98800 - DNA, 517 bp, Triticum aestivum
  unsure (1)..(517): unsure at all n locations
  Clone ID: PAT_TA_98800
aatagctcagatattctatgtcatcgcaagtatttcagtaacttgcacttttcttttatcgccatggatatttccaacacattctaaagaagcagaaccaacatcctcctccggctccaatcctgaaaaggcgcatggcctcaatcattcagtgttcttgactggagtaacatatacaatgttctggtgcctccttcaattgcttctgcaacaacccataaatgcaattcctgttttgcttattctcttgcaaataatctcgagcgtgatttatttttctctgggagaaatcattgcataggcaatgggtgcaggttgtcgcaatgcaattcttgggaatgaccggccactttggtcttgggaacacgaatagcctcgccagcatcgatgttgctggagctttcattggcatctcaaagctactccacggtcctttctggggtgctgatgttcaacattacatatggggtcanctctgctgttatacctccgggatgggtgggtcacaagtccggtg

SEQ ID NO: 98801 - DNA, 550 bp, Triticum aestivum
  unsure (1)..(550): unsure at all n locations
  Clone ID: PAT_TA_98801
ccgcctccgaggatccgcacaaacccccaaccaccgtacgcaccgcaagcagcggcggcgagaggggcatggaggagctccgtcgccttcggngccgttccccgctgctgcaggcgccaagtggngaagcaacgtaccgtgcctgcaccaataccctacnggnttcncctccgacaacccccgcaaaggccagccccgtcggagatccaagtggatcacctcttcctgangtccgtgccatccttcagagcagngngcggagaatgaccccacggtgccggatgccccgccaaggccgaaaagtttgctcaaaggtacactgatatgcttgaggagttgaagaagaanccaagaggaggccatggggggcctcctggattgcatacttctttgtaaggcttcgtggagctaatccttaaaagnatttgggggttcaatgacatcttcaaagaaggttaaaggacgaaggaagaacgctaaggctaatgtcactgntttgaagggaanttgttcaagcnggatgatgaaatnngaagatgggngagaaacn

SEQ ID NO: 98802 - DNA, 522 bp, Triticum aestivum
  unsure (1)..(522): unsure at all n locations
  Clone ID: PAT_TA_98802
gatcctcccgcgtgccaagccaccgaccaacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccanctctgccctcctcgtctccggcgcgaagcgcggagggggcgcccaagaggctgaccttcgacgaagatcaagagcaagacctacatggaggtgaagggtaccggnaacgcgaaccagtgcccgaccatcgacggcggngtcgactccttcccttcaanggcggcaagtacganatgaanaattctgcctggagcccaactccttcacgtcaaaggcgaaggcatccanaagaacgagcggcgggctttcaaaaagaccaagctcatgaaccgtctnactanaacc

SEQ ID NO: 98803 - DNA, 519 bp, Triticum aestivum
  unsure (1)..(519): unsure at all n locations
  Clone ID: PAT_TA_98803
gatgtcttcgccttcggtgcgttcctcctggaggtcacctgtgggcggaggccgatcgaggaagacgaggaaaacaaccgcgtcatgctcgtggactgggttgccgaacattggcgtcagggttgcatcactaaggcggcagacattaggatgccaaacagctttggtcttgaccaggtctctctagtcctaaaactcgggcttttgtgctcccatcctttgcccaacgcaaggccaaccatacgacaagtcatgcagtacctcgatggcgacatgcccctcccggagttttcaccaagagtacctcggctcaaccatgctggagcagatgtacaagcgcggagttttttaacaagaatgcaatgtcatacgtgtcattgggtgtcatttccgatctctccggaggaaggtgacaaagatgcatctttataacaaacangtgtatcaatgcatgctacctgcttatgatangcgtttcctaacaagattcatgtttaatgcatagtagatgtgcaagtt

SEQ ID NO: 98804 - DNA, 509 bp, Triticum aestivum
  unsure (1)..(509): unsure at all n locations
  Clone ID: PAT_TA_98804
acacctgcaataccaagtgcttgccaaaaaccgttcagctgcttgctgacaagtgataggcttctcggtccattcatcggtcgacacgcgtctggtgaagatggggagggccaactgctcggttcctctcctcctggtgctgctggccttcctctcctgcttcttcctcgcccacgcggcggtggccggggccagcggcaaccgcaagatgttcctgccgagggagggagcggnagccgccgccgggtccaacgatggtgggcaggccatgctgacgacggcggaggaggtggnggtcggaggagagatgcatctgctgctgagcgacgacgaggagatgttggccaaaagggtggaccctgcaagacacaggactaaccggggtccggggccaacgggcggcatgattcacgaaacccgcantaagangtaataagtcctggctggatgtnagctaantgcaaggtntttancgcaagtttaattncccgacaatcaagcctaattta

SEQ ID NO: 98805 - DNA, 679 bp, Triticum aestivum
  unsure (1)..(679): unsure at all n locations
  Clone ID: PAT_TA_98805
agactaaagcccacgggagcaaagcaacaactaagctnatttctggcaatgggcaagctccccngtngcccaacgcccggccngcngaaccttnggcccctngctgggtgggcgggcgccttngtngctggtcctggcgggcaaccggggcgcccgggcgggaggggttgccgggttngccgaaactngccgggccaaggtgggtggaagctaaccttggccccccgttgcaatcaagtttnacgcccaatnggggcaagggggttgaagttgccgcccttgggcgggtggggctggcttgcaagcggggcnttgccgttgggccctttaaacggcgggcggggcttgcccaaaccccccgcccggaanccggcaaaggaaccaacccttgcaanccttgccctcaaaagcaagcaagggcggaagcgggcatanggcgggcaatcaaagcccaaaccctcgttcgcctgggaatcccccgggcaaagttgcgggggtcaaacaatcccctacggccatcaagccaaggaaaccgatttgctccaangtgcgttaagcgttgagattaagaaccatttcagaatgcatggtgaagaagcgaaataaatcgtgggaaccgggcgtccttgctgcaatgggtccaacgggtttaatttaactgntttacaantccacnggt

SEQ ID NO: 98806 - DNA, 152 bp, Triticum aestivum
  unsure (1)..(152): unsure at all n locations
  Clone ID: PAT_TA_98806
gtaatatagactacttggagcaaagtccancacanccccatcccacgtccaagacaagaagcgcctggagcttgccatgggtgncaatccaaatngggaggngtgncaacgggnaaggagaggagggaaaatnctgntgncggtganggacg

SEQ ID NO: 98807 - DNA, 525 bp, Triticum aestivum
  unsure (1)..(525): unsure at all n locations
  Clone ID: PAT_TA_98807
gcactcagcagcccccctcacatcccccccaagctcaacctccccacacgctccaaccaccagcacccatggcacccaaggcggcggagaagaagccggtggccacggccgagaaggcgacggcggggaagaagcccaaggcggagaagcgggcgccggcgtccaaggaggccggcggcgaggggaagacgaggggcaggaagaagggcagcaaggccaagaagggcgtggagacgtacaagatctacatcttcaaggtgctgaagcaggtgcacccgggacgtcggnatctcctcnaaggccatgtcatcatgaactccttcatcaacgacatcttcgagaagctcgccggcgagtccgccaagctggcccgctacaacaagaagcccaacatcacgtcccgggaagattcaagacctccgtccgcctcgtcctccccggggaagctcgncaaagcaagccgtctccgagggcaacaaaggncgtcaacaagttcactcatcctaacaagcttaggcttgtccn

SEQ ID NO: 98808 - DNA, 514 bp, Triticum aestivum
  unsure (1)..(514): unsure at all n locations
  Clone ID: PAT_TA_98808
gacaaacactactagctctagaaggaccgacattaccatcaagtacgccatcgaggtaattcaccaatccatcatcaactatgctttgctatccttagttttgctctttgctgtaaagcacaaagaaaattgaagctatgtagattaattgatctgaagagggtcaaagaggatgtgataacatgttcactgccttantancttccgcttgatctgacactatttatgtccaaacctgggagtatattttttgcttgtcgtcatcacccatttgttgggctgtataagtgtatctgntgtctgatttgctccatcatatttcctgatgtacttctacatatatatatatatanatatatatatatatatatatatatatatatatatatatatatatatatnttggntgtaatctgcttgaangatccaagtacttgatattccattctgttcctgtcagtgaatggngcntgtgttgttggganaactccgttgangacctcntccaagttgn

SEQ ID NO: 98809 - DNA, 577 bp, Triticum aestivum
  unsure (1)..(577): unsure at all n locations
  Clone ID: PAT_TA_98809
aggaggcaagggaagcaagagcaaggaggaggaanaagcagtgagcaagcatccatccaatccgatncatcgaccggggatgtcttcccccaagcaaggcgcangggngatgggtttgnataaanctggtcccctaagtcctaacctacttncattcnnttgtnatctngatgcctttttggtgatggatttggtntgagtttcatggttctaantangctangctttgctttcgaattganttggncaagggatgatngagccgattacaaggtgggncatgattcancgaccgggatgnacgaagntcttcgccnacttcaacnggaccaaangacagtatttaccagggtggtgtgtggaaggtgaggggtgagctcacaannagcttacccctacaaatccccttccattggnttcaacancnangatctatcaaccaaaatgntgatgaagatgtccgggttcgggtcngctttggattgtgatcaaccagacctggagnccaaaggttcgagccttgngantaaccnttganggtngtnctggcccaagcttctcctccnacccgaanccn

SEQ ID NO: 98810 - DNA, 694 bp, Triticum aestivum
  unsure (1)..(694): unsure at all n locations
  Clone ID: PAT_TA_98810
agaggtaatcccaaatcccgcaacaagaaaatccccaatcttcaaaaaacccttagcccttcaanccccgattcccgggcggaagcgaaggaatggccaaaccccgaaggggtngtttctttcgacaattgaaccgttcgggcgggcgccgcccgggcggggggcgcaatccgttgattgggagcttgttacaaaaggaacgccgggttgcccgccgggaccgggtgggganaaactttccggccgcngcttcttgcaaccgggcggaagaaanggggggtcccggcaaagaagcgggnaaaagcccgcctggcaacttacaaaggggcaancggcctttccaaccggcggtgaattcccccganctttcaatgttgcccaaaggggcggggngaactttnaaccaanggggcaaacggggaaaccgggaggggcgaagtccaatctacggggggaagaaagtttnccccgaacgaagaaatttcgtccaaaaagcaacaaccaaaggcccggggaattctctccatggggcaaacggccggggnccaaacaacaaacggggtcccaattcttcaaactggaaacgtcccctggcaaatttggntccaacggnaaagcacgttgggnccttcggngaaggtcctccaaggggcattggcgtcgtcaaagaacattccagaaaggnggggttncc

SEQ ID NO: 98811 - DNA, 658 bp, Triticum aestivum
  unsure (1)..(658): unsure at all n locations
  Clone ID: PAT_TA_98811
gcagctcgaagctctgctcctcccttcacctcggattaataaacttcggcgccgatttttactataatattttaccatgggcgcgtgcaactcgtgcgangcgacggncgtggnggcggtcangggggcctccgcagtgggcgaagccacggcggcaagggtcgtgctcgcggacgggcagctgcagcggttccccgggggcaaccgggcgtcgcangncatgaaggncgcngcggctcccgcgggcgcgtgcttcctgtgnagcngcgacgggctcganctcngcggcgcngtggncgcngtggtgggcgacgaaganctgcaagccgggcaagtctacttcgtgctgccgccgagatgctgcggnnggcgctgcaagcggangaatgggcgcgctcgcattcgcgccaacnncgcgctgggnggngaacaaganggccgctcgtgttcccgactcggcantggngcccccncggcnaagaacggnccnaaggcggtcccgccgcggtcccnnaaggggncaacctcggcgnganttcttccgntttnggncaattccagtaaccctggcttgccggnaaatggttaccaaccgaaccccgnggnggnagaaaaacccgnntagttcngaactatccangngggatttgttgcaagc

SEQ ID NO: 98812 - DNA, 211 bp, Triticum aestivum
  unsure (1)..(211): unsure at all n locations
  Clone ID: PAT_TA_98812
agaaggcacgaccgcacgaggccacgagctagccggncagccacacttttgggagagcaccaaaggnaacagtcttcgcgaagcaactgaaaggggccgatngacccatggcgaacttggatggttaagctccctcgccggcggcggcgtcttgtggtggcgctcggctcgccgttcggcgccgnccaactgaagncggggtactacgcca

SEQ ID NO: 98813 - DNA, 470 bp, Triticum aestivum
  unsure (1)..(470): unsure at all n locations
  Clone ID: PAT_TA_98813
agatngctccccaatctctccaaacccctcctcnntctctccgttcggcctccgnaactccggggcggcggcggtaagcctncccccgggggaagctccccngggggcaantggnaaattggcggaaagccgnaaaanatgggaaacccttngnagaattaccgaattgggaaagaccctggggattgggtcctnccggaaaggcaagaantgctgagcaaattaaaactgggcaaangggggccgtcaagattcttaancgccgggaaatcaaaacnatggggatggaanaaaaagtgagangagangtnaagntataagattantcaagcaaccgcatatcanccggcctttatgaaatgntaaanggaacaactggaanttangtggtaanggtnagttaantccggggaattanttgcnnaaattgttgnaaaagnagggtccaagggggaaaaggnccccggttt

SEQ ID NO: 98814 - DNA, 486 bp, Triticum aestivum
  unsure (1)..(486): unsure at all n locations
  Clone ID: PAT_TA_98814
accaagcctcctcactcctcacagtcgcaagcatcctctcaagtcctcaacttcctcccctcgccaacaaccaacaaggaaaggaggatgtcttgctgcggcggnaactgcggatgcggcgccggctgcaagtgcggnaacggctgccgcgggtgcaaagatgttccccgacgttgaggcaacgccggcgccgccggcatggtcatgcccaacgnctcccanaaagggaactccggcgggttcgagacgggcggcggggagaacggcggctgcgactgcacaactgcagtgngcacgggctgcgggtgctcctgctgcaactgcaaactgagccggngncaaagaaggcgggcggcgangcgagcacgaagnttaaggaggcaactggtcaagcaancaacaacaacaacaacaacaanaataagccggctgnatgggccgcccgngcgcgcgctggntaaataaaaacgcctgggnttcctaaac

SEQ ID NO: 98815 - DNA, 264 bp, Triticum aestivum
  unsure (1)..(264): unsure at all n locations
  Clone ID: PAT_TA_98815
agccgatccgttggcttcctgttcatacattctcccctcccggcgccgcctccaagcctagggtttcctcccgccgtccgccgccatggctcgccgcancggaggaggaaggtcttcccgccctgctccacntgctgctccantgaagaaacccancaangccagnccgtcaagctcctccaactgntactaaccaaaatancggtggtggnatcatgagtggattgggtccaacantgctcaaggcanggctttcngtactgg

SEQ ID NO: 98816 - DNA, 464 bp, Triticum aestivum
  unsure (1)..(464): unsure at all n locations
  Clone ID: PAT_TA_98816
agaagcagcggcactcgcaccacagtcatccactcacaagctaagctagcgggcgcagtagctcacttcagtccaatcggnatggcgngntccgangggcgcggnatggtgctggcgatggtgctcnccggcatggtggtggcgcgccggngacgtgnagcggcatatcctgntccaacgggtncaagacgctgatgccgtgctgnatacntncaanaaggcggtncgcggnccggggctgtgnaacggnatcaaaanctgctggcggaggcaacaacagcccgaccggcggancatctgcgggtgctcaagaangtcgcaanggngctccggngggncctanatcaaccgngccggcgngctccctcaatgnaaagtcgcctncctanaanttagcccaanntcaatggaatnctttcntgacnaantgaacnccttggccttgtccaantnttngccttgag

SEQ ID NO: 98817 - DNA, 630 bp, Triticum aestivum
  unsure (1)..(630): unsure at all n locations
  Clone ID: PAT_TA_98817
agagcaccaagagcctcctcaacctcccggcgccggcgcatcgacgacatggcccgcaccaagcagacggcgaggaagtccaccggcggcaaggcgccgaggaagcaagtggcgaccaaggccgcccgcaagtccgccccggncaccggcggcgtgaagaagcccaccgcttccgccccggcaccgtcgctctccgggagatccgcaagtaccaagaagagcaccgagctgctcatccgcaagctgcccttccaagcggctggtgagggagatcgcgcaggacttcaagaccgatctccgcttcaagagctccgccgtctccgcgcttcangagggcgccgagggctacctcgtgggcctcttcgaggacaacaacctctgcgccatccacgccaagcgcgtcancatcatgcccaaggncaatcaagctcgnccgccgcatccgtgggnaaangggctaacctgctggcgcaattcataatcaagcgtcgtgtaantaaantcctgtnaggacaanttaaccgtggaaaaaacaanggggnttanaangggnccgcctanttcaggtanttcttttcccgaactagangatttanggctctantgaaaaaacggtttnnagnttaaaaa

SEQ ID NO: 98818 - DNA, 577 bp, Triticum aestivum
  unsure (1)..(577): unsure at all n locations
  Clone ID: PAT_TA_98818
cgttggcttcctgttcatacattctcccctcccggcgccgcctccagcctagggtttcctcccgccgtccgccgccatggctcgccgcagcggaggaggaaggtcttcccgccctgctccacgtgctgctccaagtgagaaacccancaagcgccagcccgtcaagctcctccaactgctactacccaaaatagcggtggtggtatcatgaagtggaattgggtccaacattgctcaaggcatggctttcggtactggcagtgccatggcgcacanggctgttgatgctgtgatgggtccccgcaacattcaacatgagactggtgtcggtgaagntgctgcatctatgactccaatggacaatgctgctgatgacaagtgtggnaaacctttcaaaggccttcaagantgcatcaancactacggaagcgacatcaacaagtggcaanttcaactcgaaatgctgaacgantgccccnctggaggagcaagagctgggnaantcttaagctacnanctntgcgtgantgngggtaaattgtngnaacctgntttanccanatgatgatgatatata

SEQ ID NO: 98819 - DNA, 607 bp, Triticum aestivum
  unsure (1)..(607): unsure at all n locations
  Clone ID: PAT_TA_98819
gcttcccatacttggactcatgctcatctcaacagtctgacccatgatgagatcgacgaagagatcgaggctttggaactggcactgtggaagattattggagcagttccagcaatcattcgacctccttatggcgaagccaacgacgacgtggtacaatacctcaacaacaagcatggtcttacagtcactaattgggacgttgattctgcagattcagctggagcaactccatcagcttcgatcagcactctgtctgctttcaagtatccggatccacacatgcctctgatgcatgaaacctatcaaacttcagtcgagatggtgacacctcaaatcttaccaatctataggaaacaaggttataagttgatgacgatnagtcaatgtttgagtggagttcagcttataaacttcaaggcaaaagacaagaaagagacgaaactttggccttgtgatggncaagtcacttaccttgcaaagagaaagttgggaatcanaanagaattgttnagggaangctgttnaaaaaagncactgggaanttttggagggccaaaattttcncaaggttaaanggntcaaaanggttaaancnccnttgtgg

SEQ ID NO: 98820 - DNA, 440 bp, Triticum aestivum
  unsure (1)..(440): unsure at all n locations
  Clone ID: PAT_TA_98820
aatccctcaccgccaacaacaatctctcccttgggattctcccagatccctcctcanctcctcccacagcaaccaacggttcaactcggcntcaacaacggggcaaccaacggccgaagcccgagctcactcgatncctctcctttccgatgacatggncatgccgncgtcgctgtagcttcacgcccggcgacaagataactctgcaagncggcctcgncccttgccttcctccttccttttcnttctcctctctcttttcttacgtctctccttgtcatggcaagannaagcaatggngcccgancagctcgtggtttgtancccgtcagatggattcagctcaaggccctctctctgggctgaaggaaanatggngcccgaaagcatgggcggggctcccaatttaacganaccggggtgggaaatttcctgtgtca

SEQ ID NO: 98821 - DNA, 437 bp, Triticum aestivum
  unsure (1)..(437): unsure at all n locations
  Clone ID: PAT_TA_98821
acaactctccctcaatctcaactccganaaanttcaacnggaagcaatggcccaaaaggaagacaagaangcnggcggccgagaanaaggggganaaggcggcgganaaacccccgcggggaaagaagccaaaggccnagaancggttgccggaaggnatnacggcgtcaaaggatgccggcggcnaggggaagacccggggnaggaagaagggaacaatggcgatgaagggcgtggngactacaatatctacatcttcaaggtgctgaancaagtgnaccccggcatcggaatctcctcaaaggcatgtcatcatgaactccttatcaacganatctttgagaactcgccggngaatcggcaaactcgcaaggtacacaagaagccaacaanaactctaggganttaaacctcgttcggctncnctnccgggaagt

SEQ ID NO: 98822 - DNA, 488 bp, Triticum aestivum
  unsure (1)..(488): unsure at all n locations
  Clone ID: PAT_TA_98822
gttaacgaatcctaatctactttcttgaagctggaacggtctttaaatttgcgttcatagactatttattcgcctgccggtgggtagcatatgttgtgatataactaggacttctctgactaccgttggagcgtttggcaccgcattatctttcttcatttccatcctcgttatcttcgtcttggtcgtcttgtgtattatttgaagcttatctttgacggagagggagataattcagctcaaatttgaaaaggtgttactcaatctcggcactgtaaactctacagtgagagcttagtatgtaatacttttttggaattgagacttatcaaaagaatatgctgagctgggatgacgtaccgatagtatgaaagtatggtaggagttagctatggctttaagagaaatgaagttcgtgagttatactcttagaactttgattaatttgcgaaccttgggataaaaaaaaanaananaaaaaacncnca

SEQ ID NO: 98823 - DNA, 691 bp, Triticum aestivum
  unsure (1)..(691): unsure at all n locations
  Clone ID: PAT_TA_98823
aaaaacanaaaatatcaaaaacgaactcagcacaaagttagtgctggggggaaaccatcgagtacctggtgtgcatcctggttgatttcctgctgctgattcttctccgacgactcaagatccgagtcccgtgtgtgtccaccgttagaaagcgagactttgggcctatcaaagacctccgtcctcctctcccctcccggcgcctccatggttctcctgggcaggggaacgcggtcttgagttgggcgggaagcaccaccaagcagcgggaacgaggggagctctgccaagaggcaagggcgactggaggcgaaggagcaaccggggaangcgacttcctgaccgggcaccccaagctttatgaccaatctcgccgcagagaaggcaacaagcagcgttccggcaagangcaatgcgatggtaaggngaaagacatcgaaaacaatttccccttggccttctaagaaacaacaacnttgncctctgaaggcgggggaanangggttngcnnattganaaccaggcgctngctggtgcgnccttggtcaacaacgcaacnatgggtnccaaggcgttgtaanccccaacnaggaanggtnaaaccncnggaangacnggattaacctngccatgccaaggaaagggnccnacaggcantaangcccgagangnncacccgggaancccaaaa

SEQ ID NO: 98824 - DNA, 450 bp, Triticum aestivum
  unsure (1)..(450): unsure at all n locations
  Clone ID: PAT_TA_98824
cttcccgcatacaagaatggtgggacagaagtantgaggcgaaaacangagcgggatncgcnactccttccatgggctacgcaacaaccaagttcgcggacgcgtgcctgagaagggtgcncggcgacgcgnggatatgggagtgctcctacatagcctctcaagtgacggaactggcttcttcgcgtccaaaggtgcgctgngccggggccngngtcgaggagtctgccgctcgggccgctaacgaatttgngaagggcgggctggagaangcaaaggcganctcgccgagagatccgcaacggggtcgccttcgcaacaagtgagatganagatgggaagaaantacacacanaggtcctccgnatcnttcgccgggtggaaagctccganggncaacaaaaaaatctgagaccaatttgctcctgcctgncaaaaatgncccctgga

SEQ ID NO: 98825 - DNA, 617 bp, Triticum aestivum
  unsure (1)..(617): unsure at all n locations
  Clone ID: PAT_TA_98825
agagtgagatttgngccttccgatttagtgatttcaattcgtgttttgttagtgaagagagaagacaaacggngatgggctccaaaccangnaccanagcgaagcttatggccggcgagaccaaagnccgcancgaggagaagaccgggcanatnatngacaaagcgggcaagcacggaggcaccaagcaaaaaggcggcnagacnggcganggcaccaagcaaaaaggcggcgaagcaaggacaagacggccaaaccggtcaagcgggcaaggaacgcnccgccnanagcaangnccaaaccggnagctttctcngcgagaaaactgaagngggcaagcaanaagngtcgganacngngcagtaccncaaggtaagtcctcgacgccgcgcagtanacaaggaatccgccgttccggnaaggacaaaaccggnagcttgttcaacaggccggcnaaacggttgttaccccggttgtggcgccaaggacccggtgngaanaccttggnatggcngtgcaaaacacaagggnccacacagatcntaatnaatggttcccttaatttgttccttaccgttggcttanaccntnccagtttccccctntggtttcccctt

SEQ ID NO: 98826 - DNA, 291 bp, Triticum aestivum
  unsure (1)..(291): unsure at all n locations
  Clone ID: PAT_TA_98826
agagagaactagtctcgagttttttttttttttttttccagacanccaatcccacacatcccactcggcggcggcggcgggggtggntcacncnaanatgggaagtcctgaagaccggtaaggnggtgatcnntctccagggccggntcgccggccggaaggcggcattgtgcgcttttcgaggaggganacncgaccgcccctatggccactgcctcntcgtccggnctanccaagtaccccaagaagggtgatccgcanggactcctgcaangaanacnggcaaacaaa

SEQ ID NO: 98827 - DNA, 511 bp, Triticum aestivum
  unsure (1)..(511): unsure at all n locations
  Clone ID: PAT_TA_98827
gggggcgctctagaataatttatccccgggctgcaagaattctgnacgagaacaatccacaangaaacccgatgggccgcacgaagcagacggngaggaagtccaacggcggcaaggcccgcggaagagctggcaacaaagcggcgcgcaagtcggcgcgggcaacggcggcgtcaagaagccgcaccgcttccgcccgggcaacgtggcgctccgggagatncgcaagtaacanaagagcanggagctgctcatccgcaagctgcccttccagcgcctcgtgcgggagatngcgcaggacttcaagaacgacctccgcttccagagctccgccgtctccgcgctgcaggagggcgccganggctaactcnggggntcctccagganacaanctctgcgccatcangccaagcgcgtcaacatcancccaagganatncaactcgcccgccgcatcggggagagagggctaanatctttctgtcntatcncagngttanattacatgtgtt

SEQ ID NO: 98828 - DNA, 192 bp, Triticum aestivum
  unsure (1)..(192): unsure at all n locations
  Clone ID: PAT_TA_98828
gaatcngnacaacaaacatctgcnaagtccggngaaaaagtaacactacanctcgtngtgtacggcggtagaagcaaancaacaagatggggnagctcaacaagaagcntctngtgggntccanggtggtggcngtgctggccntggcaacantggagctgtgcggcnccaanccgctcgaagacaatgact

SEQ ID NO: 98829 - DNA, 368 bp, Triticum aestivum
  unsure (1)..(368): unsure at all n locations
  Clone ID: PAT_TA_98829
caatcaccacgggggggcgtcatatatggtcncgggtgagnatcgacagtcaccancagtatangccatgnggcccgaggcacactcagtcaagcgngtggggtcaagactaccntnangcggcgcaccggganggggttctcgtcanaanancgccctgcangtgtggaggttctactcgagactggnagatggcangctaatgcacttgtngcttanataattaatggaaaaacttnggacattntccttcatccaaactgtntgtncacatgtggccgtacngatanaactgattncatanacagatggatttntagcntctnctgtaatggtagcactaaggangatctaaactccaactgaag

SEQ ID NO: 98830 - DNA, 442 bp, Triticum aestivum
  unsure (1)..(442): unsure at all n locations
  Clone ID: PAT_TA_98830
aggtggatccccgggctgcacgaatccgcactatgcccctctactcctcgtttctctccgggttaccgctgccatcgccgttgccccatcccgaaatccacctcgagactgaggggtaggcagaaagacggcgggcgttccactcgggacggggaagcatgggtgacggcgatctcgacgcaaggttcggtggcggantctgaggttgtgggaggcnagatgatttgaatcaaaggtgtcaagatcatcaggaccggcgacgtcatggangccgacgccgcttcggcgcctcttgcgctcctcctcgacgcctcgtgcccgctcttctgcgtcaccgagggcgtcagnngngcgggcgcggcganccaaatgcagtacnagtgggaccaaggttgacacggcactgggancaagngatggagacggcaatatctcagtcaag

SEQ ID NO: 98831 - DNA, 589 bp, Triticum aestivum
  unsure (1)..(589): unsure at all n locations
  Clone ID: PAT_TA_98831
agacagagtatcccgatagcannaacatggcgggagaangagatctgaanctgctgggcctgctggtgaacccgttcgtgaaccgcgtccggctggtgctgcacatcaaagggcctgagctaccagtaatcganacngacgtgctggacaanggcgaagctcctcctccgctacaancccgtccanaagaaggtggccgtgctcatccanaacnggctgccgctctgtgagtcgcaagtcatcgtcaagtactncacgaaggctgggccncgccggnaagccatcctccccgncganccctancccgcgcaacgccgcttttgggcggctangtcacgacaanctgttccccgcctggntgggcatctcttggcccgacanaggcgggagggcngagaaagtcctctaaaacctcncggcgctcgcgcaacttgnngtngtcgccggccgattcctgganggnggaaaaancccttcntcgccggnangncaatcgggtccncgaacncccgtcgggtgaaaatttctggatggaggcgcngccnaagatttncgcttacntcncacccgggaaaacccctctgttngt

SEQ ID NO: 98832 - DNA, 441 bp, Triticum aestivum
  unsure (1)..(441): unsure at all n locations
  Clone ID: PAT_TA_98832
cgcanaaacaaaactcccatgctcgagttgttgccaggcgtactgcagagtantgatcatcggcgatatggcgtcggcagcaagcgatgggacgaangangaagaagacngcgtgcgtcancngcggcagcnggtatatcgcntctgcgctggtgaanatntgctggagaatggtacgccgtcaagaccaccgtcangaacccgatgacacggagaagaacgcgcatctcaaggccttggcggggcncggcccttggagtcctccgcgccnatctgaacananagggcagctcnacngcgccgttgcngggtgngactacncgttcctcgtcccgctccggtnaaactcnangcggagaaacccnancaggacntnattgcaccgggcgtccactnnacaatcaaccttaangntgtcctntctngcgatcgggggacggt

SEQ ID NO: 98833 - DNA, 797 bp, Triticum aestivum
  unsure (1)..(797): unsure at all n locations
  Clone ID: PAT_TA_98833
ggcgctctagaacatggatcccgggctgcagaatcggacagcgaaagactgaaatgaatcagagtgacaaaagaaagnntactcctccatccggtggacatcgctatctttggtccatcgcctgatcctcttaccaanccgaagtacaaangaaagacgaatagcgcangcccattgcgcaaagcgaaaatgaccatggcangagtaatccacccatctttgctgacgtgcgcaagatcgaacacccaataactgtacgagaaaacaatgaagtcctgcagactgtagcnacgaccatgattccccggagatgggtttgtagcaatcnatcgcgtangcgatggnaatagtgggcaccgtggtgacctgagacaagcaagccgtngcccaaaccacgatatgacccacgccactgctggtggtatgcaacaacaacgaggataatnnaaaagcatcatgacgatcaccttaatgaacatcgccgggaggggcatctccgcttcgcgcacgcaacaattttangcgctgngcgcgcagataccantccgngtatggactgctgttgcaacccaatcaanggaacantcgcgaacgcgaaatttgtgttcaacctggncngcttgaaaagnanggagngcaaccaaaanagggatccgtgnggtnaaaanaggaggantcaccggccggnancataacctncacaganatgggtnaaaaaacttatggggtcagngccnccaanaagtcttcacncctnggttntaaggaanaatggccggatgggnnccccgggtngg

SEQ ID NO: 98834 - DNA, 388 bp, Triticum aestivum
  unsure (1)..(388): unsure at all n locations
  Clone ID: PAT_TA_98834
ccggctgcaagaattcggaacagcaataacgcatgggctccgctgcttgctagctntcatccagtatatataaagagcggcaccgctgtgngacccggcccgtatccaagtcaatcgtctcatgctccggtccacgcacccgctcaagcccagcagnaaganttcggccccggcgtcanntccggngatacatggtggggggcgcgccgagcggggcnaanctgcngcaaatcctgaacgtgcncntggtgggaaccngcgaccgcgtggtggngctgtccacggcttccgcacngacaatcggagtggagncgcgtgctgccgtncctcatccgtnagcaccgngtggnggtctacanccncgtctgggccgggagagtcaacccgg

SEQ ID NO: 98835 - DNA, 625 bp, Triticum aestivum
  unsure (1)..(625): unsure at all n locations
  Clone ID: PAT_TA_98835
agcaaatcttcgtgaagacctcaccgggaagacatcactctgggaggttgagagctccgacaccatcnacaacgtcaaggccaagatncaggacaaggagggattcccccggaccagcagcnnctgatctttgctggcaagcaactggaggatggncgtaccctcgccgactacaatatccangaangagtccaacccnccaccntgtgctgcgcctgcgtggtggcatgcagatcttcgtnaagaccctcaccggcaagaccatcaccctggaggttgagagctccgacacaatcnacaatgtcnaggcaagatcangacaaggagggcattcccccggaccagcagcgcctgatctttgctggcangcagctggaggatggtcgcaccctcgcagactanaacatcaaanggngtccaccctcaactngtactccgtcttcncggtggncannaattgccctgtcgtttgagctgnnggttancctggtcgncggtgggcggngccctgtccttcaattaaaatgtttcccntcgtgtgagcccactgggtggttnaaaantgtcgatcccntntagtccaatncnttgggttantaacatcgtngtgnacnttncggaatca

SEQ ID NO: 98836 - DNA, 467 bp, Triticum aestivum
  unsure (1)..(467): unsure at all n locations
  Clone ID: PAT_TA_98836
agatctggaancaaaggcagcgccgggaagcancaacagctagcgacacacaacaactacagcaagcacacagcaggaggnagaagaagggtctgcagttctacacttctacttctacacgtntgggnaactgcgccatcacgcatcaagccacgtcntgggcggncgacggcgantggganctgccgtcccccngcaangactacnaagggcgcgcggngcanaggaangagcactcaaccaggtaancatccgtntcatcaancggcagctgcangaactggtggncaaaagggccgcccacgaacggcacngtcacatcttgaagancgggcggtcggngtccgngcttctggnccacatcaataacgcngggaggnncaccaacanntccancactgnangggggggcacttgnaancccccctcnaagcanccccgngngnggtggtgcttgagcnatccca

SEQ ID NO: 98837 - DNA, 417 bp, Triticum aestivum
  unsure (1)..(417): unsure at all n locations
  Clone ID: PAT_TA_98837
gcgctctaaatatngatccccgggctgcaagaattcggacaaaacaactccanctgacaatgctagctaagcttctgcatancaagcaatggggtactctaaaaactancggntggnctgttcgccatgctgttcctanctccgggcgtcctgggatccgaacccgatctcttcangacttctgtgttgcgacctcnatggcagggcagtctcggtgaacgggcatcatcaaagccatgtcggaggntggtgacganttcctcttctcntccaaactggcaanggcgggaaacgtncaacccgaatggtcgggcgtgacngactccnngtngccgagtgggccggtncaaaacactgggtgtgtcataaacgtntggnntcccgncggganggacaaccnccgcaagtcaaccgcgt

SEQ ID NO: 98838 - DNA, 442 bp, Triticum aestivum
  unsure (1)..(442): unsure at all n locations
  Clone ID: PAT_TA_98838
agcacgtctancctaacttaactaagctaacccaagtanccangccatgaacatgaactacggntccangggtcctggcgcgatggtgctgtgcaagcagtncaactcnancatcacggngatncccggcgcccgcgccgtgcantgcatgcagtgnaactgcgtgacncgcgtcagcggtcgtggccggcagcancacggataccgcanngttanggcggtnacggcggggggatgctgntgccgccgatgcgtcccaccccngccttcngnggngggcgcggcaagaancgcgccntgctgatctggatnaagtataacaaccggggctcctgcnanctgcggggcccatcaannacntctagtgnatgcggtnctgctcaccgancgnttctggttccccaacngaatgngttctantccccacagaccagggngagga

SEQ ID NO: 98839 - DNA, 203 bp, Triticum aestivum
  unsure (1)..(203): unsure at all n locations
  Clone ID: PAT_TA_98839
agtcnaggcgcagcgatttctggagagggaaacggaganggagacctatccacagatggtgtgcgcaatctgccaatcncattgtgagagtgncattgagcagacttttcgcattgncatccgtgatgactacgaagctttagcgaacatcccatgcactgcaaggnatangtttaaacaaatttctgggttgaactttaaag

SEQ ID NO: 98840 - DNA, 508 bp, Triticum aestivum
  unsure (1)..(508): unsure at all n locations
  Clone ID: PAT_TA_98840
ggcgcctaaatantggatcccccgctgcacgaatcggacgagagtcatagcattcaaagcctctccatctccgaagctccaacccaactcgaagatgtcttgctgcggaggaaactgcggctgcggcaccgcctgcaagtgcggcaacggctgcggnggntgcaacatgtaccccgaggttgagggcgccggcgccaacctcctcgtctccgccaccgccaccacaaggcgagctccggcgggatggagatggcggccgagaacggcggctgcggctgcacccagtgcaaagtgcggaacaagctgcggntgctcctgctgcagctgctagatcatcatcgatcatgcatgcaccgtgccgtgcgtgcatcatcgatcatatcgatctactactacaaancatgtaancgcaacctgattaagggctttatgtacgcaactgacctgctcancagtcaggtgcatgcatgattttaaaaaggccccctaaataaaactcccctngttt

SEQ ID NO: 98841 - DNA, 390 bp, Triticum aestivum
  unsure (1)..(390): unsure at all n locations
  Clone ID: PAT_TA_98841
ccgtcggccagagcacaagatggcgaacgtccccgctcncgcagncgagaccgcggcctcagcgcgcnnacgtgaaagntgtaaaccccacgagttcgtcaaggctactccgcgcacctcaagcgctccggcaagatggagcttccagagtggggttgacattgtcancgactgcaaggttcaaaggagctgccaccntctgatgcngacngggtactacatnaaggctggctcgatggcaatgnanatctacctgnngcagggaatcnggatcgggggcttcaanaaattanggtggccgtcagaggaacggtcaccccaccccaacttttcaanagcaannggtggtgttcccccaacatcctcacnagtttaanatattgggatatt

SEQ ID NO: 98842 - DNA, 217 bp, Triticum aestivum
  unsure (1)..(217): unsure at all n locations
  Clone ID: PAT_TA_98842
caccccccncccagngngggtcncggtgagaatcggacagctaatcctacatantagtcggggtacgagatgttacttcagcttgcatcggatttttnatcaanacgnatggcaccgtgattcaaaccnacgcgcctgacggngaggnccacgtngaacgcccgcnccgcnaggagtcncattaagtngangccccncnccggncgaggcgaggtca

SEQ ID NO: 98843 - DNA, 412 bp, Triticum aestivum
  unsure (1)..(412): unsure at all n locations
  Clone ID: PAT_TA_98843
agcacacaccaactaagccacagagcaagcacactanctagtttctgccatggnagctcgccgtgcccacgccgcggngggcttgggcctgctggtggnggngctcgtgctgtctgcggcaacggcgccggncgagggtgcggttgcgaactgcggcaagtggtgagctacctggcccgtgcatcanttacgccatgggcanggtgagtgtgcctggcggcggctgctgcancggcgttcgtngcttaangcgggcgctggcaaccccgccgaacgcaaaaacaactgcacctgtctcaagcaacangcgaacgggatnggcgggatcaancccaaactcctcgccggnattccccggaagtnggggtcaanatcccctacgccatcaancaaggaaccattgctccaaggt

SEQ ID NO: 98844 - DNA, 423 bp, Triticum aestivum
  unsure (1)..(423): unsure at all n locations
  Clone ID: PAT_TA_98844
tgcgaccccgccccggaatacaangaccgtcccntcgtgtcagatcagctcgggagcttccccgccgaggccgccgacanagcttttcccngcaaganatggcgccattcgagcgggttcttgggaagacgcttctcngctaggaccgcagcangggtctgtgatggagaacgcctccaatgangagatgctgcccccggcgctgcctctgggganctngattggcgcgagctccgccggcgggggtccgagcgccgctcgtgcggtacggcaatccggcttcnccaagcgcggngaggnctacttcctggtcaagcccgaatgcctccgncgtcccggngaccttcccggntttccgtctcgctgnttcnaaggtaaaatgtgtgtcgngggggtgttancaangagacttctccacgatgt

SEQ ID NO: 98845 - DNA, 411 bp, Triticum aestivum
  unsure (1)..(411): unsure at all n locations
  Clone ID: PAT_TA_98845
gagcattcccatccaagcgcaaccgccgncaacacaatcctagcgagtcctccccgccggagaagcaacaagcaatatggccggaaggaanggaggcgacaggaagaaagnggtgaccaggtccgtcaagggcgggctccaattccccgtnggccgcatcgggcgctacctcaaagaagggccgctaccgcgcancgcgtccggtccggggccccgtctaactcgcgacgtcctcnaatactcgccngctgaggttctggaggcttgccggcaaacgccggtcanaggcaacatnaaganccggatatcccgnggnancttgctgctcncngtnccgcanagaacangagctcgggaggtgntcgtcggcgtnacatccccaccgnggggtgatcccaatatnaactccgt

SEQ ID NO: 98846 - DNA, 275 bp, Triticum aestivum
  unsure (1)..(275): unsure at all n locations
  Clone ID: PAT_TA_98846
ccgtctcctcgcctcgccgtctcgccccacgccgccgacgcaaagatgcgttcaagagntcgtcnagatcgggcgcgtggcctggtgaactacngcaangactacgggcgcctcgtcgtcatcgtcgacgtcgtcgaccagaaccgggcacttgtggatgctcctgatatggtcaggtgccaaatgaacttcaagcgtctttcnctgaccgacatcaagattgactcaangcgtaccctaagaangnaactttgatcaacggcatggaggaagca

SEQ ID NO: 98847 - DNA, 621 bp, Triticum aestivum
  unsure (1)..(621): unsure at all n locations
  Clone ID: PAT_TA_98847
gctccaaaatccccanatcccctctcttccgaagctactcanccatgtcggggcgcggcaagggcggcaangggctcggcaagggcggcgccaagcgccaccgcaaggtcctgcgcgacaacatcaangcatcaccaagccggcgattcggaggctggcccggaggggcggcgtgaagcgcatctcggggctcatctacgaggagaccgcggngtgctcaagatttcctcgagaacgtcatccgcgacgccgtcactacaccgagcangcccgccggnanaccgnaaccgcatggacgtcgtctacgcgctcaagcgccaaggaccaccctgtacngattccgcgggtgaggagccgcggcgcttgctggccgggccgtggggcacaaagcctggctcgcggtcaaaaaantggaggagangagaaagctgtagttgatntggggtccatgccctctatgaattagtagtnatatctgtataacaatanctggttgtcaaatggttnctnantgttctgaaatttctgatnggcaaacaacntgttttgccgagatatatgaatccanagttaacaaantttcctaaaacatggntattctatgccatctgttctgttttc

SEQ ID NO: 98848 - DNA, 163 bp, Triticum aestivum
  unsure (1)..(163): unsure at all n locations
  Clone ID: PAT_TA_98848
ctcatcngncttcactcacacaccaactaagccncagagnaagcacactaccagctatttctgccatgggagctcgccgtgctcacgccgccgcgaccttgggcctgctggtggcggcgcttgtgctgtctgcggcaacggcgcccgcggagggtgnggttgc

SEQ ID NO: 98849 - DNA, 456 bp, Triticum aestivum
  unsure (1)..(456): unsure at all n locations
  Clone ID: PAT_TA_98849
gaattccgnacgagctccccncatgcttcacancccaangcacaaaaccangntgctgttaatggnacaaataccgaaccngtcganaaatgctcggttccacagcccaagnanaaggttgttantattcacgagcctagggtttttagaataaangatgtngtaaaccnacaaggangaggataacatgatgctgcatgcgaataccatccaggcctgcggttttcatgacaggnataagggtggaaggtttccatgtccangtcaaggagtttncnaatttatggngatacctccacgcanaaaagggtngaacaatntgnngccttgtnngttcacacatgactcttgcattaagagttaaanttgtggtatnatcncctgnggcanaaggttggatcctngcncactttctggagaaatttgcttggnatgtggcccnngaccaaaaataag

SEQ ID NO: 98850 - DNA, 231 bp, Triticum aestivum
  unsure (1)..(231): unsure at all n locations
  Clone ID: PAT_TA_98850
ctcaagggncccatcaacgacgtcaagtggatgaggtagatcctcaccgagcgcttcngnttctccaannaatgngtcctcatcctcaccgatgaggagagggaccntncaggnagcccaccaaaggcaacatccncatgggcatgcactggctggtgcanggntgcagctcccgtgactccctggtgttccaattttccggcgcggggtgngcaagtcccccactgcgac

SEQ ID NO: 98851 - DNA, 452 bp, Triticum aestivum
  unsure (1)..(452): unsure at all n locations
  Clone ID: PAT_TA_98851
ggcgctctagaatagtggatccccgggctgcaagattcggacaagctctctcctccggtacccatataaagccgcctcgtcttctccctattctactgtcacagctctgcaagtctttaacgtgtgctccggcgggcgcgggcggcggaggatgaatgctgttgttctgangaagcggggcgcgggcgccgcnccgccgcgcggcgccgcggtgaccctggaggaactgaagaagaaatggccgacttcgcaaggaaagggattgggagcagtacacaagccaaggaactcctgcttgctctggtgggtgaggtgggggagctctctgagatattccagtggaaaagggaggtgccaangggctgccccgggtgcaataaacgaaanngtcatctccgtnaaggactctcaaatgtnctcctcactcntcntcttccccgncatntgtnttt

SEQ ID NO: 98852 - DNA, 554 bp, Triticum aestivum
  unsure (1)..(554): unsure at all n locations
  Clone ID: PAT_TA_98852
angggnccnggcgnggatgaaaagaanatatatcaantccttccctatccttttgngatttgctcnntttgccaccagaaacctgggaagtaaaatgtnagatattggtgacgaggggtaatcnactgntccacacggtaatcttgagagttcgcccaagacgtttcaatgatgacactttaagtnngcactgggcgtatttccgtatgagccgggcagnnaccgtcgcgatacacatccagatgactggttngtctcaccatcaagaaacacctacgntgnatgacagtaaagaatatgcagtgngcataaccatagtgataaactgcgncaacttactctgaaacatctgggnccnnggagcnacccttttgacaaatggggatatgtnaccncctgtcgttgganccgggtgatgagcatacaaacaagagnggcacacatgccngttgatgganaacttnccaatataangngattttatcaagctccgcatattataacgggngngggtanttcaggcactctccncgccnccgctggggtatgcgnat

SEQ ID NO: 98853 - DNA, 210 bp, Triticum aestivum
  unsure (1)..(210): unsure at all n locations
  Clone ID: PAT_TA_98853
gctgcaggaattccngcaccaaaactggngaggcctctgttcctctccctancangcaacttccttagngaaganggcaccccgagttccacangaaagaancgccaccggaggagggagantgacgnccaatatttttcggtgntcangcggcnaagacncggcccccttcttttngcttntccngcagccnccngccangctcntttt

SEQ ID NO: 98854 - DNA, 179 bp, Triticum aestivum
  unsure (1)..(179): unsure at all n locations
  Clone ID: PAT_TA_98854
acaacctcaagcgtgcgagagacatcgatccgttccatcggaagcacaggacagagatgacctcgncgngcaaccaaaaatggggcgtcgctggtggtggctancaccanggcggccgtctccgcncncaatgntcacgcggggntgtnacgctgggantacgcacaccnctcgcncta

SEQ ID NO: 98855 - DNA, 275 bp, Triticum aestivum
  unsure (1)..(275): unsure at all n locations
  Clone ID: PAT_TA_98855
gggcggcgtacgggacggcgaagagcggggtgggggtggcctccatgggggtgatnctgccggagctggtgatnaagtccatcntgcccgtggtcatggcgggggngctcnggatntacagtctcatcatcnccgtcatcatctccaccgggatnaaccccangggcaaaccctacttccncttctacnggtacgcccacctctccctncgggctcgcctgcgggctcccggggntcgccnccgggantgccatcttcnatnntccacaancggc

SEQ ID NO: 98856 - DNA, 586 bp, Triticum aestivum
  unsure (1)..(586): unsure at all n locations
  Clone ID: PAT_TA_98856
cangaagttcaagggctgtcctgagaagctcaaatggctcccaaagttgctgttgccaagaagggcgatgccaangnccangccgccaaagttgccaaggctgtnaagtctgggtcaatcaacaagacggcaaagaagatccgcacttctgtgacatttcaccgccccaagaccctgtccaaggccagggaccccaagtaccccaggatnagcacccctgggaggaacaagctcgatnaatatcaaatcctcaagtacccgcttaccactgagtctgcaatgaanaagatcgaggacaacaacacactcgtcttcatcgtccnacctgaagggcgacaaagaanaaagattaanggcgctgtcaangaaaatgttcgacattcaacgccaagaaaggtaataccctcntcangcctgatngcaaacaagaangcgtacgtgnaagctgacaccaaactacgatgctcctgatgttngccnacaaagatcngcatcatataaatcaacagggagggtcctgcaaataagncgcttgtgtcctnggtttcttggtgttnttgggaatttttngctttttncttancaa

SEQ ID NO: 98857 - DNA, 538 bp, Triticum aestivum
  unsure (1)..(538): unsure at all n locations
  Clone ID: PAT_TA_98857
caccantgaacgtgtccgacctgccgccgtccgtggactggcggnaaaanggcgccgtgaccggcgtcaangaccaaggcaantgcggtanctgctgggccttctccaccgtggtgtccgtgggaggnatcaacnccatccgcacgggcancctcntgtccctctcggngcaagagctcatcgactgcgacacnggggncaaaaaaaggtgccagggngggctcatngncaangccctctagtatatcaaaannaaaggngggntcatcacngaaggtggctaaccntntcgcgccncccaaaggaacctgnnaagtctcnaagagcgggccaaaaaatnccccctnggnggnggaaatncnacagggcaaccaaaaacgttnccgggcnaaaaacaangaggggcntggccaaagcgggggggcgaaacanacccctttcttgnnccttctaaggccnaacgggaaangngtttnatnttctactccccngggggtctttaccgnaaatnngggaacnggagctgntccaccggggt

SEQ ID NO: 98858 - DNA, 540 bp, Triticum aestivum
  unsure (1)..(540): unsure at all n locations
  Clone ID: PAT_TA_98858
tccattccccaacagcaccttccggcgaaccaccgcacctctccccggcgaagcagcagngtccgatggcccccaangcgganaaaaagccggctgccgcggagaagactccggcggncgagaagaccaccgcgggcaagaagcccaangccgagaagcggccgcccaagtccaaggagggcggcgccgacaagaagaagaagaaggccaanaagagcgtggagacttacaagatntacatcttcaaggtgctgaaagcaggtgcatccggacatcggnatctcctccaaggncatgtccatcatgaactccttcatcaacgacatcttngaagaaagctcgccggcnaagtccgccaagctcgccccgctacaacaagaaagcccaacatcacgtccccggggagatncaagacctccgtccggncttgtcctccccggngaagctnngccaaacaacgctgtcttctgaagggcaaccaaaggccgtcaaccaaagtttacntcctcttanatangaatgttcttctgtcgncctggt

SEQ ID NO: 98859 - DNA, 629 bp, Triticum aestivum
  unsure (1)..(629): unsure at all n locations
  Clone ID: PAT_TA_98859
aattcggcaccacgaccccgaactgcggtggctcttctccggcgatcngtccatcgacnggctccatatcnatggggtccttgccctgccggctggatggagtgggntctgtcctccaaagcggagtcccanggattccatgggtgcancanatnccggccgacaaagcacatgcanacggaggtgcggccatatacgaggtgtgttctgaanctacnantggntggncacnaaanggttaggatggggaaagctcctgacnagagggagatnaaccctgacaacagaacancactggaattgtctgtgcgcgcttatgcnaagaaaaggagctggtcatgttgtcaatccaagcaattgggcacatcctttaactccgctagatgangcttatgaagttcnacaacctttattgggaatgcngntttggagttcggctantgttgctccgggaaangtgcatgccaagagattgnttgntgattgtgcggtacgcngtcccnaangtgcactaagttttgatgncaccangtttgatcggactggtttgagcctaacttccnccnagantaaantaagtgtggacntggganggtttgaagccatcctgttttcatgtgtttggtatn

SEQ ID NO: 98860 - DNA, 607 bp, Triticum aestivum
  unsure (1)..(607): unsure at all n locations
  Clone ID: PAT_TA_98860
cgtcttccgttcaccaagaagcagtggtatgacatcaaagcgccgctgctgttcaacagccgcaacgtcggcaagaccctcgtgtccanggacacagggnanctangattgcctcaagagggtctgaancacanggtgtttgaagtntctcctaagctgatcttcaaaacgacnaggaccaagcctacaggaagatcaagactccgtgctgaggatgtgcangggatgaatgtcctcaccaacttctggggcatggacttcaccactgacaagctcaggtcccttgtgaggaagtggcagacactcantgaggctcatgtggatgtgaagacaactgacaactacatgcttcgcatgttcnncnttggcttcaccaaggagacgcccgaaccaggtgnaagcccacttngctnatgcccaagcaagtcagatnanacaggtccgccgcaaagatgggttggagatcatgggtcaancaanncttgcaangctgtgncttgaanggagctttgtgnancaagttcattcccngagggtngatttggnaaaggagaattgaagaagggcaacctcaagcatcttcccctccaagaacgtgttcnttcng

SEQ ID NO: 98861 - DNA, 614 bp, Triticum aestivum
  unsure (1)..(614): unsure at all n locations
  Clone ID: PAT_TA_98861
cngncgcctccgcactctgccgccgcagccgcaaccgcagccgcagccatgggcgcgtacaaattcgtgtcggagctatggaggaggaagcaatcggacgtgatgaggttcgtgcaacgcgtgcgttgctgggagtacaggcaagcaaccggccatcgtgcgcatcaccaggcccacccgccccgacagggctcgccgtctcggcttcaaggccaagcaggggtatgtggtctancgtatccgtgtcaggcgtggtggcaggaagaggcagtgcccaanggtattgtctatggtaaagccaaagcaccagggtattacccagctcaaagttccagaagaacaagaagtctgttgctgaacaaaaagctgggcgcangctgggtgggtcttcgtgtgccaactccctactgggtgaatgaggactcctaacctacaaagtacttttgaggtcancccnngttgatgttgctcaacantgcctgtccncaatgaccccaaaggattaactggntctggaaagcccgtgcacaaacaccnttgaggcttcgtnggnctaacntccggccgggaaaaaattcnntggtctgcnttggcaaaggggcaccnccaccnnc

SEQ ID NO: 98862 - DNA, 404 bp, Triticum aestivum
  unsure (1)..(404): unsure at all n locations
  Clone ID: PAT_TA_98862
agaggacgagaggaggaagaagaagacgcggcatcatggcggcggctcatgccgaggcgggggggtcccccanccancgcgcgtncatncaagcgacgtcnaccccgccgtnccccaacgcgggccggntngccgantcctcctgcttcccccagtaaaccgnctccctcaagtgtctggggaccaaccaanacaagagcaagtnccaacancaattcnatnactacaaagagtgcaanaananaaaaaaggganggtctggtggganccgnacccngaagncacacaattntnngggtggaaaaaatngggggagcacngntnaatgaactnggaagangtaaatgnnaagtgggaaccaatgactcccgttgaattccccgntggttaanttaaacccggtt

SEQ ID NO: 98863 - DNA, 351 bp, Triticum aestivum
  unsure (1)..(351): unsure at all n locations
  Clone ID: PAT_TA_98863
ccatctggaccggntgattggngcacaaacaccggagcgaanagcggngggaggcggtcccntgccgtcctttattcttaaaaaaaatcngntcngtcccntgcaanggcggngggggnggncatntctgtcgaantcgtcctctgggtcttctccttcncctctgtgatgggcccccntangcctcaccgcctaccaannatatctgcctatcnganttggngtttggctatatcaatccacatgagtcatcaactcgcatcaatgnaagtggnnagaatanaataagcactccaaagggggcctctgcgngtctttcctcntnacgccgaaattgggttccgtttccaa

SEQ ID NO: 98864 - DNA, 603 bp, Triticum aestivum
  unsure (1)..(603): unsure at all n locations
  Clone ID: PAT_TA_98864
agctgagatgaacaagaggtctttcaagtacgcctgggtgcttgacaagctgaaggccgagcgtgagaggggtatcaccattgatattgccctgtggaaagttcgagaccaccaagtactactgcaccgtcattgatgcccctgngtcaccgtgacttcatcaagaacatgattactggtacctcccaggctgactgtgctgtgctcatcattgactccaccactggtggttttgaggctggtatctccaangatggccaaacccgtgagcacgccctccttgctttcactcttggagtgaagcaaatgatctgctgctgcaacaagatggatgccaccacccccaagtactcgaagggcccgttatgaggaaattgtcaaggaagtctcttcctactgaagaaagtcgggtacaaccctgacaaagtttcctttgtccccatctctgggtttgaagggtgacaacatgattgagaaggtcaacaaccttngactggtnacaaggggccctaaccttccttgaggntcttgacaagattaaacgannccnaagaggccctcaanaaaagccccnccgttctccccctcaaggactttnaaang

SEQ ID NO: 98865 - DNA, 599 bp, Triticum aestivum
  unsure (1)..(599): unsure at all n locations
  Clone ID: PAT_TA_98865
ctcccgcctaccaagccaccgaccaacatggcagcgtctctccaagccgcggccacgctgatgccggccaagatcggcggccgggcctcctccgcgcggccgtcgtcncacgtcgcccgggcgttcggcgttgacgctggcgccaggatcacctgctccctgcagtccgacatcagggaggtcgcaagcaagtgcgccgacgccgccaagatggccggcttccccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacngcggcgtcgactccttccccttcaaggccgggcaagtacgagatgaagaagttctgcctggaggccacctccttcaacgtccaaggccgagggcatccaagaagaacgagncgnccggcttccaagaanaccaagctcatgacncgtcctaactacacccttgacnanatggaaggnccgctcgaggtccgggncgncggcacctcaagttcnaggagnaagncggnatctactt

SEQ ID NO: 98866 - DNA, 521 bp, Triticum aestivum
  unsure (1)..(521): unsure at all n locations
  Clone ID: PAT_TA_98866
gctatatacctacatantacagccatggnccccaccgtgatggnctcgtcgggcacctccgtcnctcctttccangggctcaantccancgccgggctccccntcagccgccgctccaanggggctagcctcngnagcgtcagcaacggtggnaggatcaggtgcatgcangtgtggnccatcnagggnatcaaaaanttnnagaccctgtcttatctgccaccgctcaanacggaggncctcctcaancangtcnactacctgatccgctccaantgggtgccntgcctcnagttcaacaaagntgggttcatcttccgtgagcacaaacgcatctcctgggtactacaatgggcggtattngncaatgtggganctgcctatnttcgggtggactgacgccacacaagggatnaancnaggtggggggggtcaanaaagggtaacctgaagcctnntttcccanancggnttcnacaacatnctcacggtgcatgtgtcaaattnatccccttaaacca

SEQ ID NO: 98867 - DNA, 231 bp, Triticum aestivum
  unsure (1)..(231): unsure at all n locations
  Clone ID: PAT_TA_98867
aaacttactnaccgggggggggcctacaacagtgatnccggnctcancaattcacacgaggcngtacctgctcancgancgcttcncttccccaacnactncnttctcatcctcacacaccattatatcaatccctncangcagccgaccaangacaacatccgcatgncnatgnactccctgctgcacgcgttcatctacnnccaactccctggtnttccanttctctgg

SEQ ID NO: 98868 - DNA, 514 bp, Triticum aestivum
  unsure (1)..(514): unsure at all n locations
  Clone ID: PAT_TA_98868
ggtctctggctaccaatgcctcctganggccttngagataacccncaagttnaatgaacaancctgtgaggattcttgtnaagaganatnagcttancccttnagggnatcaagcaattctntgtnaacgtngagaaagnaaaatggaagctgggtacaactcctgtgacctggtatgagaccttgggaatcaaccannagtggtcatccttngtgaacaaccncccncaagggtggggactggntcaaccgacaaagatnagggggaaaggggattcaanactgtctcctggncaacgcaacgggngaacattnggccaanaacactaaggggacaattcatcaatgaaggggaaggttcaanattctggggntntttctccgtgtggtcaatcaaacaaaccgaacccttggctggggcccggtggggnatttgatgttgcnaacaaagtcctcccctttgtcatcaaactaacgaacctngccggnctncaacccttgaggaaantaacct

SEQ ID NO: 98869 - DNA, 482 bp, Triticum aestivum
  unsure (1)..(482): unsure at all n locations
  Clone ID: PAT_TA_98869
gtgcactgttagctacagaccaagaagtgatnatggnccgcgctcangtaatgctcatggncgtcgccttggtgctgatgctcgcggcggtcccgcgcgctgccgtggtcatcnactgcggccacgttgacancttggtgagancctgcctgagctacgttcagggcggccccaccccntctgggnagtgctgcggcggcgtccanaacctccataancaggcgcaatccaagagcgatngncaagccgcttgnaactgcctcaaggggatcnntcgtggnatccacaatctcaacnaggacaacncccgcagcctcncccccaagtgcggtgtcaacctcccataacacatcagtctngacatcgactgcaacantgtgtnatgagcgacgattcntcaagctggtggtcaactcatccatccacgtggngtttnagcgcgcancctcctatccctaagtnntatgggcacanttttncgg

SEQ ID NO: 98870 - DNA, 485 bp, Triticum aestivum
  unsure (1)..(485): unsure at all n locations
  Clone ID: PAT_TA_98870
ccaagccaaatncaaagcgacaanaaaaaanctcgagctcttgcttgggtggncgagcgagcaaaccccnattncagcaataacancaangaggaggaagatgtcctcggtgttcaacngcgatgagaacggccccttcttcngctttntcggcgncgccgcgggtctcntcttctcatgtntnggggnggnctacgggacggncaaaancngcgtcngcgtggcgtccaagggagtcatgngcccngagntcgtcatgaagtncancatgnccgttgtnatggctggagtgntcngtatctaccggcttattatngctgtnatcaacaataccgggattaaacccaaaggcaaggcctaataactcctccncggggtaagnccaactcctctccggggtcgcctgtnggcttngcgggacttnctgcttgggaatgggcaancnggcaatngttggtggatgctggggtcaagggnaaatgctn

SEQ ID NO: 98871 - DNA, 481 bp, Triticum aestivum
  Clone ID: PAT_TA_98871
cccccgccggtcgcagccgcataccctaggcctggttcttgaggtcgggctgcgcatcaatgacaatcaggtgcagctagacgacgcccgctcatcccttctctcatacttgcagggagtacctcctgcggcaagccacgggagccagcatcgtccgtgccccgccgacgagatctagaatcccttagatttctccgtccttggttgggttgtgccaaggttccggcgtggcctagctgctagttaagttgtgggctgatctcaccatgaagctactgtcccactccttcacaaaaggcagtaaataggtctcctgtactaaagagattccagggagagaaaaaggacactgatggtttaccgactgccagcgaagccacaaaaaggctaatataaatttcttttgagagattctacttttgcaccacttatttctgtgatacaagtctctgggagaatcataagaatattgttaggaaaa

SEQ ID NO: 98872 - DNA, 533 bp, Triticum aestivum
  unsure (1)..(533): unsure at all n locations
  Clone ID: PAT_TA_98872
ncaaaaaaaaaanctaccccnccctgggttcccaagnaaagcangaattccgcacgtaggctgcttctgccaaacttctgccaacttctgccttgccgctgcatggaagtcgcctcgccgccaccatanccgcccatcgtcactttccagcaaggtgcacacacgcacccaacatccatccatccccaggggagatcagcatgtgaacanccacggccatttctcttggccagcacaagcagtgccatcggcagtcaccgacaagcanccaacaacctggagaaagtcctgaatctggttaaagagttttcttgttggtacatttttttgacttatatttgttgtttaagggtcattaacactgaaataaacacatgtgtgcgtnaaaagatatgtcngcancaagaaagacaangctggtgtgggnagttcatgtttttgacttatagtcagtacatctccaccttgntcgacgncggatgccnacagtcctccaancaagaacaagggttgggnagttaatccacggttcc

SEQ ID NO: 98873 - DNA, 366 bp, Triticum aestivum
  unsure (1)..(366): unsure at all n locations
  Clone ID: PAT_TA_98873
cgcatcgcctcgcgcccgcaccccaagaaggtaagttcaanggctgtcctgagaagctcaaatggctcccaaagttgctgttgccaanaagggcgatgccaaggcccaagccgccaaggntgccaagggntgtgaagtctgggtcnatcaacaaganggcaaagaagatccgcacttctgtgntatttcaccgccccaagaccctgtccaangncaagggccccaantnccccangatcaagacncctgggaggngacaaggtcnatcaatattaanatnctcaatttccgcttaccactnagtctgcaatgtgagaagatcgaggataaaaaaaaaaaccacttcatccntcaacctnaanggcg

SEQ ID NO: 98874 - DNA, 170 bp, Triticum aestivum
  unsure (1)..(170): unsure at all n locations
  Clone ID: PAT_TA_98874
nggnaaatctatccatcttntcatctccagctgagctcancaacactaatactgcaaactccatngggatggntcgcgctgcaactactcaactcgtgctggtcgccttggtgggcgctatgctcctcntnnccacggangcggncatctcctgcggtcangtgngntct

SEQ ID NO: 98875 - DNA, 431 bp, Triticum aestivum
  unsure (1)..(431): unsure at all n locations
  Clone ID: PAT_TA_98875
ngntactcctggtgctgctaatcggactcccgggcgcccccgccgtcgccgccaanatgaacgaagtctgcgtcaaaggcgccgtcgggcancccgacacgctcggngactgtcccttctcccanagggtgntgctcacnctggnggngaanaangtgccctaccaaatgaanctcatcnacgtcancaacaancccgactggttcctgaagatnaatccanagggcaaggngcccgtgtntaacggtggtgatgggaaatggattgctgattctnatgtgatcacncnaagtcattggnggggaagtacccaactccaacacttgttactccnccnnagtatgcaacantgggatnaaaaatnttctccaacttcntcaaanttnttnaataacaaggatnccancgatgggtccgagaaagngcttgtt

SEQ ID NO: 98876 - DNA, 155 bp, Triticum aestivum
  unsure (1)..(155): unsure at all n locations
  Clone ID: PAT_TA_98876
ggggaagcntaaaactactggctccccgggctgcangaattccgnacgangtaatatatactacttggtnnaaagtccancaaacccccatcccacntncaagaaaaaaancgcctggagcttgccatggntgccaatccaaatnggnaggtgtg

SEQ ID NO: 98877 - DNA, 554 bp, Triticum aestivum
  unsure (1)..(554): unsure at all n locations
  Clone ID: PAT_TA_98877
aaacaaaaanaagctttttttnaagcnancaaaaccccccgggggaaattttttntnatcnactanctnaaagtcaaatanaagcggcntgttggccaaaaaaagcaanctaaaaaatgtgnaagnccatgggcaatgcgggaggcccngnggacggggttgtggtcaaattntnccccccccccgtntccaangggggggggtcatcaaanggtgggtcaaacatcnaaccgggggggggggattccgggggtctcatcccctcccaancaaacctcgcctgggctcgaggtccaaaanctcccaaagaaactgtgacgggggcccgggacgcnccncatcncaaaactaaattnttacgtgatntccggggacnnaaacaaaaggcggggctgggtcaaagtncaattctgggggcgcggcccgnggggaagaaaaaaaanggggcggctcttttttgggcaaaggggaaatcaaaaaaagttntnttcttccacaaacgggggccaaaganttttttcccccaaanaaggaancttgggggantttttgtc

SEQ ID NO: 98878 - DNA, 251 bp, Triticum aestivum
  unsure (1)..(251): unsure at all n locations
  Clone ID: PAT_TA_98878
gnctctcttntctcaacaaaanaagaatccctttccccttcttcgtacgcctccangccatctaactcgctcggnttaatggcgtcggggggggngcttccanaagtgagcgggatggcaagggcgggggcggnngaagccgttgtgggccaaaacntccaattccctttnncaaangagggnntctccntcnangaaactgcnggtccagggtcgtctggancgaangaangccgcnaagntcgcanaac

SEQ ID NO: 98879 - DNA, 180 bp, Triticum aestivum
  unsure (1)..(180): unsure at all n locations
  Clone ID: PAT_TA_98879
cccaaaccccataanaccgacgacgggcatgtntcccctcancancgtcctcgtcctcnccgtgggcgcgacgggcgcgccgctatnanaanccgcctgcgccgacgggggggccannatnctgcacggggtggggaangacgtgctcctggagtanggnctccccaangggctcctccc

SEQ ID NO: 98880 - DNA, 337 bp, Triticum aestivum
  unsure (1)..(337): unsure at all n locations
  Clone ID: PAT_TA_98880
nggtaaaaaacaacaaccgcancgcgacaccgcgaggaaaacctancgccgccgacgcanaagcaaccatgggtatcgacctcntccccggcgggaggaacaagaggaccaancgcgtcncgcccaantccgacgatgtctanctcaanctcctcgtcaanctctaccgtttnctggtgaggaggaccaaaagcaanttnaangccntcatcctcaaaagggtcttcatgancaaaactaaacgcccgccgctctccatgngccgcctctccaacttcattaagggaaaggnggngaagaacantgctgtggttgttggtacaatcacanatgacat

SEQ ID NO: 98881 - DNA, 496 bp, Triticum aestivum
  unsure (1)..(496): unsure at all n locations
  Clone ID: PAT_TA_98881
gtggggaangaacaaaaataatngnatcccccgggctgcaagnattcggnacgaaggtttctcctcctcttcctcccgctcaatcccgaaagcgaagcctcnaagagctcccaatgggttncancaangttctcctccggcttntccancctctctctcccctcttcctcaacanccccctccgcctcgggccccaagaacctccccgtcgccaancgccgccgccgcgccgtcgccgtcgcctccancgtcantgagtccccgaaggnccttgnnctcggcgacgccattgncgggntcaaccttgnggaggntcgcaaccttgtngaccatctccaaaaangtcttggggtctctgccgcctccttcnttcccnctgccgcggtcgcgggtccccccgcggcggggggccgangaggnaccggtcnanaaaanagagttctncctggtcaccaaggagggggccaanaacncgcgttttcaaacnannaaggtt

SEQ ID NO: 98882 - DNA, 482 bp, Triticum aestivum
  unsure (1)..(482): unsure at all n locations
  Clone ID: PAT_TA_98882
tcgcatcgcctcgcgcccgcaccccangaaggnaagttcaagggctgtcctgagaagctcaaatggctcccaaagttgctgttgccaanaanggcgatgccaaggnccangccgccaaggttgccaaggntgtgaagtctgggtcaatcaanaagacggnaaagaagatccgcacttctgtgacatttcaccgccccaagaccctgtccaaggncagggaccccaagtnccccaggatcagcacccctgggaggaacaagctcgatcaatatcanatcctcaagtacccgcttaccactgagtctgcaatgaagaagatcnaggggnaaaaaaacactcgtcttcatcgtcgacctgaagggcgacaagaaaaanattaanggcgctgtcaagaaaatgtncgacattcaaggcaagaaggnttaaaccctcatcaagcctgntggnaaaaaaaaagggtacgtgaagctgacaacaaacna

SEQ ID NO: 98883 - DNA, 467 bp, Triticum aestivum
  unsure (1)..(467): unsure at all n locations
  Clone ID: PAT_TA_98883
ngggatttgaanctgctggggctgctggtgaacccgttcgtganccgcgtccgcctggngctgcacatcaagggcctgagctacgaataaatccanacggncgtgctggacaanggngagctcctcctccgatacaancccgtccanaaaaangtgnccgtgctcatccacaaagggctgccgctctgcgagtnacaaatnatcgtgcantacntcgacnaantctggggcgccgccggggcgcccatcctccccgccgaaccctaagcccgcgccaacggccgcttntggggcgcctangttgaaaaaaaactgtttcccnccctggggtggggatcctcttgggccccnacccaaggcggcgaanggcggganaaaggtcccgggaanaaancttcgccgcgctcgcgcaaaattgaagtgggccccggncgaatttctggaaaaacgggaaaggaagggccctt

SEQ ID NO: 98884 - DNA, 240 bp, Triticum aestivum
  unsure (1)..(240): unsure at all n locations
  Clone ID: PAT_TA_98884
gacaaaancaaangaaactcttccttcttcttcttcttcttccttcttcttcttcctccggggggtntcatcttcanatnacatccaagcagcgcaagcangagangagacgcggtccctcgctcgctccaccgtncanaaacaaaccaagcaaanggnancgatggngttnnacaaagtggagganctgcggncgggcacctangggcanaanctccaactccgggtggtcaactccaa

SEQ ID NO: 98885 - DNA, 423 bp, Triticum aestivum
  unsure (1)..(423): unsure at all n locations
  Clone ID: PAT_TA_98885
agtcgactctggnaagtcgaccancactgggcatctgatntacaancttggaggtattgacaagcgtgtgatntaaaggttctagaaagaagccgctgagatgaacaanaggtctttcaagtacgcctgggtgcttgacaanctgaangncgagcgtgagaggggtatcaccattgatattgccctgtggaagttcnagaccaccaagtactactgcaccgtcattgatgcccctggtcaccgtgacttcatcaagaacatgattactggnacctcccangctgactgtgctgtgntcaacantgactccaccactggtggntttgnggntggnatctccaaagatgggcanacccgtgagnangcccctccntgctttcactcttggngtgaaacaaattatntnctggctgcaacaaagaa

SEQ ID NO: 98886 - DNA, 446 bp, Triticum aestivum
  unsure (1)..(446): unsure at all n locations
  Clone ID: PAT_TA_98886
acgagctaatacggtgcactgttagctacanaccaaaaagtgatnatngnccgcgctcaagtaatgctcatggncgtcnccttggtgctcatgctcgcgggggtcccgcgcgctgccgtgggcatcnactgcgggcacgttgacancttggtgagancctgcctgagctacgttcaagggggncccggcccgtctgggnagtgctgcgacggcgtcaaaaanctccataaacangcgcgatnccaaancgatngccaaaacgcttgnnactgcctcaangggntngctcgtgggatccacaatctcaacgaggagaacgcccgcagcancccccccnagtggggngtgaaactcccatacancancantctnaacanccactgcagcaaggtgnnatggggggncnattcgtccaactgggnggtaagctcanccaaccaccttgg

SEQ ID NO: 98887 - DNA, 207 bp, Triticum aestivum
  unsure (1)..(207): unsure at all n locations
  Clone ID: PAT_TA_98887
acaaaaaacgaagcaaaaacttntnnaacttaacgtccgtatgnacaaaanagcttccnaangatgaacgtgggngatncttgacgggaggacggtgcaaaacttccttcnangacgagggngncttcaacnactccgtcgacgggcgcttcgcngcgctccacgccgaccaagaagggntcctctcctaccccnanangggccggg

SEQ ID NO: 98888 - DNA, 484 bp, Triticum aestivum
  unsure (1)..(484): unsure at all n locations
  Clone ID: PAT_TA_98888
aatttcttccgaggtccgaccgctttcggngcctccgcgcccaccttgccgaagagctcctctacctccantggctggcgccgatgcggnatctccttgattccctccccgcacccancancgtctgctccancgcgggggggcctggcaagctcttccacgccggcgtcggtggagctgctacaaaaggcacggaggcgtaagcgagagggccantaaagcgtgcgtggacttcgttcggagaggcggtcggttgacgctgctcctgcaagagcaaggggaaatgaaatctttccnacatgaanaaaacangttggnttcggctaaacaaagaagttaagaatttatgatacatagtgctaatatctcangaaaaaagcccaaaagagaantcnaagaaatgtggtaaagacatggagattggnaaagggtggaccaaacataccacttnngaatgggangngttacataacacaatcaatgg

SEQ ID NO: 98889 - DNA, 462 bp, Triticum aestivum
  unsure (1)..(462): unsure at all n locations
  Clone ID: PAT_TA_98889
gcttaancacactcatctgatcacccactagctagccagctacgcagcttaaggaactagcttgcagctagcgatccatggctcgtctcaacagcaaggctgtggcggccgccgtggtcctggcggcggtggtgctgatgatggccggcagggaggcctcggcggcgctgtcntgcgggcaggtggactccaaagctcgcgccgtgcgtggcgtangtgacggggagggcgtcctcgatcagcaaggagtgctgctccggccgtgcaggggctgaaacggcctgngcccgcagcagcccggaccgcaaggatagcgttgcaggtgcctcaaagagcctcgccaccagcatcaagtccatcaacatggggcaaaggtctccggcgtgccccggcaagtgccggcgtcagcgtgccccttcccccatcaagccatgtccaaccaaacttgcaacaatgttcaan

SEQ ID NO: 98890 - DNA, 480 bp, Triticum aestivum
  unsure (1)..(480): unsure at all n locations
  Clone ID: PAT_TA_98890
gtgcggtgcgatgcgcggaggcgaggaggagtagttggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggggacaccaccaatggctgcatgtcaactggaccacacttcaaccccgctggtcatgttgcatggggcaccccgangatgaaatccgccatgctggtgaatctttggaaatgtgacaagctgngangcgggntggtggttgcctacncaatcaaatgtttnctggactgccaatatcccccctttactgggnccaaaanttcaaattgttttggccgtggctgtttgtcngtccaatnngtgaaccccttgattgatcttgggnaaagggg

SEQ ID NO: 98891 - DNA, 491 bp, Triticum aestivum
  unsure (1)..(491): unsure at all n locations
  Clone ID: PAT_TA_98891
agaattcctgatcgaaaacttctggccagactagttatagtaagagaggaagctcgaaatatgatgggaggtggccttttaagatgaaagaaatgatcgtggtctcaatacccttcctcaagcagaggtgaacttcttgagcaaactggtcgctctcaagccaagggaaagcagtgggagaagatgatcagtgatgttatgcatggcaaagaggaaggtgctgataacactgaaagcacaaatgccgggaccaaattctgacctgggaaccttcaactggggacatctgggaaaggggaaaatgcaacaagggccgcaagccacaagcctgtccggcctggaatgttcctccgaagaacaagtttctaaaggtcttaaggccgggcaatatnatgcaanagaaacacaatctggntattacaggcaacaaacaatctnaggaatgggggtacaatcaaaacnaacaactngaaaagttccntcanggaaan

SEQ ID NO: 98892 - DNA, 449 bp, Triticum aestivum
  unsure (1)..(449): unsure at all n locations
  Clone ID: PAT_TA_98892
ctctgcccgtcgtgcgttgactcagccgtcgatttcctctcgctcggcgaccatggcggcggcgccgaggcacagctgcgcgaagctctcggtggcggtcgaggaccccaaggcgccgggcggcggcggcatattcgtgaaggccacgtggctccccacccgcttctccctcgccgtcaccgacggcgccggcgcctgggtcgccgacgcctccgacgccgaggtgcgcctccgggccgagcagtgggaccaagcccgtctccgagtacctcgccctcgccgagcgctacctcgccttccaccaagccctcctccacctactccttccacgaggctggcgccggccgcaggttgtcatggacattcgaaaaacaaggtaccaagctggaatggcgttggaaactgcagccggcaccccanccggcaacaagactattgctgaggtcctg

SEQ ID NO: 98893 - DNA, 470 bp, Triticum aestivum
  unsure (1)..(470): unsure at all n locations
  Clone ID: PAT_TA_98893
aaaattccggggtggtttattctattataaagctacgaaaagaaacancaatggggagttgtttaaggacggacaaaagccatgagttgttttgctgagaaaagaaacaagtaatatcacattctgaaggttcatttccatctatacgggtgaggagtccttaaaatgtgaagtattgtaggtttctaaccatgtacataggtcgtacacagctaagcactcgagctatgattattgttatgtatgggnttaatagtgataatcattgtttggttcaggcattgaacagctaaaactaactcaaaagtatatgtttgtttcaaaataaatgatgtacctaaagaactttattgatgatcaggcgttgtatttcgaatgccacctggggaatcaaattcagaaatgccctgnagggattggatttccttctgtttgggccatggttgttnaanaaatacgggaagcaagcn

SEQ ID NO: 98894 - DNA, 554 bp, Triticum aestivum
  unsure (1)..(554): unsure at all n locations
  Clone ID: PAT_TA_98894
agcctccccactcgctgcatgactgcacgggtaatggtgatggnggcggcnaggagagccctccttaaccacttccgcgtgccggtggcgcgccccgcggtcgcaagcggggagcaggcgggaaagcgtccccggtcgccaggctcctgtcttccacctcggggagngtgggaagaaaggggctctttcctcgacnaaagggggcggaaggtcgccggaccgcgtccgtctccgtcatcaaagaaacttccaagnaangtatccgaaaccctccaagggtggaccccnaaatggcaacatttcccaaggaagggacctccggggttgngtacaaggcctgggtacaccggtccggaagaattggtcnatgggccctttggacggggaaaggaanttcaagctttccggacgaantcccccggnacaaattgangngnaagaagaaaagaattggattcccatcaangatccaagcaggttgtaccttcaatcgnccctccngcaatccctcaaangccaaaaagntaangattttggcgnttgcaagccgggtt

SEQ ID NO: 98895 - DNA, 235 bp, Triticum aestivum
  unsure (1)..(235): unsure at all n locations
  Clone ID: PAT_TA_98895
ctttcgnccccaaccttccttctgntagggttggcgccgccaggctgctccccgccgcngctgctcancacggaagcccctccccaagtccttccccgcccgacccgagctccancgctaaccgncccgacccggccggncctcccttccctccgnccggaagnaggccgncacnatccgcgcccagntgccccgtctcctctgcggtcagnctnccaccgcgcccgctgngtgg

SEQ ID NO: 98896 - DNA, 454 bp, Triticum aestivum
  unsure (1)..(454): unsure at all n locations
  Clone ID: PAT_TA_98896
tcaccaacggcgattcgcgggcatggggttcccgcccccctctgctcgcgcgtgtcggagagcaagcgcaacgcgtggagcgcgtttgccgctgttcaatcggattccgaattcgaccgggggtggcgctctgctcgcctccgactggagtacggccaccgcctcgccgggagatataagctccattgggggcctcgtgatgctccgccggtggcagagcttctacggcgccttcgaccccgtggacgccgccatcgaggccgccgacccggaccaagttttcacgccacgtgttccggcgcgcgagggggacctgttggggcggctctgcancgccgccgacgacgaccaaggcgggagcgcatctggcgggattctcgacgaacgtcatggnaagagtctctcgaanacgcctgagggtggttccatcatcaacgccangaggcgcccgtcn

SEQ ID NO: 98897 - DNA, 479 bp, Triticum aestivum
  unsure (1)..(479): unsure at all n locations
  Clone ID: PAT_TA_98897
gttcccggtgatntacaccggcggcatcaaccccctcatctgggcgcccaatcaccagcattggctcgttcaatctgcccacctacgacatcgagctcacgccgttcttggggaagctgctggacggcaaggagcacgaggtcgggttcgcggtgaccaacgcncagaactcgtgggnacgtgaacgggcaacctccacctctgggctcgaccccaagagntccacgaccaccgggcggcctcatctcctacgacncgccgaaagctgtcggggaagcatcacatcgccactccgtggacggcatcgacggggaagtaccgcgccgacggtgaagcccgcaacatctcgatcacgggggtggggtaaagcctcgtccgncgccggcaacatcaaccaccaacgttcgccccagccggntcaagcctttcgcgnaaactcngaanngtgggtgagncaaaccaaggggcaagctncccaa

SEQ ID NO: 98898 - DNA, 492 bp, Triticum aestivum
  unsure (1)..(492): unsure at all n locations
  Clone ID: PAT_TA_98898
cagatcaggagcgncctctctcccccgccccctccccccaggaaaccagccatgaagggggccaaatccaanggcgccgccaaggccgacgccaagttggcggtgaagagcaagggggcggnnaagccggccgccaaggggaanaagggcaaggncggncaaggaccccancaagcccaagangggcgccatccgccttcttcgtcttcatggggcnaagttccgcnaggagttcatncagaaagaaccccaacaacaagtccgtcgccggccgntcngcnaaagcggccggctgannaggtgngaatgagctttgattcganatcnggaaaaaggnccccctaatgtnggccannggccaaacaangctcaaaggggccgaagntacaancaacggnccaatttgctggnccttancaaacaaangggcgganananaccgcttggncttgctgtcttgcccccnaaaaganaagggtggncggccccaaa

SEQ ID NO: 98899 - DNA, 479 bp, Triticum aestivum
  unsure (1)..(479): unsure at all n locations
  Clone ID: PAT_TA_98899
gaaaccctagcagatcgctcgagccctccgccgccgccgcggacttcagctctctccttccttctccgattcaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctggtaanggagaagtttgctgcggttccatctggtggtggtggtgtggctgtttcagctgctgcccctgctgctggaggtgctgctgcccctgcaagctgagtccaaaggaaaaggaataagaaangtcntgggcgaaaggaaagaagagtggattgattgacatggggccttcaagtcctggtttccgacctaaagtttgtgggggggcatccttggtggtccntgaaataan

SEQ ID NO: 98900 - DNA, 485 bp, Triticum aestivum
  unsure (1)..(485): unsure at all n locations
  Clone ID: PAT_TA_98900
atcactagctaatacggtgcactgttatgctacanaccaagaagtgatcatggcccgcgctcaggtaatgctcatggncgtcgccttggtgctgaatgctcgcggnggtcccgcgcgctgccgtggccatcgactgcggccacgttgacagcttggtgagaccctgcctgagctacgttcagggcggccccagcccgtctgggcaagtgctgcggcggngtccagagcctccataancaaggcgcaatccaaagagcgatcgccaagccgcttgcaatctgcctcaagggtgatcgctcgtggcatccacanatcctcaaacggagggacaacncccgcagccctccgccccccaaagtggcgggtggtcaactctccccataaccacatcaagtctccgacaatcgacttgcangcaagtntgttantgaagcgaacgatccgttcaanctggntgctcaagctcaatccantccaacgttggg

SEQ ID NO: 98901 - DNA, 480 bp, Triticum aestivum
  unsure (1)..(480): unsure at all n locations
  Clone ID: PAT_TA_98901
agcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccgggggagaccggcggctgcgactgcaccacctgcaagtgcggcaccgcgtgccgggctgctcctgcctgcagcctgcaaactgangccggcgcccaggnaggccgggcccggncagaaggccgaagcacgtanggattgaaggaggatcaagcaangcaanggcaccatcaccaccaagttcancaaccacccaagcgtaatcatcaccaagcccgcccgncaatgcgcttcngcggggn

SEQ ID NO: 98902 - DNA, 345 bp, Triticum aestivum
  unsure (1)..(345): unsure at all n locations
  Clone ID: PAT_TA_98902
ncaatcctcantccccnaaacaanccaccanccaaanccgatggcccgcactaagcangacggcgaggaantccacnggnggcaatcgtcgccgcancaancagctggccaccaacgnggcgcgcaantcggncccggccaccgcgcggcgtnaanaagccgcancgnttccgccccggcaccgtggcgctccgggagatccncangtaccananagagcacggagctgctcatccgcaagctgcccttccagcgccctcgtcagggagatcncggcagtgacttcaagacctgacctgaaggttccagttcctccgcnngtgtcggtcgcttgcacggacggcc

SEQ ID NO: 98903 - DNA, 303 bp, Triticum aestivum
  unsure (1)..(303): unsure at all n locations
  Clone ID: PAT_TA_98903
aaagagaagcngganagctcggtggtgacggacgagcgcggtncaagganctcggcgganaaggatgccangcactgaggtggacaataaggagggcanggccancaaaccaaatgctggcaatggtcttnatatggaaaaatattcctggnctcacgcanttaccaagagggttaatgttaagtgttcctgttcctgaaacgaacaaagtcaaggtttgttgtctgtganattaaanangatcatctgaangttgngctganaggccanccctcctaacattgntnggngaccttcacanaa

SEQ ID NO: 98904 - DNA, 526 bp, Triticum aestivum
  unsure (1)..(526): unsure at all n locations
  Clone ID: PAT_TA_98904
gcggcagccatggcccccaaggcagacaagaagccggcggccgagaacaaggtcgagaaggcggcggagaagacccccgcgggcaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaagtgcaccccgacatcggcatctcctccaagggcatgtccatcatgaactccttcatcaacgacatcttctngaagctcgccggcgaagtcgggcaagctcgcgaggtacaaacaaagaaagcccaccatcacctccccggggagattcaaaactccgttccggccttcgtccttcccggggaggctcgccaaagcaacgccgttctncngaggggaacaaagggcgtcaccaaaagttcnanctccctcctaaaanagttnattgcnacaaaattttatttgggttgct

SEQ ID NO: 98905 - DNA, 467 bp, Triticum aestivum
  unsure (1)..(467): unsure at all n locations
  Clone ID: PAT_TA_98905
naaactcnctcccatctccgncgccgccgccgctcgcctcgcaagatgggggtgcctatcctgaaagaccgtgattgtgannaaagagggtgnngtacttcaagaaggcgcacancgaccgctacatcggcctcaagcaaagctggcgcaagccacagggtatanactcccgccgtcaggcggaagttcaagggatncaccttgatgcccancaattggggtatggttctaacaagaaagaccanncactaccctgncaaanaaagttcaagaacgtttgtgggtggcancaacntctcctgangctgggaagcctggcntaatgaagcaacaaacaaggaacnctacctggngnctgagattcgccgcaacaancngtnttccancggcaagnatgncgccaaagggcgaatcagttggaagcgtgcccgncccnagcctcgaacngtcggtgggttcanccaaac

SEQ ID NO: 98906 - DNA, 507 bp, Triticum aestivum
  unsure (1)..(507): unsure at all n locations
  Clone ID: PAT_TA_98906
ggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaagcttctttatgacaacaaggggcgcttcccgccttcaatctgtcangggatgagggatgctaagttcaagctctgcaanggcagggcctgtccaanttccggccaagaangggcatcccctaac

SEQ ID NO: 98907 - DNA, 510 bp, Triticum aestivum
  unsure (1)..(510): unsure at all n locations
  Clone ID: PAT_TA_98907
gagcanaaccgcgacgcgatngagtgatngagtgcacggtcggtcggcgatnatggngaacangacggtggatgtcaacctggtctccgcgagggacctcanggacgtcaacctcgtctccaagatggaggtatacgcggtcgtctanctcgccggngaccccatctcccgggagcgggtcctcgccgaccgcaacggggggcgcaaccccaactggaacgccactgtccgcgtcacggtcccaacctccggctccggtagcggngcccttgcgcgtactcctccgcacaagagcgccccctcggcgaccgcgaagtggggggaggtgattctccccgctcaaccgagattctaacccggngccgggggacgagccaaacaaggcgccaaccaaaggngcctacaaaggtggcgcaaggtcgggttctancaaaggntcanngggtgntcaaacctctcctacaaagcntcggagggagtcaatccaaccaacccgccgggtcaattaca

SEQ ID NO: 98908 - DNA, 511 bp, Triticum aestivum
  unsure (1)..(511): unsure at all n locations
  Clone ID: PAT_TA_98908
gctagcaaacgcacgtcgtagctctagcttaactaagctaacccaagccaggtagccagccatgaacatgaactacggctccatgggtcctggcgcgatggtgcggtgcaggcagtgcaactcgagctgcgggggcccatcaacgacgtcaagtgcatgcgctacctgctcaccgaagcgcttcggcttccccaacgactgcgtcctcatcctcaccgatgaggagaggaacccgtgcangcagcccgactaaggacaacatccgcatggcgatgcactggctggtgcanggggtgcagctacggngactccctggtattcaagttctccggcctgggggcgcangtccccgacgacaacggggacnaactggacgggatggacgaaggcctctgccccgtggantcgttcaacaagggccccatcctggnccgacgagntaacgaaggccatcgtncgcccgnctggngnaagggggttaaagctcaaancnatncttcgaaggccttgg

SEQ ID NO: 98909 - DNA, 500 bp, Triticum aestivum
  unsure (1)..(500): unsure at all n locations
  Clone ID: PAT_TA_98909
agatcctcgggatgtttcccgctcttcgtgttctccaagctttgggccaacacatcttggtacacccgtgttgaaatgtttgttgttagcgctaacgcattcccatgtttgngagagtgcatcttctctggntttctcacggtgccatctatgttttcacgaggagctatgccacagcttgaaatcctgtggntcgatgccccagcgtcggacattgccagtggtgagctggatgtcggcatggggcacctcccttccctccggaaagtcaaggnttacttttgggcgtgaggaaggcagctcttcggataagtgcaaggaggaaagcggatgtantgctgaggcatgcagcggncatccatcccaaccgtcccacccttgagacctatccaatatcgtctctaatgatgtcnacgatctctagccgggcaaagctctgtttgctgctttgacntgttctgcagctgggttttccccttgttgnaagctgctgttctggg

SEQ ID NO: 98910 - DNA, 503 bp, Triticum aestivum
  unsure (1)..(503): unsure at all n locations
  Clone ID: PAT_TA_98910
cgacaatgagggtgaattcaagtcctacctcaaagaccattacccgctcctcaccgacgaagacctgagcacgctcgtcagtacgtaccctaacgaccgacactggcccgacagcggcgcatggtgggacgctgtagcgaaagcccagggcgacatccgctacatttgccctacatacctcgcatccaacgccatgtccgaactcaaccccgaaaacgtgcctacgtaccaataccaatgggacgtgatgtggggtgttgacatcgagaacggatacggtactaagcacgccggtaccgtcggacaggtcatggtacgccgccaaaacgagatttcagattacttcatcaagcttcatcaagttcctcgatcccaaccgcgaacatcaagtcattcctcggnaaagatgttaagattgccaagtgggagccgctggacaacacgggtcgcaaggatgttcttcacaaacatcaaaagaagggtgggtcacaagggtgacggca

SEQ ID NO: 98911 - DNA, 361 bp, Triticum aestivum
  unsure (1)..(361): unsure at all n locations
  Clone ID: PAT_TA_98911
agatcgctcgagccctccgccgccgccgcgccttcagctctctccttccttcaccgattcaagatgaaagttcatcgctgcctatctgcttgcttacctctctggcaacgccagcccctctgcangaggacctgacatccattcttgaagtcagttggtttgtgaaatcgacaatgagaagatgggaactcatgctgtcccaaagtggagggcaaaggacatcactgagctccttggctggctgggaangggaaaaattttgctgcgggtccnatctggggggggtggtggtgggtgtttcaagccgctggctcctggcggtgggnggaggttgncngccccttgcaagcntngagtcaaa

SEQ ID NO: 98912 - DNA, 164 bp, Triticum aestivum
  unsure (1)..(164): unsure at all n locations
  Clone ID: PAT_TA_98912
gttccttctagcgagcagatcnaccgtccccaacccanaactccccangccccaacaccagtccatcttcatggcgcgggtanccgtcctcctcctcgncctcttcgccgcggtcctcgcggncgccccggcggnggngntgggnggccgcggcgcgacgggtc

SEQ ID NO: 98913 - DNA, 272 bp, Triticum aestivum
  unsure (1)..(272): unsure at all n locations
  Clone ID: PAT_TA_98913
gccaagcaaagaacgaagcacaacacatctgtctgtcttccttcattcacacgcgcgtgngcgcaagagggggagaaangggattcctggntcggtggngctcngcnatgtnatggnncaaccncggcaacanaaaagaaaaggncgcctcgtcncggngctcctgtgtggtcctctccctctggtgncttgntctcctcgggggcccgcggcttctgtnaacatgtgttgaggcctcnncggnaagggtngccngggcnactgnatttnct

SEQ ID NO: 98914 - DNA, 520 bp, Triticum aestivum
  unsure (1)..(520): unsure at all n locations
  Clone ID: PAT_TA_98914
ggcggcatggagaaaacggcggcggcggtggcggtggcggccgaagaggagccggaggaagcgtgggcgtggacctggggcgcgggcacggacgggcagctggggaacggcggcttccaggactatcatctcccgcagccgctcctcctcccgcctcgctgccgcggccgcgtttccttcgtcgccggcggcggcgcccacgccatcgccctcacaagtgatggtgaagtatttacttggggcagaggtacccatggtcagcttggccatgggaacatagagaacatccctcatccaaagtccgttaagttctttgaaaactatacaagtaacctgtgtgtctactggatggaancattctggatttgctacagattctgggcaactcttcatgtgcggagatggntcatttggacaagcttggcactgggtgatactcaagtcaagggaactttgccatttgaaagtgccatccntttaccaacaaagcatgtttgagnaagctttgcattttggganc

SEQ ID NO: 98915 - DNA, 321 bp, Triticum aestivum
  unsure (1)..(321): unsure at all n locations
  Clone ID: PAT_TA_98915
cacgcgagcctcacactctctgatcaagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaaanacggaggaagcccccgcgccggtggaggccgaagtcgaggggcctgcccccgtcnaggttgaggangaccanaggaggaggcgccgggcagcagttntangcatnggngacgaangagcncgngccagaagctg

SEQ ID NO: 98916 - DNA, 531 bp, Triticum aestivum
  unsure (1)..(531): unsure at all n locations
  Clone ID: PAT_TA_98916
caacacttcagccagccgctagcaagagatggntctacttgctgccgctaccctgaatcccaccacccaccttagccttagaagccgtgcaggacgcaacagtgagaacctatggctccggtctgctgcttcatcacaagaagagcaagggaaggttctgtnacctcaccgtcagggcaggcacaccgtcaaagccagcagagcccattgggcctgtgttcactaaactcaagccctggcaaatccctaaaagggactggntcgacaaggacttcctctttggtgcctccacttcagcgtaccaaatttgaaaggtgcttggggatgaaaatggcaagggggcaagcacttgggaccacttctggcacaaatatcctgaagcgcatatcgggcaaggaccaatggggacgttcaacaanactcctaacaatcttgtnttgaaaaagggtgtcaaaagccgctgaanggncatggggcatggaaagngtataagggttctccaaactccctggggccgaggaaaaatngcnn

SEQ ID NO: 98917 - DNA, 467 bp, Triticum aestivum
  unsure (1)..(467): unsure at all n locations
  Clone ID: PAT_TA_98917
cggcgcaacacacacacacacanagaagccaagatgtncggncgcggnaagggagggaanggcctcngcaagggcggggccaancgccaccggaaggtgctccgcgacaacatccanggnatcaccaagccgggcatccggcgtctggntcgcaaggggggngtgaaacgcatctcnngggctcatctacgaggaggacccggggngtgctcaanatcttcctgngagaaacgtcatccgcgacgccgtcacctataaccgancaacgccccgccgcaaagaacgtcaaccgccatgggatgtcgtctatgccctcaagcgacagggncgcaccctctacgggattncngggggttgnccntgnggccccgctggcttccaaatctccaatgttccccgtgctaaagggntttcggttttcctgaaattnnaaaagtggcgttgngnttgtttgggtcccanccgct

SEQ ID NO: 98918 - DNA, 522 bp, Triticum aestivum
  unsure (1)..(522): unsure at all n locations
  Clone ID: PAT_TA_98918
gtccgttctggcacaccttggcttgtgtcccgcgaatctgagcctctcacgaaaacgaaaggcagtgagttccgcaacgttctcgaccccgataagatacacatggttagctatcctcaaggacggcgtaacctctcttggtgtggagcctcccatggttggcttattgcctctgacgaactctccaatcttttgttctgcaatcccttcacgttggccatgatccctctcccgcctattactgatctggaatgtgtcgagggagtctacgacaatgatagaagcattgctggttattattatgggaaattctgacaancttatcaggtcctccaagatttacattgggcgctggttctaccaaaaagggtggngttgtcatctgatccatctccatctcacgacggtggnggactacattgccatgggcatctaatggggaaataatcaggtttcttttgcgaagancaagagagaacaagctgggcgaaaatgggaacnggctccttanngaagatgggg

SEQ ID NO: 98919 - DNA, 442 bp, Triticum aestivum
  unsure (1)..(442): unsure at all n locations
  Clone ID: PAT_TA_98919
aagcgcaagtttactggagactggggngcttcaaatnggnctcaaaaactacgacccacaaaaggncaaacgtttcancggntcaatgaaagctgncccanatcccccgcccaaagatgagggngtgcatgcttggtgatgcccaacatgtcnaccaaagctgagaaaatgggacntgactacatgggatgttgaaaagtctcaaagaaaatggaacangnacaanaagcttgttntaaagctagccaagaagtaacaatgctttcttgggatcagagggnataatcaaagcagatccctcncccccctggggctgggcctaaaaaagggaaggnaaaggttcccactcctgggtagtcaacaaaaaaancnctgtttgccaaggncaacggagaaaaaaaagnttccagtccangttccnacccttaaaaaanggtccttt

SEQ ID NO: 98920 - DNA, 513 bp, Triticum aestivum
  unsure (1)..(513): unsure at all n locations
  Clone ID: PAT_TA_98920
caggaacgggaccaacaaatccccaanccaatctcgtctccgatcgactccaggctcgtcggntnctcctcccccaccgcctcaagatgcanatcttcgtgaagaccctcaccggaaagaccatcacccttgnggttgagagctccgacaccactgacaacgtcaaggncaagatccangacaaggagggaattcccccggaccagcaaacgcctgatntttgctggnaagcanctggaggatgggcgtaccctcgccgnctacaacatccagaangagtccaccctccatcttgtcctgcgtctgcgcggtgggatgcaaatcttcctgnagactctcaccggcangancatcanccttgnggntgggagctccgacaccancnacaatgtcaaggncaaggatccangaaaaggaggggantcctccgggccaagaaagccttatcttcgctggganagcaactanaggatgggcggtnccctcccangctacaanatccaagaaaggggt

SEQ ID NO: 98921 - DNA, 541 bp, Triticum aestivum
  unsure (1)..(541): unsure at all n locations
  Clone ID: PAT_TA_98921
agaagcaatgtgaggcagatatttgtcaacatgtcaatgatgcaacgcccatccgttggttatgagccaacaacagataagctttatgaccaaccactgttaggatttgtgcgggcaaaaaatgagcctaccgaaaacaaggaagcacagccggcacaaaaaacacgcgaagaacccttggacctgcaaactaagtgctcgttggagaacaaggaggaagatgaatcgggtgacagtgagtcctgctctagctccgacgaagacggttcgtgggcaatgagtccacaaaggtggggcccgaagaaagggaaggctgctcgcaaggaaaacaagaaagaaaagttgaggagggaaaagaagggaaaactcngcaaggaccaaagattcccaaagggccgattangaaagaaaganggaagaaaaatgggcgaaaggcaaagtncaaagcccggtaatgggatcactggcttggcttggcaaaagttggaaatccaacaatgggttgacanccaatcaatttttgttatacaanatnctactt

SEQ ID NO: 98922 - DNA, 187 bp, Triticum aestivum
  unsure (1)..(187): unsure at all n locations
  Clone ID: PAT_TA_98922
agcncannaagttcaatacttgcacatccatacacnatncacacatcacctgtangatcgancggtgcacgtaaaggcncgacattgggagtnccagngggaagancggccacgccaccgaacaangtgggcggngtaaggccaagcccgtgagnccggggcannggaggtgccancgncggaccca

SEQ ID NO: 98923 - DNA, 511 bp, Triticum aestivum
  unsure (1)..(511): unsure at all n locations
  Clone ID: PAT_TA_98923
caaatcccaaatcaccaaccaattccccttccctcctctcccgcgtcccgacgagcaccggncgccagacatggacgcctcanccaccggagccggagcgaaggcgaanaagggcgcggccgggcgcaaggccggcgggcccangaagaagtcggtgacgcggtcggtcaaggncgggctccagttccccgtcggccgcatcggncgctacctcaagaacgggcggtacgcgaagcgcgtcggnacgggcgcccccgtctacctcgccgccgtcctcgagtacctcgccgcggagctgctggagctcgccgggaacgccgccaaggacaacaagaagtctcgcatcgtgcccangcacctgctgctggccgtccggaacgacaangaactcgggaaggtgctgggcgggcgtgacaatcgcgcacgggggggttgctgcccaanatnaacccgggggntgctgcccaanaaaaaccngggngnaaggngcccaaagtcncccaaaaaggng

SEQ ID NO: 98924 - DNA, 510 bp, Triticum aestivum
  unsure (1)..(510): unsure at all n locations
  Clone ID: PAT_TA_98924
ccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcaagcaaggtgtaatgggcgacgatccgtcaaagctgggngctcagctcatccaatccacgttgggagttgaagcgcgcaaccctctaancctatggtagtaatgggcactagt

SEQ ID NO: 98925 - DNA, 484 bp, Triticum aestivum
  unsure (1)..(484): unsure at all n locations
  Clone ID: PAT_TA_98925
ggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaatgttggcttcaatgtcaagaacgttgccgtgaaggatctgaaacgtgggtttgttgcatccaactccaaaggatgaccctgccaaaggagggnangncaacttcacctnccaaggtcatcaacatgaancaacctggtcaaga

SEQ ID NO: 98926 - DNA, 490 bp, Triticum aestivum
  unsure (1)..(490): unsure at all n locations
  Clone ID: PAT_TA_98926
agaagcacacaagaatctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaacccgctactttgatcgagggccttatctatgcacctgacctgcatcaacantcaagtgccatgccatgcttgttttaaacaaggcccccctaaaataaaatctccctggt

SEQ ID NO: 98927 - DNA, 485 bp, Triticum aestivum
  unsure (1)..(485): unsure at all n locations
  Clone ID: PAT_TA_98927
cggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaanggcatcccatacctcaacacctatgatggcgcaccatccgctacccaagacccaact

SEQ ID NO: 98928 - DNA, 661 bp, Triticum aestivum
  unsure (1)..(661): unsure at all n locations
  Clone ID: PAT_TA_98928
ngcgggtggggggcgctcctanaaaataatgggttccccggggctggcaaggaattnccggaacgaagcgcaatcaancgtgatttcaaacaagggnggngnaatcctcctcctcgccgtcgtcgtctccgggtccaacgccgctccaacgcgaacaatgtccgtccnaanagggaagaacaaggggagcccaagggagggagaatggtnaaccttgggccgggtgtccgttgagggaagaagcaatntctttnggcgttggctcaacaatccttttgcaatccttcaaatngacaacttttcaatccaatgttgaactggacttggtcctggggaagggggaaaaaccctggccggcgggggttcaactgggtgggnnattgaaanggtcaaggggctggnttngtgaatgaagtcttcaccctaatgctggctatgctttgcatctcaaggatgttgctacacgtttgcaaagggagcnttggtatttaccggcaactggcacaattaaagctccggtnccaactgggagggnaaacaaaggaccaaagacacctgggnccctgggaggctcaaatctgctcctcaaagggctccctggccncngtttcctggggaatggnaaaanttggggccccaattgaagggacggtgaactncc

SEQ ID NO: 98929 - DNA, 496 bp, Triticum aestivum
  unsure (1)..(496): unsure at all n locations
  Clone ID: PAT_TA_98929
tcccaacccccaagcancagagcctcctcaacctcccggngccggngcatcgacggnatggnccgcaccaagcagacggngaggaagtccaccggcggcaaggngccgaggaagcagctggcgaccaaggncgcccgcaagtccgccccggccaccggnggngtgaagaagccccaccgcttccgccccggnancgtcgcgctccgggagatncgcaagtaccagaagagcaacgagctgctcatccgcaagctggccttccancggntggtgagggagatngccgcaaggacttcaagaccgacctccgcttccagtcctccgccgtctccgccctgcaagagggcgccgagggcctaactcgtgggcctcttcgagggaaacaaactctgcgccatccangccaaagcgcgtcaccatcatggccaaagggacattcanctcgcccgccgcatccgtggngaagaaggggataaggctgctgctgcaatccatt

SEQ ID NO: 98930 - DNA, 494 bp, Triticum aestivum
  unsure (1)..(494): unsure at all n locations
  Clone ID: PAT_TA_98930
ccggaaggagcggggccgccgagccgggaagagccancancccatcttcctcgcctccgcttccgaagggtcagagatggnggaccgtgctaaccanccntctgtcatgcaaaagtttggtggngagttccaccttgcctccagcttctctgagggtgttcgtgctcgcaacatctgcccttctgtgccatcctatgagaggngcttcaccacaanctgctacatgactcanaancttggnatcaaatgtccccatgaagtcatcttctccattgtttgccaatgcaccacctgagaagaaaggtgtcaagaactttgcaattgacttcctcaagggaggagtgtccgctgcagtttccaanaantgctgcagntcctattgaacgggttaagctgcttatccangaaccaaagatgggaatgattaaagntgggaagggtctcctgaaccaaaaaaanggtaatggtgactggntttgggtcgcaccancaaa

SEQ ID NO: 98931 - DNA, 453 bp, Triticum aestivum
  unsure (1)..(453): unsure at all n locations
  Clone ID: PAT_TA_98931
cgacactgcagacgctaccatcgccatcgccgagacgtgctggaccccgtcgtgttcctctccaaccccgaagaccacagacatgagcgccacgaccaccacccgaagtggcagcaccattgacggccgagtcgctcaagctctgagctctgtcccatgggcccctgcccgacaccgttgcgcagcaccgcccgacgccacgcaggagacgccgcccctcgccccgtgacccgctgccccaccccaccttcgcctgcctcgccggagtcgccgcctgagacgacgaccatgcttctgttttgcgccaccacctcccatgtgtactcgcctcttcttttcatgtttttttgtttgttcggttcaaccnagtgnatgggtttttacttngagcgagcgggttattactttaccatcggncangatccaaaaatcnaaggtctagatttagntctt

SEQ ID NO: 98932 - DNA, 324 bp, Triticum aestivum
  unsure (1)..(324): unsure at all n locations
  Clone ID: PAT_TA_98932
ngcgcaaggaggtggagaagaaccggcggctgcacatgaagggactctgccncaagctctcctccctcctcccctcctcctcctcagcncancacctccgccattattcttcctcgccgccgtccagcaacaaggacgcgacnacgcagctggnccanctggncaagcgcgggnggngtacatcaagaagctcaagaagccggggtcgacgaaactcanttcgccgcaaagcanggccgtcgtctcccgggtanacgcttggggtgggtcnnnctccggtctcccgggcggngggctaaaaagggggagaaagaactggtccca

SEQ ID NO: 98933 - DNA, 282 bp, Triticum aestivum
  unsure (1)..(282): unsure at all n locations
  Clone ID: PAT_TA_98933
tgctgacatgcccggaggcatggncgaggacgcgccggctgccagcggcggtgctggccccaagatcgaggaggtcgactaagttattctctttgatatagtgagaaaatacactatacgccatttgtttcagtcctgggtgccaatcatatcacctgggctggaagttttgttgtacttttggtctgtagcatcacgagacttgtgtgtaccgtaaacaatgcaatgatgcatgttttggctcattgttgatttcagcttaatgcttattgtttggactaa

SEQ ID NO: 98934 - DNA, 449 bp, Triticum aestivum
  unsure (1)..(449): unsure at all n locations
  Clone ID: PAT_TA_98934
atttgccattcatccgtcaaaangggagacgaattgaaggcgatgangcggcggctatggcgcatgggcggcanggtgctgaactgcttcgccgcctgcgtgggcgccggcgccggctgcggctgcctgtgcgcgcgcgcgctgggggacgaggccngncgatangaangtccttgttgaccgggnagcanccaaggtggtgaggctcaancgacctcgtcgtcgagggcgcgtcgtccaggacgctggggtttccatctgcaagcccaaagaccgttngagcctgagnggttgtccatgcacttgcttacggcntgcgccaataaaagttcaanaangcaacattcttccaaagatggnaaggggggtgantntngttcgaangttggatctgggncgcncanagaaaggtgcgntggtngacccggcaaacntngacncccgctgga

SEQ ID NO: 98935 - DNA, 447 bp, Triticum aestivum
  unsure (1)..(447): unsure at all n locations
  Clone ID: PAT_TA_98935
cactaggtcgccttccgattcgaacctcccccaaatccgcagcagtccacaggaggcgaatccaccgcgatggcccgtacgaagcagaccgcccgcaagtccaccggcggnaaggcgccccgcaagcagctcgccaccaaggcggcgaggaagtcggcgccgaccaccggcggagtgaagaagccccaccgctacaggcccgggaccgtcgccctccgggagatccgcaagtaccagaagagcacggagctgctgatccgcangctgccgttccancgcctggtccgcgagatcgccgcaggacttcaagaccggacctccgcttccaagtcccacgccgtgctggccctccagggaggcggccgaggcgtanctcgtcggggctgttcgaggacaccaaanctgttgngccatccaagccaagcgcgtcaccatcatgcccaatng

SEQ ID NO: 98936 - DNA, 447 bp, Triticum aestivum
  unsure (1)..(447): unsure at all n locations
  Clone ID: PAT_TA_98936
cctagcctcaccaagccccacatctcgcgctcctccctcctccatcctcgttagccgccgctgccgttctgcctccctcctctctcccctacaaccacgtcgccaggaggaaaccgccgttcgtggcgccatgccgctgccggggtgttgtgcacttcgttccccacagctcctccctcatcctcgctcatcaccgccgctgcctgctactcccctccaccatcgttggtgcttctgggtcgaatctggcgttggtgggttggagctcgatgctagaggccaagacggggaaggttagaaaaatgagagactggatggaggtgctcgagaccgaggaagctggagatgcacaattagcttcactggccatccggtggttggntnaacaaccaattctctggtcgcgatggggttgagctgcccaggaagggggaaggaggcttggtt

SEQ ID NO: 98937 - DNA, 475 bp, Triticum aestivum
  unsure (1)..(475): unsure at all n locations
  Clone ID: PAT_TA_98937
cacctttcccctccagcaaactcacacaacccaccaccgaagctcccaaccccacccgaagcggcagccatggcccccaaggcagacaagaagccggcggccgagaacaaggtggagaaggcggcggacaagacccccgcggggaagaagcccaaggccgagaagcggctgccggcgggcaagacggcgtccaacgaggccggcggcgaggggaagacccggggccggnagaagggcagcaaggcnaagaagggcgtggagacgtacaagatctacatcttcaaggtgctgaaagcangtgcaccccgacatcgggcatctcctccaaaggccattgtncatcatgaactccttcatcaaggganatcttccgatgaaaggctcngccggggggaggttcgggncaaagcttccgccccgcctacaaacaaggaaggcccaccatncancctccaangggaggattccagtacct

SEQ ID NO: 98938 - DNA, 442 bp, Triticum aestivum
  unsure (1)..(442): unsure at all n locations
  Clone ID: PAT_TA_98938
cccagccttgactggtacaagggccccacccttcttgaggccctggaccaagatcaatgagcccaagaggccctccgacaagcccctgcgtcttccccttcaggacgtctacaagattggtggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaatgtcgggnttcaacgtcaagaacgtggccgtcaaggatctcaagcgtggatacgtcgcttccaactccaaggacgaccctgccaaggaggctgccancttcaccgcccaaggtcatcatcatgaaccaccctgggccagatcagcaacggctatgcccccggtgctggactt

SEQ ID NO: 98939 - DNA, 460 bp, Triticum aestivum
  unsure (1)..(460): unsure at all n locations
  Clone ID: PAT_TA_98939
cccgcgtcccgacgagcaccagccaccagacatggacgcctcagccaccggagccggagcgaaggcgaagaagggcgcggccgggcgcaaggccggcggccccaggaagaagtcggtgacgcggtccgtcaaggccgggctccagttccccgtcggccgcatcgggcgctacctcaagaacggccgttacgcgaagcgcgtcggcacgggcgcccccgtctacctcgccgccgtccttgagtacctcgccgccgaactgctggagctcgccgggaacgccgccaaggacaacaagaagtcccgcatcgtgcccaaggcacctgctgctggccgtgaggaacgaccaggaggctccgggaggctgctgggccggcgtcaccatcgcgcacggggggcntgctggccccaacatcaaaccccggttgcttgctggcccnaagaaggattggggggntaaagg

SEQ ID NO: 98940 - DNA, 452 bp, Triticum aestivum
  unsure (1)..(452): unsure at all n locations
  Clone ID: PAT_TA_98940
ctggtttcattgataatgtcanctttgatctatttcatattgttgatctatcagctatgcatagggagaatatcctcatttgctcctccatctgctatgactttatctatcaagctcattgttaaacagcaatatctggttctgaactcgggtcaatgcttgcgaaaacatttacttttctcaagctggctatcttaaacatcgctagcttgaatacccaaaataataagtgtagttctaaattccaanaacttactttcgctcacatcatcgcagctgggtgggataggcctctcgctgttctctctttacctagttgtcaatctcataatccaatattcactctctgcaactcttatttgggcattcaggggtcgacgaaaaaaagcaaaggaaggtgggccctttccagggggtgccggtcggacgcctctggggtggcangcgatgcc

SEQ ID NO: 98941 - DNA, 196 bp, Triticum aestivum
  unsure (1)..(196): unsure at all n locations
  Clone ID: PAT_TA_98941
gggaggggaggntctncggggaacaagttccntgntgtcgctggggctgcctgtggcngcnactgngaactgcgtngacaatacagnngccaaaaacctctacatcatctccttcaaggncatcantggccgtntcaancgcctctcgtccgtctgcgtcggntacatgntcatggtccactcgtcaanaagggca

SEQ ID NO: 98942 - DNA, 210 bp, Triticum aestivum
  unsure (1)..(210): unsure at all n locations
  Clone ID: PAT_TA_98942
ggnccttcttantcccgtcgcgcgaggaggggcaacancgcctgagcatccccgcccggncgtcgaatcgaccgcgagaganaacttgctagtgcctgtgctcctcaanaagcaagccatggncaactgcgccgaccaaaaacttgcnnagaggagnattggnttcttcacgggggggtggnctctttntntggntggggcagnaaaaaa

SEQ ID NO: 98943 - DNA, 466 bp, Triticum aestivum
  unsure (1)..(466): unsure at all n locations
  Clone ID: PAT_TA_98943
agaaaccactctccctatccccgtgtccaagaagctaccccccggctccaatggcggcgaaggaaccgatgcgcgtgctcgtcaccggcgccgcaggacaaatcggatatgctcttgttcccatgattgccaggggagttatgcttggtgcagaccancctgttattctgcatatgctggntattgaatttgctgctgaagctcttaaaggtgtcaagatggagttgattgatgccgcatttccacttctcaagggaagttggttgcaacaactgatgttgttgaggcctgcactggtgtgaatgttgcggttatggttggtgggttccccaccaaggaaggaatggaaaggaaggatgttatgacgaaaaatgtttcaatctacaaaagctcaagcatctgctctttgangctcatgcaagcccccaatttgcaaggttctggttgtttgccaaccncaancaaa

SEQ ID NO: 98944 - DNA, 447 bp, Triticum aestivum
  unsure (1)..(447): unsure at all n locations
  Clone ID: PAT_TA_98944
attgttctgtgcattggattattgcttctggttctatctgctctgcatatgaatttgtatgctttgttctttgttgcctttgcaggataagtgtgtatcggttaaatgccttatgctgtgcatttcttgccgaaagtttttcctgcaatattaatttgaggaaagtgggcagttgggctgagcttgataatctcttttgccaacaatcattttcctcccattattcttaaaatgcgataaggtcacaaaatagatgttttgtgctggtccagacctgatctgtgttaaactttagagacctaatattgttcatgcttggccggtgatgaaaaaacttttaatcataccatctttcgggactgattggtcgctgtgcgtccatgctgttattctgcaattctgaggccaaatcgaacacctttttattgttgtngtatcaatcaagta

SEQ ID NO: 98945 - DNA, 478 bp, Triticum aestivum
  unsure (1)..(478): unsure at all n locations
  Clone ID: PAT_TA_98945
gatcgctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgaagctcttggctgctggtagggagaagtttgctgcggttccatctggtgggtggtggtgtggctgtttcaagctgctgcccctgctgctggangtgctgctgcccctgcagctgagtcaaagaaaagaagaaaatgtcntggngaangaagagagtgatgatgacatgggcttcaagtctggttccgactaaagtttgtgggggcanccttggtgtcctgaaataatcctntggggccaaggaaaacctanaagtcann

SEQ ID NO: 98946 - DNA, 469 bp, Triticum aestivum
  unsure (1)..(469): unsure at all n locations
  Clone ID: PAT_TA_98946
tcgcccatttccctccacaccagcccgacacctcaagctccatcccgatcgatggcgcccaaggccgagaagaagcccgcggagaagaagccggccgccgaggtcgccgagaaggccgagaagacccccgccgggcaagaagcccaaggcgggagaagcggctgccggcgtccaagtccgccaaggagggcggcgacaagaagggccgcaagaagaacaagaagagcgtcgagacctacaagatctacatcttcaaggtgctcaagcangtgcacccgggacatcggcatctcctccaaggccatgtccatcaangaactccttcatcaaacgacatcttcgagaagctcgccggcgaaggcggncaaagcttggccangtacaacaagaagccaacatcacgtccagggagattcagacctccgtcgcctcgtcctccccgggggaagtcgccaagcaacgccgtttn

SEQ ID NO: 98947 - DNA, 489 bp, Triticum aestivum
  unsure (1)..(489): unsure at all n locations
  Clone ID: PAT_TA_98947
ccgcccggnaagnatccagttccaccgggcctccttccccaagcccaacgccatggnaggctcggacccgagctcgccgttggcgtgatgagctccgtcggatcccctcctccgtccacaagccccgggacgccgccgtgactccgttanacgccttccccgaagtcggatcgccantttcctccgacatcttcttcctctgctcgacttcttcagggaacgcgaaacacctccacgnttcaggcgcttcttcctgtangcctccgtcgtcgcgtacccgggcctccacgtcagtatccttcgagnccatgcaacgggatggntggncatcgccccccggggcaaccgtctcccgggaangngaggtccgtcggcgtncgactnaaantgagggctggggtgntngggaacccngccacgaaggggganggcggttaatccttgtgggcgancnggacttggncgttgcgnccaacaaacaancaccgg

SEQ ID NO: 98948 - DNA, 478 bp, Triticum aestivum
  unsure (1)..(478): unsure at all n locations
  Clone ID: PAT_TA_98948
agccaaagcgaaaccgacctttcccccttcccatcccanctcccctcccctcccgcaggaagctcggccgggatncaatccggcaggccccctcccccaccggcggcgagcgagccagcgagagggcggagagcggtggggaagcacgcgggaggagccatgggggnagcagtcgctcatctacgcggtcgtggnccgcgggcaccgtggtgctggccngangtacaccggagttcaccgggcaanttcagcaaccatcggccctcncaagtggcctncgtcaagcntccccggggcaagnaaacaaacaaagtntcaacttaccaantggcngacggggcaacacctttcnanaaacnaaagctttgctaaaaggtgncaaggccanaangtntttcaagnaaagtggaaaaaacgtgggtggatggganaaacaattggaagaaagggtncttggtnggnngggagaganaaaatt

SEQ ID NO: 98949 - DNA, 198 bp, Triticum aestivum
  unsure (1)..(198): unsure at all n locations
  Clone ID: PAT_TA_98949
agcacatctcaacgtcattcaattcaatcaccgtggtgtggaaaggaattgancatgggctatgagaggnaacaatggtcanagaccntttggggatgatgcncgtanttgtgggggggttggnggccatgggggcaaaccccnnccaaggtanaangcaaccccccngngtggtnggggattnccaaaatcgggggc

SEQ ID NO: 98950 - DNA, 384 bp, Triticum aestivum
  unsure (1)..(384): unsure at all n locations
  Clone ID: PAT_TA_98950
ggtactgcaactatgtcgagggcacgggcacggggccccacaaggggtgcgcgcancanctcttcaccgtcgaagcantggggtcgccaccgacgcctccccctancgcctctacaccggccgtcgaaaactgnggngacaagcangccgccaagggccangaggtcagggccancatcgctctgtgaagtctatgcacgcgccgcgggataacgtgnactgcncccccnagcgaaaananatattgggtgggaaagcatgataccnattggntcgaatggcgcgcgattagttttggggcgggcctcttgganacacccgggnaaataaaangccaancggntccgcttgtggtttctgggaaacnaatnttgggggtctggg

SEQ ID NO: 98951 - DNA, 231 bp, Triticum aestivum
  unsure (1)..(231): unsure at all n locations
  Clone ID: PAT_TA_98951
caaggacgagcccaccatctttgcatgggagctgatgaacgagccccgcgtccccagcgacctctccgggaagaccatgcaggcctgggtggngctcatgtcctcctacgtcaagtccgtcgacggtaagcacatggnggngatcggtctcgaggggttctanngggactccgcnccngagcgcaagcggttcaancccngtgggaaatanagngcgggcaccgacttcat

SEQ ID NO: 98952 - DNA, 201 bp, Triticum aestivum
  unsure (1)..(201): unsure at all n locations
  Clone ID: PAT_TA_98952
gaggagngagagagaggagtcaaatcctcctcccgcgccgccgaccccacccgcggnattctctccggcgcccctcgtcaggccagttaaaaaaacaggagcaagatggngctgtgggtcttccgggtatgggtccctgatttgggaacccgggttcgacttcgacgaagnangatnctgggattcaatcaanggggtaca

SEQ ID NO: 98953 - DNA, 494 bp, Triticum aestivum
  unsure (1)..(494): unsure at all n locations
  Clone ID: PAT_TA_98953
gngaaaacccccggttccggttncggttccgattccgattcccccggcagncatggggtcccacatcatcctgccgccggacggggacgacgacgagcaacaacggagggaggacgangagaacgacngcggnggnagcgggagcgggggcgacngggagcaaaaacaacanggnggggggcaacgccaaggnggggggtgcccttctccgccatgtgcgtgngggtntcnccgcgactcctaccccaaactccgngncctccggaaagcctcccacgncaagnctcaccgatgncggcataagtcaagatntcccgnggggggacttnggntacntcctngaanaanggtgggccccacctccgccgnntaaaattccccgacgntccccaccttntccggancccattttcaaggacccancccaancaatatttcaancttgtcaaggcnaattatttttgttcgnntgaaagattgacacccnntcccca

SEQ ID NO: 98954 - DNA, 457 bp, Triticum aestivum
  unsure (1)..(457): unsure at all n locations
  Clone ID: PAT_TA_98954
cttctctaaaaagctancgaggnttggnggngagngaaaatgccggtcaacaagatngccgtggggagccaacgtgaggngtacgangtcggggccctcaanggggggctcgccgagttcaactccangctcaacttnggcttcngcgggcanggntccggnaatgggcttnaacaagntgaggcccgacggngnggngaaccccgccgggctgatntcncgnggggatagngcannggcttccccctggtcntggggggtgnccgtngggngccaanaactccgggggggaaagngaaaccngggccggggaccttngggggctttcgtggggcgggaanaacaacctcctccgcgggctgntttantgggatttgccaaantcctggggtncaancggcnggcctggtttctcctccgnttttccaacggggggggnttcccaaccgggaacatt

SEQ ID NO: 98955 - DNA, 179 bp, Triticum aestivum
  unsure (1)..(179): unsure at all n locations
  Clone ID: PAT_TA_98955
agcctccgcgcaaaaccctancggatccgtcgattgacctcccgggaaagggggaaaggcgggagggggtcccaaaatgcaaaatcttcttgaaanaccctgnccgggnaaaaancaaacaaccccccagggggccgagggacaaacggnnaccntccacaaaccgttcaagggggcaa

SEQ ID NO: 98956 - DNA, 451 bp, Triticum aestivum
  Clone ID: PAT_TA_98956
gcgaaccctacccgagcgaatcatcccgagcttttccctcaagccgccgccacaactcatcccgcacgccgcaaccgccgccgccgcacctcaccccgctctgctatccactgccgccgcacctcaccccgctggccaaggtgcttgaggaagcgacggctgctgcgagcagagcttagggacgccatggagtttctggggcagcccagttcggcgtgggagggaggcgccccggccgcaagctgaagtgtagttgcgctacagtgtccgtgggagtgtcaagtgtggcctcttcatatgggttaggggaacctgcaggaaaacttcagtcggagcaagagccggaggtgcatctgcgcaaggttgaactgtccacgtagatcttcttcctctgcagcttgacaactgcagcaagactttgccttgagtaagcatgctcatgtacacgggg

SEQ ID NO: 98957 - DNA, 465 bp, Triticum aestivum
  unsure (1)..(465): unsure at all n locations
  Clone ID: PAT_TA_98957
gcggcgcgtagaacaagagaangagcaagcggcggcggtgcccgaagaggagaagcacggngacctagcccgagctcgcaaccatggntaggggtttgaagaagcatctgaagaggntcaatgccccgtctcactggatgcttgacaagcttggtggagcttttgcccccaagccatcatctggtcctcacaangccagggagtgcctgcctctgatcctcatcctgaggaacagactgaaatatgctctcacctaccgtgaaagtgcaatctatccttatgcaacgtcatatcatgggntgatggaaaaggnccgcactgacaagacctaccctgntgggttcatgggcatcatttccattcccaaagactgggggnagaactacaangcttctttatgacaccaaanggncgnttcccgncttnnctctgtcaaggggatnaggggtgctaaagtttaaagcg

SEQ ID NO: 98958 - DNA, 396 bp, Triticum aestivum
  unsure (1)..(396): unsure at all n locations
  Clone ID: PAT_TA_98958
agaaaaaatttttgctaccaacaactaagctccaatggagggtgagaagaactcntccggggacctgatgtccaacaacaagctggtcgcggaggccgccaagacggcctacgagaagaanagcgtcgagggcatcgacaaggaaaaggtagncgccgcctccgccgacatcctccactccgcccgccaaatacgggnaaagctgggaggacaaaccggtggggcantacctcccaagaaaggctgnggggtnccttgaaaacantacaaactccccggcnggaaccgagaaaggagaaaaaaccgacgcacccttgcttnncgcttgacgcaaccgaaagcccgggntgcaacccaaaggaggggangnggccctgtgccttgccccctgtccgc

SEQ ID NO: 98959 - DNA, 469 bp, Triticum aestivum
  unsure (1)..(469): unsure at all n locations
  Clone ID: PAT_TA_98959
ggaaatcagcccgcccccgcacgacaaatcccatctccacctcctgccacgcccttcaccgcgcgccgccaccgcccaccccgtcggcgcacctgccccgacccgaccggctacacggggatgaagctcgagcacaccttctggatcggctcaacgcggcgggtcgagcggttgggggtggcacggctgctcnatgtagaacggcggcggcggcgagcggntggagcttgcagggggcggatccgtgcgtggcaggngctggggagcctgatccgaatgcgggggtcgcccgttgacgacgaggaagggcagagcgcgggatccgggtgacctagccaggagctcgccgntgccgggcgacggatgggcgggcgcgcnaaacggatggatccggcgcggcgggccgcgaaattccnttgcaagggganaaagcagcaagcanaaagggagganggaatggggaaaggct

SEQ ID NO: 98960 - DNA, 474 bp, Triticum aestivum
  unsure (1)..(474): unsure at all n locations
  Clone ID: PAT_TA_98960
agtacgggtacaacataaaagtggtagaaatactgttgatgtcacaatcgattgcgattccaaagtgtcaacagcggtcacttttgatgaagtagtccctggtttgaagacttctttcggcttcaaggttcctgatcaaaagtcagggaagctcgatttgcaataccttcatgatcgcttcgcactgaattcaaccattggcttgacttcggcacctgtgatcgagctggcaacaactattgggcacaaacgaacttgctgtcggtgccgaggttggatttgacaagtacttcagcttctgttaccaagtacaactcaggtgtcaagctataccaaggatgatttttctgccgccttacaaatggctgaacaaaggggagnacactgagagcttcctacatccacctgttcaagccccgaagcaagcgcagttggncggccggaggtaaacgcacaagggttgaaaaacaaagg

SEQ ID NO: 98961 - DNA, 452 bp, Triticum aestivum
  unsure (1)..(452): unsure at all n locations
  Clone ID: PAT_TA_98961
caagaacgctcattcgcatcgccaccttcctccctcccctcctcgccatctccgacccgacttgcggccaatggcggaccagctcaccgacgaccagatcgccgagttcaaggagggtttcagcctcttccacaaggatggggacggttgcattaccaccaaggagctgggaactgtcatgcgttccctgggggagnancccactgaggcagngcttcaagacatgatnaatgaggtgggtgctgncggcaatggaacaattgatttccccnaattcctcaaccttatggnccgcangatgaaggacactgattctgacgaagngctcanggaggnattccgtgcgtttgncaagggatcaaaatgggtttatctctgcnggtgaactgggccatgtcatgancaaccttggtggngaanttgactgatnangangtgacnagatggancgg

SEQ ID NO: 98962 - DNA, 463 bp, Triticum aestivum
  unsure (1)..(463): unsure at all n locations
  Clone ID: PAT_TA_98962
gggggaatattgatgctggaaggccgactggccgagggagggccttcatcgctcgctcccccgctatagcagtgaccggcgccgcctcctaacgtcgtcccatcgagcgccgccgcactggtttcctcgccgtcccgtgccactgctgctctcctatccgcctttaccgtacgctgccggccctgctaccgctgctctaggattccttggcgggcgctacggcccgtcttctggaagcggattggnggcagcgagcgggcggggaaagcggtggctagagcaaatgctcaagttcctgtccanggtgggggtggggtaacgccctctgganccgcgcaagggaannggggcgtggggctcctccngcaatgcaacgggcgcaagggcaaaggaatccaaaccccaacctggctccgttccanttgcggggggnctggcctccccccgggccgcggggccgaaa

SEQ ID NO: 98963 - DNA, 503 bp, Triticum aestivum
  unsure (1)..(503): unsure at all n locations
  Clone ID: PAT_TA_98963
cacatacacacacacaaagtgctagctagcttaatcgattcagccagccatggcggggggngaaagcaccaccancaaccttgtttccancacaaagaagggagggggcgagggacttccagcccgccgcctgacggnggcgtcnacatgtacggggtactcnaccggagacggtggtgaccgccaccggcaacgagggcgagtacgaagcggatcaccaaggaggagaagcaccacaagcacaaggagcacctcggncagatgggcgccgcccgccgccggaagccttcgccctctacgagaagcacgaggcgaagaaaggacccggnggcacgcgcacaagcacaaagattttatggaaggagggtgggcggccgcccncaaaccnttcngtgcccgggngggnttcttcnttcanngagcaaccaacgcngaagaangcaaggcccacaaagggagggccaaagggaggncangcggggnaagaagaaagcanccaccnc

SEQ ID NO: 98964 - DNA, 268 bp, Triticum aestivum
  unsure (1)..(268): unsure at all n locations
  Clone ID: PAT_TA_98964
actgcctcgctagaagccactgcggtagccgtcaccgcacttgcggggagaacactcgcacgcggagggagacgcctccactccaatggcggtgatcancgcgccgccgccgcatcctccccttgccgtattcgccgccgcgccctgccacggagtgcgcttctgccgcgctccactcatccgcatggngggctcctcctcancgtcttcgccttcgttttcctcgtcctcctcttcctcctacggangtggtgggggcggggggccg

SEQ ID NO: 98965 - DNA, 454 bp, Triticum aestivum
  unsure (1)..(454): unsure at all n locations
  Clone ID: PAT_TA_98965
aagcagctgtcctactgtcacatacacacacacacaagtgctagctagctaatcgatcagccagccatgtcggaggagaagcaccaccacctgttccaccacaaggagggcgaggacttccagcccgccgctgacggcggcgtcgacacgtacgggtactcgaccgagacggtggtgaccgccaccggcaacgacggcgagtacgagcggatcaccaaggaggagaagcaccacaagcacaaggagcacctcggcgagatgggcgcagccgcggncggagccttcgccctctacgagaagcacgaggcgaagaaggacccggagcacgcgcacaagcacaagatcgaggaggaggtggctgccgccgcaaccgtcggcgccggcgggttcgtcttccacgagcaccacgagaagaagcaggaccacnaggagggccaaggagggcaagcggcga

SEQ ID NO: 98966 - DNA, 443 bp, Triticum aestivum
  unsure (1)..(443): unsure at all n locations
  Clone ID: PAT_TA_98966
gtgngcatcatcatccctgataccaaagctcatcttcttctccttgaaatctttttgggtccacanatttggaggatgtcttgcaactgcggatnaggntgcagctgcgggtcaaactgcaagtgcgggaaagatgtaccctgatctgacggagcaaggcagcgccgccgccgaggtcgccgccgtggtcgtcctcngcgtggngcctgagaacaangngggacaattcnangtggccgccgggcaatccggcgaggggctgcanctgcggcgacaactgcaaagtgcaacccctgcaactgttaagctgcatgcactcgttacgtangtacgtgtgatgggggngaggagtatacgtgaaataaacgancgtcctggatttgattgggagttccancaaaatgtgncgcgctgtggtggtgttgtggtgggtttanattgcc

SEQ ID NO: 98967 - DNA, 447 bp, Triticum aestivum
  unsure (1)..(447): unsure at all n locations
  Clone ID: PAT_TA_98967
cacatgaggatcacaggatnaggtcgagtcgaacataggataggagtagtacgaacggngtccgggaggaaattatattagtatcaccggagtagtgtcctggtcaaatgggcacaagcgcttccagtaagtaatccaagttgctcctccccttctttcccggacacgtctggccgcgctgccgtgccgagcatatccacgctacgctacaccgacgtggaagcccccaccgcacctcatccggnacgcctcccaccggcttcgggctatatcaatctccgggccgcgcaccgggatgccgcctcccatttccccctcccatctctaacaaacatccgcgggcggtggaatctgtttgnatccgtcgctcgctcccgacgaccgagaanagctaacgccgttgctccgcggngggcangcgagaagaggagatngnccacgcggnng

SEQ ID NO: 98968 - DNA, 364 bp, Triticum aestivum
  unsure (1)..(364): unsure at all n locations
  Clone ID: PAT_TA_98968
agagagccacttggatnaccatgaccgccacctcgcgggcacagcatcccaacgggagcctagccccggcctccgacggcggcgaagtccttcgccaagttcttcnagtgctggatcttggagnagtcccgacgacgctgacctccggcgnctcgtcnatcgtgtcctcggncactacgagcantantaccgcgccaagtccgcgggcgcctccgccgatgtgctccccatgttcgcgccctcgtggatctccgccaccgagagcctctacctctggtggcggggggtgggngcccacttccgngatncanctgctctaatccaagtccggcctgcaagtcganggccanctcccgggcttcct

SEQ ID NO: 98969 - DNA, 440 bp, Triticum aestivum
  unsure (1)..(440): unsure at all n locations
  Clone ID: PAT_TA_98969
cgacgcggaagcgacccaagagaagaaacccccaaatggcggncgcatccatgctcaccaccgtcttctcccctctcgccctcctccgcccgtcgggctccttcgcgcgcctgcgccgcgcgggtcccgccgccgccgtngncgtgcgcgccgcggccaagtctancacngncgcggggggccccaanaaaaananggcggcgccgaccggnatcancangccccggtccgtgtcnccggcggtgtatgcgttcatnggcgccgncgaggtccnccncaccgatgggcatgaancgcatctgggnctanatcaattcatnnaaaatctccatnaaccctnaggacaaanaaggtcancctttgcgatgnagaanctggaaannccctgttttgcatngcnngacaacccgtnntttggggtttcctggggagatttgcca

SEQ ID NO: 98970 - DNA, 446 bp, Triticum aestivum
  unsure (1)..(446): unsure at all n locations
  Clone ID: PAT_TA_98970
atttcgagcaagcaccgccgccgacgcatctcgagtagtttccagctcgccggaggaggagaaagatggcaggaaggaagggcggngacaggaagaaggcggttacccgctccgtgaaggccgggctccagttccccgtgggccgcatcgggcgctacctcaagaagggncgctacgcccagcgcgtcggttccggcgcccccgtctanctcgccgccgtcctcgagtacctcgccgccgaggtcctggagcttgcangcaacgctgccaaagacaacaagaagacacgcatcatcccccgccacctgcttctcnccgtccgcaacgaccangaactcggtaggctgctcgctggcgtgancatccnccacgggnggggtgntncccaacancaactccgtgctgntccccaagaaatccgccgncgccganaaggaaggcaagtc

SEQ ID NO: 98971 - DNA, 442 bp, Triticum aestivum
  unsure (1)..(442): unsure at all n locations
  Clone ID: PAT_TA_98971
gtgccatcctgattgagcaggtcgagcaacttaaaagtgaaagtgcaaccctcttcaagcaactgacagaggcaaatcagcagttcaccaccgcggtcactgacaacaggatcctcaaatcagatgtagagaccttaagaatcaaggtaacacttctcctctggtacaaggaagaaatagtcacctctaaacgatcatcagttccatagcagaagtgacatctgaaattggctccgcaggtaaaaatggcagaagacatggtggctagaggcgcagtgtcatgcggcctaggacagcagctcggattggcaccatttctgaactccaggaagatgtgacaaagccttggtgagcgttctcacaggcacagggttgaacttgaaagggaancatgcactcttcagagggtttctagctctagctcttcaagttcagacatcgg

SEQ ID NO: 98972 - DNA, 345 bp, Triticum aestivum
  unsure (1)..(345): unsure at all n locations
  Clone ID: PAT_TA_98972
ccacttccatcgcctcccaagatagcagatctgctccggtgagaatccgtcnccatgtcttccaangaggncgnctggacccttgccgtcctcatccnccacgangangggatccccatcanttctgacaaaatcgcgacggtggggaaggctgccggnatcaaagntgngggctactggnccgcgctcttncccaagctcctgganaaaangancgtcgatgaactcatcctttccntcggatctggtggaggtggggnnccanctgctggtgctgctgccccggctgctggtggtgctgctgcccgctgacnaaaanaaagaaaagaaaaaangaggggggct

SEQ ID NO: 98973 - DNA, 461 bp, Triticum aestivum
  unsure (1)..(461): unsure at all n locations
  Clone ID: PAT_TA_98973
accccaagaatncaaccctttnccctncccngggggttncctnccctnccggggtncggaatnggaaaannatnaaccggngctnggattcaatgatnactggaaactggaggnttggtgggagctcaaatncaagaggatggaaccgcttcaataacctaaangntgggagaaccaagaagggaggtcattgtggaccaaactggggagcgcgagggcacctatgagggacttnaacaaagaacctccctgagaatgactgnccgattcgcggggttcgactttnacttcancaacccgggggatgttgccaaagagcaagatcttctatatcttctggnccccgggcaacgcaaangtgagggagcaaagatgacgttacgcgagcaacaaacgaggaagtttcaagaaggaccctgggacgggattcanatttgaagatgcaaggcaacttganccca

SEQ ID NO: 98974 - DNA, 445 bp, Triticum aestivum
  unsure (1)..(445): unsure at all n locations
  Clone ID: PAT_TA_98974
accattcgcatcgcancacaccaagcttanacatggccgccgccgcctcctccaccgtctccggcctcgccggngccgcgctcgcccgccggacagccttctctaccagcttcacnagtggnggccgggtgtcggcgangaacccgctgatgacaaggaacctggagaggaacggcaggatcacctgcatgacgttcccgcgggactggctgcggagggacctgaacgtgatcgggttcgggctgatcgggtggctggcgccgtcgagcatcccgctgatcaacggcaacagcctgacggggntcttcttctccatgcatcggngaggagctcgcccacttcccctcgcccccggntctccaagtcncaagttctggctgtggntggtgacntggnacctgggtctgttcatcacgctcaccttcggacaaattgggttcaaggg

SEQ ID NO: 98975 - DNA, 540 bp, Triticum aestivum
  unsure (1)..(540): unsure at all n locations
  Clone ID: PAT_TA_98975
tcgctttccaagccacgcaacgatncacgcctcgctcccgggccccgcgcctccggcgtcctcgctcgccccgccgactccgggcggattcggccgggccgctcccgcccggcagttgnagcgcanatcggacaggcttgcaagcatgtatattcnaagtcaaagcgggnacaaagggccacctacttcaataaaagngngattccaacaaaagaccgantttttggaatatcaaaacaagaaagttgcaagtcaaataacgggccaacccctccctaaatnaaccaaaaaggtttgattctttgttgggcntaccaaacaaatnataattggggttggactcccaaanaacgcctggggcttggattcaaaaaagggggggggnaaatgaaannccccgttgntttgccaatttggnaaatttggggaaaaaaaaccaaacnaagnttccnaggggggggngtnccnaaccncccggccccttnangggnattttcantngggggtncccccannaaggggcccgggcccgggcccggn

SEQ ID NO: 98976 - DNA, 447 bp, Triticum aestivum
  unsure (1)..(447): unsure at all n locations
  Clone ID: PAT_TA_98976
atgtttgaaaacatcatgtttgagacgcctgtctccttcaccaagcagaaattcgtatctgtgcctcatggtcaggaaggcaggcttggagcactcaggggacataatagaggactctttcagcatcagatgtgatctcactctcaaggatatcggcgagcagtttgtcgtggtccctccgagcgacatgcatctgcatttcggcagccttctggagagcatggatggagccgacgtcgcctttcttgtcggnggggagaagttctcggntcataagctcgtgcttgctgccaggtcatccgtgttcaagggnagaagctcctcggcgccatgaagggagaaaacccgacagcctcaattgaaatcagtgacatgggaacctcaaggtggttcaaggnccctgctccattttaatataaaaccgantcnctgcctggattttgagaa

SEQ ID NO: 98977 - DNA, 435 bp, Triticum aestivum
  Clone ID: PAT_TA_98977
gttctgacatgcaagaatcaacaggaaatgaacaggataaaggaaactgcagaacatcgaggtatcccaacttttattgttgcagatgcaggccgcacacaggtactggctgggtctaagacagttcttgcagtagggccagggaggaaagcagacatagattcagttactgggaaattgcgcttactgtgagctgcatctcggacatgaacatccagtgtagtcccatcctggaaaagactatgtttgttggatcgcagttgaaggccaggatcccttcgctgcacccgttcctcatgcattgctcgattcttctgacccagctctgcagactctagtgcttggtttaaaatcccaccgcccgcgattactttcttttttacctacttgatgatgacgatgatgacgatagtgcaacacagctttgtttttctt

SEQ ID NO: 98978 - DNA, 440 bp, Triticum aestivum
  unsure (1)..(440): unsure at all n locations
  Clone ID: PAT_TA_98978
acgagccacacttttggtagagcacgcaaaggcaacagtcttcgcaaagcaattgaaagggagaccgatagacccatggcgaaccttggatggttagcctccctcgccgccgccgccgtcgtcgcggtggcgctccgctcgccgttggtcgccgcgcagctgaggccggggtactacgccggcatctgccccaacctggagaccattgtccggaactccgtcaggcagtccatggtccagtcccaaatctccgcgggcgccacgctcaggntcttcttccatgactgcgncgtcaggggntgtgntgcgtcgatcatgatcgtgaactcgancggcgacgacgagtgggggagnccggacgaccagtcgctgaagccgcagggcttccagaaggtcctggacgccaaggccgccgtcgacaaggacccgcagtgccgttn

SEQ ID NO: 98979 - DNA, 447 bp, Triticum aestivum
  unsure (1)..(447): unsure at all n locations
  Clone ID: PAT_TA_98979
tcgctctctccttcttctcttcttcttctcccgagcaaggaggaggctctgctcaagcaagtggagctctgcctcatggcctgcgccttcttcttcgacgcggagccgttgggcgaacccggggtgcgcntgnacgggccggtnctggagntggacgcctgcgcgctctgcaccaanccgctgcagagcaacagttanatcttcatgtanaagggggacacccccttctgcagcgaanactgccgctacgancagatgcacttcgacnccgccatggtcaggnannaggccaagcgccaggcggaancagcagcagcagcaggcccaggcgcagcccaacgtgccggncgccggcgcccgtgttcgccaaggnngacgtgtccgtggggagntagttgcnccgcgcccgcatcgggnttagctggtaggaactangtnccctttttg

SEQ ID NO: 98980 - DNA, 167 bp, Triticum aestivum
  unsure (1)..(167): unsure at all n locations
  Clone ID: PAT_TA_98980
cattcacatgccgnggnaagggtatctcgncgtcggngctgncgtacaacgangacccccncgagatgggtcaanacngccgtcnactgattgtcgagganttgataacnaacgctgcgatgtaatcggtcaggatgccctngacanctcggcgtgtctcctccgtg

SEQ ID NO: 98981 - DNA, 508 bp, Triticum aestivum
  unsure (1)..(508): unsure at all n locations
  Clone ID: PAT_TA_98981
gctgcaagaattcggcacgagccccattcctccccgtgttctaacangctgtcgtgagaaatgcatcattcagaaggngaacaacttcaagcaggctggcgagagatatcgttccttcgaccctgcaaggcaagaccggttcatccaacgatgggttgacgcactgacagaccctcgcgtgncccatgaacaccgtaccatttggntctcctactggtcccagtgcgacgccgctcttggccanaagctggcttctaggctgaacctgaagccnagcatgtaagatcgacgaggaagaaagcaggcaccggtggccaaggatgcaacccaacatggagcgtgtgatgtttacaccaatataattgaataaacaagggatgtgcgcgttgtccntacttatgctgangctgatggtcggtggtcgantatatatactggaacntctggtgtatgcccctctcctcctgggggagaagtaatgtaacgaaaaaagaatgtgtcattgtgg

SEQ ID NO: 98982 - DNA, 184 bp, Triticum aestivum
  unsure (1)..(184): unsure at all n locations
  Clone ID: PAT_TA_98982
gcaaaaacccctggcctccagcgtcctcaagtncnggcaagggcaaagtctggctccgaccccaattnangtcaaacgagatttccatggtcaactccccnggcanaacaatccnaaaagctcgttaaagggnggtttcatcantcaanggaagccccaaaangatncactcccangtcncctt

SEQ ID NO: 98983 - DNA, 497 bp, Triticum aestivum
  unsure (1)..(497): unsure at all n locations
  Clone ID: PAT_TA_98983
gcagcccccctcacaccccaccccaccacaccctcgaatcaccaccaccagcagcacccatggcacccaaggcggcggagaagaagccggtggccacggccgagaagacgacggcggggaagaagcccaangcggagaancgggcgccggcgtccaangaggccggcggcgaggggaagacgaggggcaggaagaagggcagcaaggccaagaagagcgtggagacgtacaagatctacatcttcaaggtgctgaagcaggtgcacccaagacgtgggcatctcctccaaggggcatgtccatcatgaactccttcatcaacgacatcttcnagaagctcgccgngggagtcggccaaagctggtccgctacaacaaggnagccaccatcacgtcccggggagatncaaanctccgttcgcctcgncctccccggggngctcgcaangcacgccgttcttccgngggggaccnangggcngtcaccaagttnncctn

SEQ ID NO: 98984 - DNA, 525 bp, Triticum aestivum
  unsure (1)..(525): unsure at all n locations
  Clone ID: PAT_TA_98984
ggagaggatgctcatgttgcgggccgccggcgccagggcggcgtccgcggtcgtcgccggcgccaggaggagacccggcctcctgccggtcgccgtcgccggtctcgcgtcctcctcatcaggaccaccatcgggtgggaagcggnggaagggccancggcggggcgatgccaagccccagccccagccctctgagatccccagcaacaagaagcccancgcgaggccggccaaggacaggaaggcccgcccggctacggaagaggcgcaatggtcatcgggccaggagattgagctnaggaagcaagccgccgggtggaagcccgaagcggggtggttgccggtggcgctgcgcnacggggggtgcgggccgcctgcctgcaaaggcctgggacaaggggcccccgagttcccncacccccggangagggtcttcgcccgacttncccccgtaccaacctccaagnttgttacaaagaagcatnatttgngccccgantgggatgggtntnacaaacctacctc

SEQ ID NO: 98985 - DNA, 493 bp, Triticum aestivum
  unsure (1)..(493): unsure at all n locations
  Clone ID: PAT_TA_98985
gaagcgtcnccggcaaccgaagttgcanaatcagaagtgccgcaagcaacatatgcgcgtaggcgatcactcgttcctaaatttggggactgggaagacagcgaggatgtcccttacacaccagtggtcttgggtgctcggaagaacaagaaaacaggcatttattccaatccgaatgagccaggacatcacaccgaacctcctcgcaggtcacctttgaatccaaatgagcctgtggcacaacgacacacaaatcctcagtgggaccaggggggcaacggtagcacatccaggaagcccttacaagaagtgttgcaggatctgcttcaccaatgcacatggcagctggaatgctagcttcagaaaggagggctttgtcagtagtgcatgggacccgagcagaatgaatcagagtaacccaggctacaatcgtgacgatgaagtggctgttctgccatttggtgaatgggatgaggctaacgtagcatcaagg

SEQ ID NO: 98986 - DNA, 509 bp, Triticum aestivum
  unsure (1)..(509): unsure at all n locations
  Clone ID: PAT_TA_98986
gttttgctgnctccctcccccaccgccgccgtcgccgcccgcgtccaccatggcgctgccgaaccagaacaccgtcgagttancccagcttcaagctcctcatcntcggcgatggcgggactggcaaaaccacatttgtgnagaggcatctcactggagagtttgagaagaaatacgaacccaccattggtgttgaagttcacccgttggntttcaccactaactgtggaaagatccgtttctactgctgggacactgctgggcaagagaagtttggtggccttanggatggatacgtatatccatgggncagtgtgcgattatcatgtttgatgtcacttcaaggctggacctacaagnaatgttcctacgtgggacagggaccttgtgnaanggtttgtgangaacatcccccattgtgctgtgtggcaancanaggtttnatgctgnaagaaacanngcagngttaagggccaaagcaagggtgaacattcccacnacggagantg

SEQ ID NO: 98987 - DNA, 495 bp, Triticum aestivum
  unsure (1)..(495): unsure at all n locations
  Clone ID: PAT_TA_98987
gcctccacttctctgctccctcgtctcctcgcgcgcagggcccggcgaaagggaagcaagatgtacaccgccaggaagaagatccanaaggacaagggcgtcgagccctccgagttcgaggacaccgttgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttatcggcaaggatgttgtctttgttgcaacaagaaagattgtgaggncacccaagaanggttctgctgttcagcgccctcgcaccangaccctgacaagctgttcaaganggtatccttgggngggatgtcgtgtacccaagctgagattgtgggggaaacgttgtcaagat

SEQ ID NO: 98988 - DNA, 393 bp, Triticum aestivum
  unsure (1)..(393): unsure at all n locations
  Clone ID: PAT_TA_98988
ccaacatgggaagngtctctccaanccgcggncacgctgatgccggccaagatngtgggcgggcctcctccgcgcgaccgtcgtcnacgtcncccgggcgttcggcgtcgacnctggggccaggatcacctgctccctgcaagtccgacatcagggaggtcgcaagcaagtgcgccgacgccgcccaanattgccggcttcnccctcnccanctctgncctcctcgtctccggcgcgaagcgcggagggggggcccaacagggctgaccttcgacnagatccaaagcaaagacctacattggaggntggaagggtaccgggcaacgcnaaacaatgnccgancatcntacgggggggtcgactcccttnccccttcangggccgggaaattac

SEQ ID NO: 98989 - DNA, 502 bp, Triticum aestivum
  unsure (1)..(502): unsure at all n locations
  Clone ID: PAT_TA_98989
cacccacgcaagccccaagcagacgcagcgcccgccccctcnccaccccacccacccctcgctccgattcaaggttggnggtcggcggnaggatgaaggccaaggcgggctcccgcgccggcgactccaggctcacggtgaataagagcaaggccngagaaggaccccaacaagcccaagcgccccccgagcgccttcttcgtcttcatgganaccttcaggnaggagtncaaggagaagcaccccnacgttaaacaggtgtncgtggttggcaangccggtggtganaagtgnaagtccctgagcgatgctganaacgctccctacactgccancggccgagaagctnatggccnantacaccaagaaagattaacgcctacaatnaacccaacagggcaagggaggaggcgtccggcgactctgacaangtccanatcngangtgaacgaccatggtcagcgangggnngatccaattgatnctgnacggccanngcact

SEQ ID NO: 98990 - DNA, 455 bp, Triticum aestivum
  unsure (1)..(455): unsure at all n locations
  Clone ID: PAT_TA_98990
attccccttcccgcaaccgcccccgtgtctcccgtgcgnngcttctcgaagcctcccccatggcggaccagctcaccgacgagcagatcgccgagttcaangaggccttcagcctcttcgacaaggatggcgacngttgcatcaccaccaaggagcttggaaccgtgatgcggtccctcgggcagaaccccacggaggcggagctgcaggacatgatcaacgaggttgacgcggacggnaacnggaccatcgacttccccgagttcctgaacctgatggcgaagaanatgaangacacngnctccgaggaggagctnaanggaggcgttccgcgtgttccgacaaagaacaaaacnggttcatctccgncgggngngctgcgccaanttnttaccaancctncgggganaancctgacgggaccaggaagtgnacccaaatgatcccgggagagc

SEQ ID NO: 98991 - DNA, 491 bp, Triticum aestivum
  unsure (1)..(491): unsure at all n locations
  Clone ID: PAT_TA_98991
attccgaacaagcaccgccgctgacgcatctcgagtantttccagttcgccggagaaggagcaagatggccggaaggaagggcggcgacatgaagaaggcggtgacccgctccgtaaaggccgggctccagttccccgtcggccgcatcgggcgctacctcaagaagggccgctacgcccagcgcgtcggntccggcgcccccgtctacctcgccgccgtcctcgagtacctcgccgccgaggtcctggagcttgcaggcaacgctgccaaggacaacaagaagacgcgcatcatcccgcgccacctgctgctcgccgtccgcaacgaccaggagctcggcaggctgctcgctggcgtgaccatcgcccacggtggngtgatccccaacatcaactctgtgctgctccccaagaagtccggccgcaagccgagaaggaggccaantngcccaagaangaagggcgccaccaangtcccccaagnangaagg

SEQ ID NO: 98992 - DNA, 526 bp, Triticum aestivum
  unsure (1)..(526): unsure at all n locations
  Clone ID: PAT_TA_98992
aagaattcgagaccctgtcctaccngggnncgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaaagctgcctatgttcgggtgcaccgacgccacacaggtgatcaaccgaggtggaaagaggtcaagaaaggagtaccctgacgcgtacgtccggatcatcggattccacaaacatgcgccaaggtgcagtgccgtcagcttcaatcnnccttcaaancaaccgggctngcgaaggagtcccggcaaagggcctaaaacaagctcaatcaccacggggncaanatatnaaagtgccaattgcngggttttgnnaaaaccctgacnattgccctttgggggtttttcccctcccccaaattatcctntccctggnttgntccccaaaanaaaatgttgtntcnttcctg

SEQ ID NO: 98993 - DNA, 507 bp, Triticum aestivum
  unsure (1)..(507): unsure at all n locations
  Clone ID: PAT_TA_98993
ngcccgatccaacgcaaccgccgcaaacaccacacctcgngagtcctcgtcgccggagaagtattancaagcaagatggccggcaggaagggcggcgacaggaagaaggccgtgacccgctccgtgaaggncgggctccagttccccgtcggccgcatcgggcgctacctcaagaagggccgctacgcccaagcgcgtcggctccggcgcccccgtctacctcgccgccgtcctcgagtacctcgccgcagaggtcctggagctcgccggcaacgcggccaaggacaacangaagacncgaatcatccccgcgccaccttcttctcgccgtccgcaacgaccaaggagctcggcaggctgctcgccgggcgtcaccatcgcccaanggnggggtngatncccaacatcaactccgtggctgctccccaagaaagtcccccgccgccgccggagaaaggaggncaaagtcncccaagaaagaagnaaggcggccangttcccccaang

SEQ ID NO: 98994 - DNA, 220 bp, Triticum aestivum
  unsure (1)..(220): unsure at all n locations
  Clone ID: PAT_TA_98994
gcccagtcatcaactccccgccagagagtcccatctgggaacctgaggcgcctccgtccgtgcacctgccaagaaagccttcaaaaaagaagaagaggaggcggtcgagaagcgaagccccttcggcgccatggccggcaaataaggggaagaggtgccagcactgtgggtcgtcagagacgccgcagtgggangggatgngtntnatcggnctagccac

SEQ ID NO: 98995 - DNA, 439 bp, Triticum aestivum
  unsure (1)..(439): unsure at all n locations
  Clone ID: PAT_TA_98995
ccaaccccgccgtggtcctccgcaggcgcaggggcacgcagtccgtccccgtcgacgacgccgcacggccacagctcgtcgtgttctgggacctcaccgccgcgcgctacgacgcctccccggagccgcactccggctactacttcgtcgccgtcgccggcgccgacgtcntgctggccgtgggcgacctggcggccgagttcgtcgaggagaggttcgagggccggatccccaaggccgcggctttgaccgtcccgttcgcgcgcagggagcgcgtcgttgcgccggacccggcggcgatgcacaccgcncggcgcgtccggttcgccggagggcggcccggatcacgangtaagccntaaggtgctccggtggngcggaacaaaanagaactntgggtcangcgtccantggaagctctccggttnatgtgccgccg

SEQ ID NO: 98996 - DNA, 173 bp, Triticum aestivum
  unsure (1)..(173): unsure at all n locations
  Clone ID: PAT_TA_98996
gccgcattccgagaggttcgagctcgccggagagggaggagagatggtcagcaagggcggnnagaggaagaatgnggtgaggccngtccatcaangcctncctcnatttcccngtcgnccgcatcgggcgcttcctcangangggccgctnctcccancgcctngggtcccgc

SEQ ID NO: 98997 - DNA, 506 bp, Triticum aestivum
  unsure (1)..(506): unsure at all n locations
  Clone ID: PAT_TA_98997
actcgctctcaagctcacccacagtgctagctcacttcatccacaagctgaatcgccgagcaccagcagtgaccactgaccagcgactgctctggctcgccgcactgtctgcgcagcgttcatgggcgccggtgaggccggtggcttgtgagatccggcggcaaaggaaggaaggcgcggcgagctgagctgctcttgctgtccggttcttgcatggcaacagcccgatgcgccggaggatggagtgctcctgcgcgggtgctggtgctcctcctctgcgctctcctctgcgccattgcgctcgtcgccgtcgtgccgctcgcagcgcccccgggaaagggcgcggcgagcctgcctcgtgccgcatcgtcgtngttcccggtgggggcaagtggccggcccncttccgccggaactggggaggtcccgcgccccgagatggnactccggggggctcngtcnaaaacangcatnangtnccgagccggcccaanccggantccaat

SEQ ID NO: 98998 - DNA, 515 bp, Triticum aestivum
  unsure (1)..(515): unsure at all n locations
  Clone ID: PAT_TA_98998
aaattattttccagtcttcccatgtttcctgtcattttgtaggcatgtgtgatatttcttctgtaactctttgtcgatttttcttcttctgaaactactctacattggccccgagggcgactagggttccgccgcgccgccaccctcatcgatcccctttccctcgccgtcgtcggaggcaaccgccgggcaagcccgtgcggccgtcgaggagggcgacgacgaggctctcggctgcttcgtcgttcgggcagagggtctctggtgcgccggggcggcggcctcgggtggtggtgcggtcccgcttgttcgtcaggggtggccgcggatgctggaccggctcctcggccgcgtgggcagcgaggttccgacataagtttcctgtggcccggggttgcgccgttggcctccggtgcctggaatctgatgtatggcgccccgtccacctcctctggcctctgcccccgccggatncagctgttggtnacccccgttcaccngtccggttancggct

SEQ ID NO: 98999 - DNA, 459 bp, Triticum aestivum
  unsure (1)..(459): unsure at all n locations
  Clone ID: PAT_TA_98999
cacgcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcagctgcggccgaaccggaggccgaggcgcccgccgtggtcgagacagagaccaaggaggccgtggctgaggcaganccggcggcggccgaggaggtgaaggganaggntcncctnctgccnatgcccanccngccgctccccgcttgtt

SEQ ID NO: 99000 - DNA, 314 bp, Triticum aestivum
  unsure (1)..(314): unsure at all n locations
  Clone ID: PAT_TA_99000
aaggatcgaaaagtagcggggaatttcttccagccgcagctcacgcaaagaatccagccaccaagggaacggagcgaatgggaaggaagggtttggattctagctgagcccggtgcgcgcacccacgcacgcacacatgcgcaggacggagagcggaggcagccggaggcggcggtgctgtgtttgatgaggaagtctggaacaaaagagggtatcgagggatctattggatttaagcatgggattgatgtgaacccatcttctgtttctactcaaacaggaggaacgccgatcngatttgatgattcgagtgt

SEQ ID NO: 99001 - DNA, 357 bp, Triticum aestivum
  unsure (1)..(357): unsure at all n locations
  Clone ID: PAT_TA_99001
cgcagggggacaagttcgtgttccggtcgacgagggacggcggcaaggacaagttccacaagaacctctacatcatggaggacgccgaggagggggagttcggccatggcacggtgacncggctcaccgangggccgtggacngacacccactgcatctggtcgcccaagggggactggatcttcttctcctccacccgcgagatgcccgccagcgcgccggtngatnngccttccttgactcgggctacttcgccntgtacctggtnaaggtcaccgatcccacngtggtcgtgcgcgtngtgcaaanctcggccaccctcgcgggacantttaaccancnctnttttcaggcccc

SEQ ID NO: 99002 - DNA, 529 bp, Triticum aestivum
  unsure (1)..(529): unsure at all n locations
  Clone ID: PAT_TA_99002
tttccatccagcgcaaccgccgccaacaccactcctagagagtcctcgccgccggagaagcagcaagcaagatggccggaaggaaggccggcgacaggaagaaggcggtgacccgctccgtgaaggccgggctccagttccccgtcggccgcatcgggcgttacctcaagaagggccgctacgcccagcgtgtcggctccggcgcccccgtctacctcgccgccgtcctcgagtacctcgctgccgaggtcctggagctcgccggcaacgcggccaaggacaacaagaagacccgcatcatcccgcgccacctgctgcttgccgtccgcaacgaccaaggagctnggcaagctgctcgccggcgtcaacatcgcccacggnggtttgattcccaacattaactccgttctgcttcccaagaagtcccccgcccgccgccgagaaggaagncaaagtcgcccaacgaaagaaagancaaccccaagttccccaangaaagaagaacgccggcanccnaagggagtaccct

SEQ ID NO: 99003 - DNA, 320 bp, Triticum aestivum
  unsure (1)..(320): unsure at all n locations
  Clone ID: PAT_TA_99003
tgagagatgaactcctttcaaattcgggttatttgagttgggagctgtgttccagttatgtctgattatctcctgaaacccggatttcagtttctgattccccgtgttccactggcggtgaccatcaggcctttgcgcatgatcagtggtgttctgttctgataggggagtagtagtaggaatcgtgtcaacggagcttttggctggaaatctgtttggtgctctggcattacgacctanaggtgctccacttgtaacgatccngaatttgactgaaattattggtatttggatgctgtgtgctccacnncaanaataac

SEQ ID NO: 99004 - DNA, 534 bp, Triticum aestivum
  unsure (1)..(534): unsure at all n locations
  Clone ID: PAT_TA_99004
cccagatcccccaagagctccctctcccccacccacgaagcgcctcccatcccgatggcccgcacgaagcagacggcgaggaagtccaccggcggcaaggcgccgcggaagcagctggcgaccaaggcggcgcgcaagtccgccccggccaccggcggcgtgaagaagccccaccgcttccgccccggcaccgtcgcgctccgcgagatccgcaagtaccagaagagcaccgagctgctcatccgcaagctgcccttccagcgcctggtgcgggagatcgcgcaggacttcaagaccgacctccgcttccagagctccgccgtctccgcgctgcaggaggccgccgaggcctacctcgtcgggctcttcgaggacaccaactctgcgccatccaacgccaaggcgcgtcaccaatatgcccaaggacatnaagctcgcccgccgcattcgtngcgaagaaggcctaaaagcgcccttaagcttcnttnggnggtngtataaggggtttttaggtttgaaacctgtgttggcgtt

SEQ ID NO: 99005 - DNA, 415 bp, Triticum aestivum
  unsure (1)..(415): unsure at all n locations
  Clone ID: PAT_TA_99005
cagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggancccgagccagcanctgcggccgaaccggagccgaggcnccccgcccgttggtcgagacagangaccanggaggccggtggctgangcaganccngcggcggccgancgangtgaangaaaanggcggcgcctgttngtcc

SEQ ID NO: 99006 - DNA, 539 bp, Triticum aestivum
  unsure (1)..(539): unsure at all n locations
  Clone ID: PAT_TA_99006
gcacttcancagctcccctcacatcccacgccaagccccacgctcgaaccaccaccaccaccagcacccatggcacccaaggcggcggagaagaagccggtggcggtggccgcggagaagacggcggcggggaagaagcccaaggcggagaagcgggcggcggcgaccaaggaggccggcggcgaggggaagacgaggggccggaagaagggcagcaaggccaagaagggcgtggagacgtacaagatctacatcttcaaggtgctcaagcangtgcacccggacgtcggcatctcctccaangccatgtccatcatgaactccttcatcaacgacatcttncgagaagctcgccggngagtcccgccaagctggcgcgattcnacaaagaagcccaacattacgtcccggggagattcaatacctccgtccgcctcgtnctcccccggngagnttcccaatgcaagccggtcnncggaggggcancaanggccgtcaacaanttcacatccatcnataaggtttccncctctgtttnt

SEQ ID NO: 99007 - DNA, 492 bp, Triticum aestivum
  unsure (1)..(492): unsure at all n locations
  Clone ID: PAT_TA_99007
cggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatnccgtggggtgaggctggtgccnattacgttgtggagtccaccggtgtcttcactgacaaggacaangccgctgctcacttgaanggtgggtgccaaagaangtggtcatcncctgccccaagcaaaagatngcccccangttttgtnggttgggngtcaatgaaggacaaagtncancctccagacggttaaacaattttntcaaatggcctaactggcancaactaactgncctttgcncccccnaancaaaggat

SEQ ID NO: 99008 - DNA, 464 bp, Triticum aestivum
  unsure (1)..(464): unsure at all n locations
  Clone ID: PAT_TA_99008
gagaggagagagagagcccactgtgattgatgaggtgaggactggcgcttaccgccagctcttccaccccgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtcttcaatgctgttggaggtggaactggctctggccttggttctcttctgctggagcgcctctctgttgactatggaaagaagtccaagcttgggttcacagtgtacccatcaccccaggtctccacctctgttgttgagccatacaacaagtgtcctgtccacccactccccctccttgaagcacactggangtgttctaatccttcctngacnanttaaggnccatcctatgacaatctgcccgcncgct

SEQ ID NO: 99009 - DNA, 358 bp, Triticum aestivum
  unsure (1)..(358): unsure at all n locations
  Clone ID: PAT_TA_99009
ggcggangtcnagtaccgctgcttcgtcggcggcctcgcctgggccaccgacnaccattccctccagaacgccttctccaagtacggcgacgtcatcnactccaagatcatcactgacagggagacgggccgatcccgcgggttcgggttcgtcaccttcgcgtcggacgaggcgangcgccaggcgatcnaggccatgaacggccatcacctggacggccgcaacatcancgtcaacgacgcncattcgcgtcnctccggcngaggaggcggcggcggcttcggcggcggcngtggnggctacnggggccatcnccgtgaggncntgangcggnggcntnactgctgnngcggcggc

SEQ ID NO: 99010 - DNA, 486 bp, Triticum aestivum
  unsure (1)..(486): unsure at all n locations
  Clone ID: PAT_TA_99010
nggcgtccagccctccnagttcnaggacaccgtcgcgcangctttctttgacctggagaacggcaaccacgagcttaagagcgacctcaaggacctgtacatcaacactgcaatccaaatggatgttgttgggaacangaaagccgtggtgatncatgtnccataccgtctgcgcaagcccttcangaanatncatgtcaggcncntcagggagctccagaaaaantttagcggcaaggatgttgtctttgttgcnacaanaaagatnntgaggccacccaagaanggttctgctgttcaacgcccncncaccangancctgacanctgttcatnanngtatcttggnggatgttgtgtatccancngagaattgtggggaagcgtgtcaaggtncccntttggatggtgccaaaggtcntcaaaatctaacntggncccnaaagganncgcaaacaacaactggagtncaaagcctgggagaacc

SEQ ID NO: 99011 - DNA, 275 bp, Triticum aestivum
  unsure (1)..(275): unsure at all n locations
  Clone ID: PAT_TA_99011
cgggcactanatncttaaaantgggtcggacggactgcagcnaggatggcatgcatgttcgttggccttttgtcgtgctatggtcgaanccatggccggagcgtgatntggcaccaagcattgttgtnttcgtaccanaaatangtgcgttgttgtatccnaanttctttttgaaggaaacangaattgatttgtttgtattgtaacgttgtgtcattgcaaaanaataacctgcntgtaaaactgtnaaangtgacagtctgcccgtttgcacc

SEQ ID NO: 99012 - DNA, 449 bp, Triticum aestivum
  unsure (1)..(449): unsure at all n locations
  Clone ID: PAT_TA_99012
ccgcgccccgtttattattccccttcgcgcatccgcccccgtgtctcccgtgcgcaccttctcnaagcctcccccatggcggaccagctcaccgacgagcagatcgccgagttcaaggaggccttcancctcttcgacaaggatggcgacggttgcatcaccaccaaggagcttggaaccgtgatgcngtccctcnggcagaaccccacngaggcgganctgcanganatnatcaacnangttgangcggacggnaacggnaccatcnacttccccgagttcctgaaacctgatggcgaggaanatgaaggacacggnctccgaggaggagctcantgagagcgttccnccgtgttncnacaatgaacaaaaanggcttnatctcggncgggcggagctncnccaccttgatgancnaaccctcccggggagaaancncacaggaccat

SEQ ID NO: 99013 - DNA, 561 bp, Triticum aestivum
  unsure (1)..(561): unsure at all n locations
  Clone ID: PAT_TA_99013
gccggccgcctcccaccngcctccgtgctcccgtgcctcgccgcttaatctccgtcgangcctcccgcctggatccgtgcctcgccctgcctttcccttccccgcacgcnggncgcgccgttccaccgcgcccaagtcctgcccggcggccgccggtgttcaggcgtgcaccttggccttgccctgcgctacancagctaagcccncccaccggcccacgacnaaacactgcacacnntgtggnccgcccctgttttaaactcctagatccancaaacgtcctcaagcatcaaggcagtcagtagccaagcnancttagggttacgggagggcangcaaggcncggttgggcaagcctnggccaaagttttanaatcctcncaantaacngtggtttccaaagnnttttcccctttcgacggtncgcangttccaatncagnaanggnttcccgccnaaggcccngacggcctttcagacggnaagnaattgcaaaaanggncctgcccgnaattttcaaaaagcccccccctccactttttttcgnnnctagaccncgcn

SEQ ID NO: 99014 - DNA, 417 bp, Triticum aestivum
  unsure (1)..(417): unsure at all n locations
  Clone ID: PAT_TA_99014
cggtggagctcggtggattgtcngggcaaatggattccanttccagggccgccctcttctgcttcctggccgtcgcctcctccctcctgcaccccgccagatntgacngggagganaancaactccncnaggggatcaananctacagagcttcactcaaggtccnngcgctcacccagaacannaatgccgactgcctggccgagcagctancnaagaagttcaanggccagggagtgcatcaacaccaaccggagccaacaacgtccccngcaccgaagccgcagttccncgactaaccccaagttcctccgatcgctggcaacctcaacccgttccgtttactganngacggggcaagggtgattgcccggcaatgcnttncccgggactncntgggccggacntttntttctt

SEQ ID NO: 99015 - DNA, 265 bp, Triticum aestivum
  unsure (1)..(265): unsure at all n locations
  Clone ID: PAT_TA_99015
cggaggaggacctgatccagccgccgcggggtacgcgcacggtggaggggctgcggctcaacacccgggtcggcgtgcagtacctcgcggcgtggctgggcgggtccgggtccgtgccgctgtacaacctcatggaggacgcggccaccgcggagatcanccgcgtncanaactggcantggctccgccatggcgcggtgctcgacgccggcggcgtggcggtccganccangccgganctgctcgcncgcgtcntngangagga

SEQ ID NO: 99016 - DNA, 425 bp, Triticum aestivum
  unsure (1)..(425): unsure at all n locations
  Clone ID: PAT_TA_99016
agcatcctctgccccccacaatctcacctactccggccatctctccggcgancaccgtantaccaccctacctccccacccaaccctancgatggcgacaacggcanccngcggcgggaggggcaanccnaagggcaacaantcngtgtctcngtcngtgaaagggggcctgcagttccccgtctgccgcgtnncccggcacctcaaggtnggccgctanncnaaacgcgtgggcgcgggcgcccccgtcctacctctnncccgtccttcaagtnncttcgcccgccnaangccctttnagctggcccggnnactcgggcgccnccgataaacaaagaanaacctgggnttttcncccgcnccaacattncaagcctcgcccgtncctcaaacngancnatggagctnaaacccngcttgctctg

SEQ ID NO: 99017 - DNA, 191 bp, Triticum aestivum
  unsure (1)..(191): unsure at all n locations
  Clone ID: PAT_TA_99017
cctcctttcnccaacccacacnangagcgccctctctcccccgccccctccccccaggaaaccagccatgaagggggccaaatccanncggcgccgccanngncgacgccaagttggctgtnaanagcaanggggcgganaatccggccgccanggggaataagggcaatgccggcaattgaccccantca

SEQ ID NO: 99018 - DNA, 490 bp, Triticum aestivum
  unsure (1)..(490): unsure at all n locations
  Clone ID: PAT_TA_99018
accctancctccggctccgatggcccgcacnaatcanacggcgcgcaaatccaccggcggcaaggcgccccgcaagcagctggctaccaaggcggcgcgcaagtcggccccggccaccggcggcgtgaagaagccccaccgcttccgcccggggaccgtcgcgctccgggagatccgcaagtaccagaagagcacggagctgctcatccgcaagctccccttccagcgccttgtgagggagatncncangacttcaagaccgacctcaggttccagagctctgccgtctcccgccctgcaggaggccgccnaggcgtacctggtggggctgttcgangacaccaaacctgtgcgccatccacgcnaaagcgcgttcaaccatnaatgccccaaaggacatcnagctcgccccggccgcaatcccgttnngggaanccgcnccctaaaggttttccggttncccgaccggtgaaaaactgggttaattanc

SEQ ID NO: 99019 - DNA, 440 bp, Triticum aestivum
  unsure (1)..(440): unsure at all n locations
  Clone ID: PAT_TA_99019
ccanccctcgcgccgccgcaccaacaancaagcgccgtcnccgccgccgccgccggagaangagagggagcaaccgcanccatgggtcgcgtccgcaccaagaacgtnaataagacctcccgccaggtcatcgagaagtactactctcggntgaccctcgacttccacaccaacaagaaggtgctagaggaggtctcatcctccantcgaagcgcctccgcaacaangtgggcggcttcaccacccatctgatgcgccgcatccatcgcggccccgtncntcggcatctcnctcaaactgcaggaggaggaagcgtttancgccgcatngaattctttccggagnaanttcngcgctccnacgtcgnccaaatcctcntcngacanagggagaccatnggacaatnnctnggcgttcctcccccatngntnaacttcccc

SEQ ID NO: 99020 - DNA, 498 bp, Triticum aestivum
  unsure (1)..(498): unsure at all n locations
  Clone ID: PAT_TA_99020
ctcaactggctgtacagcgttctcgtcaatgaatactcagacgtaaatcgcacatatcacgacgcggccgaggcactgtccaactacccgtcgctttcaccaaagacggaaccatatacgtatgagaatggctcctcagcgcttctcttgcttctcagcggcacgctgccggtcacgtttcgcggcgcaacatacggcttcccggtagcgatatgggtgcctcaagtcgtacccccgagaaccacccattgtatacgtcacgccagcgcaggacatggtgttaagacctgggacaacacgtgagcactgatggcangatataccatccgtatctggcacaatggggcgaagtactgggaaaaatctaaactgtttcgacnttctagccgtgctnaagangggttctttgcnaaaaaagcaanccnttgcgaattngccggnnaacaaacaagcccgccaatacaaatncgccngcaagccanncaaagcaaccccctn

SEQ ID NO: 99021 - DNA, 462 bp, Triticum aestivum
  unsure (1)..(462): unsure at all n locations
  Clone ID: PAT_TA_99021
ctcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctctatcancaaggagtgctgctccggtgtgcaggggctgaacggcctggcccgcatcaagccggaccgcaanatagcgtgcaggtgcctcaaagagcctcgccaccatcatcaagtccancaaacacgggannaggtctccggccttccccggcaagtnnggcntcagcntgcccccttcccccattcagcantgttcnaccnaactngcaaaaaatggtccactnantttcaanattaaaacnccccttcc

SEQ ID NO: 99022 - DNA, 473 bp, Triticum aestivum
  unsure (1)..(473): unsure at all n locations
  Clone ID: PAT_TA_99022
atgtttggttgttttttctaaatatgtatgccgttatgtctgatctatctgagatttatttgtacataatcntctattcacaaatagcggccactgattgctagcactataatttaactccactaattaacttctatgtcagtattgggctattggccngcaacttancaataaatggcaaactatgaggacgctatgttatcctcccacctttcnattttggatttgttgagaggatattaaaactggnctatttgttgtgttcaaaaacgacagtggagcttccttcgattccgcataacaattagaaggggcaacaangctggcacttaanaaccangccaaatcctgcttccaagtgttgngatgcnaggtanaaatcctttacaaaatgttganncagcccccaccttgggccctggttaaccnttttaaaaattaattccattgtnccannccaagggggattcaaa

SEQ ID NO: 99023 - DNA, 386 bp, Triticum aestivum
  unsure (1)..(386): unsure at all n locations
  Clone ID: PAT_TA_99023
accaacggcggcgggganaaacggcgcattggcggccaacancgcatgtncagcacataacaacggcggctgtaangccacanccgacgaacangtggtncngctgagggcgtganaaaggaggccgggcggcnccccatgcggagctcggccgccagcctggcacgcacagggcagccccccgcgagcgccctgcanccgcatcnccnancggcaaccccgccgccacactactgcacnanggcaggcgccancgcatcctccgagccacanncccngccgttccntggccgggaggtcgccaccctttccancctttttcgttcggncancctgaaatnccttgntttngtncgcccccccctttttggttancaattttttct

SEQ ID NO: 99024 - DNA, 492 bp, Triticum aestivum
  unsure (1)..(492): unsure at all n locations
  Clone ID: PAT_TA_99024
atnatcccatcccccaanccataaacccaagtcggactcgccttcctcctccccaactactcctcctcgcctccgcgcatcncaccgcaccgggggtcacctgagatcacatacacaatggtgaaggctgtggctgtgcttaccggcagtganggtgtcaagggcaccatcttcttcanccaggagggagatggcncgaccaccnntgacgggaantgtnactggactcaaggaagggctccacggnttccatgtttcacnctcttggtgacaccaccaatggctgcatntcaactggaccacacttcaaaccccgcctggtcatgtgcatggggcnccccgnangatnaaattccccntgcttggtgaatcttggnaaatgtgacanctggaagcccggtggtgttnccnaaacatcaaatgntacnggnctgccaaantcccccttntctggatcaacaattcaatttttttncccgttgcngtttngtn

SEQ ID NO: 99025 - DNA, 162 bp, Triticum aestivum
  unsure (1)..(162): unsure at all n locations
  Clone ID: PAT_TA_99025
ngccgccgctctccattctccaangtcccaaggntccaaatntctctccttcgcanctgcctcggtgggctttggagcgcacnaaatggcggnagaanccccnacaccaattgttnccccantaaaggnacctaccccggttcttggtgagccnatggactt

SEQ ID NO: 99026 - DNA, 439 bp, Triticum aestivum
  unsure (1)..(439): unsure at all n locations
  Clone ID: PAT_TA_99026
gtcacatntaagaagtanagcccggtgcccaagaacnaantnctgatcccgctcatnctccacgacngncgcctcgtgcaacgcccgacgctgctggtggcnctcgtcatcntcctctggatgccgttcggcttcgcgctggcgctcctccncgtgtanatcaaaangcccctcccggagcncatcntcttctanatctaccacatnatgggcatcaagctcatcgtnaatggaaacncgcccgccgccncccaanaangggagcccgggcgtgntcttctntgcaaancaccgcaccnttctggatnccaatcnaangtcggccgtngcgctccngnccgcaaagtgaggcttgcnnttacctanaaacnatctccaaaactttnntcgggnggcttaattntctccccaatttaattggagggtgngnggnctcgat

SEQ ID NO: 99027 - DNA, 425 bp, Triticum aestivum
  unsure (1)..(425): unsure at all n locations
  Clone ID: PAT_TA_99027
caagtgcggggcnnacgcacagagaaagaaaggaagcaaggggaggaacangatntatgggctgctatngcgtctgtngggaacaaagaaagcnccctccctggtggtggcggcaagcntgggcgccctngatggcgctcaancgaccaancnggcctgttccgctggggntanccgctccgctcgctctaacgccacnccgccgccgcgcccanggtccgcgccctgtcngcctcnctctccgaagcagcagccgcccgcggctcccccaccggcgccttttttcgcggaggatgcgaaactncgcaatggggcaccaccctngtcttgcctgggggncccaanttgaggtccttctctccgcttcattgtnncccancggccacaatnangcatatataaaantngctgnatgaaatgccctt

SEQ ID NO: 99028 - DNA, 485 bp, Triticum aestivum
  unsure (1)..(485): unsure at all n locations
  Clone ID: PAT_TA_99028
catccatccgcccctcgctgccgctgcgtctcgtctccaccaccccacttgcccccggactcaggaggatcntcggagatgtcggacaccgatgaagcaccacttcgagtccaaggccgactccggcgcctccaagacctacccgcagcaggccggcgccatccgcaagggtggacacatcntnaatcaaggcccgtccctgcaaggttgttgaggtctccaccctccaagactgggaagcatggtcacgcaaagtgtcactttgttgccattgacatctttaatggaaagaagcttgaggatatcnttccttcatcncacaactgtgacgtcccccatgttgaccgccaagattatcacgctgattgacataaatgatgatggatatntcagccttctaactgaagagtggcaacaccnanngatgaccngaagcttccccactgatgatntttctgcctngccaaatntnnactgggntttnt

SEQ ID NO: 99029 - DNA, 205 bp, Triticum aestivum
  unsure (1)..(205): unsure at all n locations
  Clone ID: PAT_TA_99029
gccagccgcaagccacctncctctcccctcccatcccctaccaacgcccactcccctgcctctgccaccggcgtcccgtccanattnccgccgcgggcctgccccgccgcggnattggtattcngtgccccgctccgtcngcccagccccgcgcgcgatgacggcgggcgcctccttgttattgttgttgttgatgaangaagaa

SEQ ID NO: 99030 - DNA, 502 bp, Triticum aestivum
  unsure (1)..(502): unsure at all n locations
  Clone ID: PAT_TA_99030
ccgcagcggcgcgcacacctctccctccttcctgaagacagcgccgccgccggccagagcacaggatggcgaccgtccccgctcccgcanccganaccgcagcctccacggcgcgcaccgtgaangatgtcaacccccacgagttcgtcaaggcctactccgcgcacctcaagcgctccggcaagatggagcttcnagagtgggttgacattgtcaagactgcaanggttcaaggagctgccaccttctgatgctgactggtactacatcagggctgcctccatggcaaggaagatntacctgaggcaaggaatcgggatcngcggcttccanaagatntacggtngccgttananggaaangggttcaacgcccancncactttntgcaaanaancaancggtgctgttttcccncaacntncctccaggangttncataaanaanggggcaatcaattgntngttcnaaccccaangggtgggaaggnccatcacctncc

SEQ ID NO: 99031 - DNA, 487 bp, Triticum aestivum
  unsure (1)..(487): unsure at all n locations
  Clone ID: PAT_TA_99031
tgcaatcacttcactcagtacactaaattatnagagaacgtccatcttgctgcagtattttatggaacatggtgaagttcttacaccacagcaggttgccaagcaagagcatattcttccgttttggtcaagctggcggaaattacttagggttaaacttccacatgagcttgtncacttaggtgctaaagcctcgatgcttactcactctgacatgttgctgattgcaaaaacaagatcctactattcaaatgccaactattttttgctggacaaggaaagcaagtgttcatatcttcatccacaaagcaggcaagtggcaactgatgtcttgaagtccttcatacatgggactcntcttancaacgcttgatgcagaagaagcaaaatctgtcatacnggaagctcaccaatgggatnggatgagaaaataacaacaccntcaatctccaaagctntaaagttgggaagggtaccccaaccggag

SEQ ID NO: 99032 - DNA, 342 bp, Triticum aestivum
  unsure (1)..(342): unsure at all n locations
  Clone ID: PAT_TA_99032
gtccactgcaaacaaaccaacgccttgacccctgcgctctccctcccctccccagcgccaagaacccagcttttctcctccccgccgccgcctccagcgccatgaagcgcctcttccgacggctctcccgcgtcgccgcggccgactcctcctccgcggctgccgccacggcgtaccggcagctccgcgcgccgaagcagtccgcgtcggcggccggcggcggctgcgccaaggtgccgcaggggcacgtgccggtgtgcgtcggcnaggagggcgggcccgtngatcagttcncngtncgcccggacctgntgggccggncggccttcncntttctgtctc

SEQ ID NO: 99033 - DNA, 231 bp, Triticum aestivum
  unsure (1)..(231): unsure at all n locations
  Clone ID: PAT_TA_99033
cgagctgtgagctctanctctgaagctcgagcttgctagaaaanccacacancaatancatggcggnatcaataacctgcnccttcttcttncanncccagccngccggcgagcccggcaagcanncnctggacgcgtgcgcgctctgcgccaancgggtggcncgcgacanacaacgttttcatttntataangggagaagcccntctncagcgaggagtnccgccacca

SEQ ID NO: 99034 - DNA, 494 bp, Triticum aestivum
  unsure (1)..(494): unsure at all n locations
  Clone ID: PAT_TA_99034
agccgccaccctttgcttcgcttttgcttgctgctgcggttaagttagatntcntcccccccgccacctcaccaacgacgaacaaaaaacacccgcaggtaganggccggagatcgatctctgagcttatccacctgttgctgcggtggtgatgctggtggtatcgatctcacancttgggatcgancccgccgtgcatttgcnccttggggatttccatgtgaagcntgctgctgctgctgctgcagctgcaaggaccgactgattctcccntaacnaagccgtnctgtnatggaatggatgcttggcccaaannggttggtgnaatccctccctcctaactaagataacatgattgggtgntgccccngcctgtttctattcnatgggagnggcctaccaaactgctgctgccnanaacaatggggggnngactctgttccgtccgtcgnaaaaaggncgtgcntatgatttnatnattttttttnacccnn

SEQ ID NO: 99035 - DNA, 274 bp, Triticum aestivum
  unsure (1)..(274): unsure at all n locations
  Clone ID: PAT_TA_99035
ggncgctcctaanaactangtgggattccccnggggctgcaaggaaattcngcaacgaanggcgaaggcaaccgtnanggaaacccngatnaacccnaagaaacgcncacctngaaggggcctccccnggcgcnggtgggaagcgtctgggtgctgttnaanggccgaactgctcgacgggcgaacgcgctccgcgccgccatcgccggctgccatggcgttttccanancgcctcgccggttaccgacgatncaaaangaaatggtggagccc

SEQ ID NO: 99036 - DNA, 402 bp, Triticum aestivum
  unsure (1)..(402): unsure at all n locations
  Clone ID: PAT_TA_99036
cccgccaccccaaaatgctgccggcgaggcctgggaccgccgacgttagctncangcgttcnacgacaccaangcgggcgtcaanggcctcgtcnacnccggcgtnacggncctcccgcccancttncgccaatcgccggagtccctggngggcatcacttnctcaaaccatgacgccgcngccatcccgacngtcnacctatccgccgcncggcgcgangacactgtcgcccntgttctgngcctcngccgcgacagtgggcttctttnatgtggtcaaccacagcgtgcccgcttgaagctcattggccggcatgctctaaagtcgtncncccnggttnaattgaatgggncccgccctaggcganatcnaaggncaatctacaacaagggaagcaaagc

SEQ ID NO: 99037 - DNA, 261 bp, Triticum aestivum
  unsure (1)..(261): unsure at all n locations
  Clone ID: PAT_TA_99037
ncaaatncctcgtccctcttccccctcctcgttcctatcgccgccanccctcctcccctcgaatttctatnanccatcgcgacnctactccccatcccatanccagnatgntcctcgcaccntcncctgctccaatggaagacanccgctnccgtgtncgtgcccanatccgccngccgtgccgctctccccttcccggcncccctnaagctncaggggncgcgnttcgctcncccgccgnggcggntccnctggggtgcc

SEQ ID NO: 99038 - DNA, 497 bp, Triticum aestivum
  unsure (1)..(497): unsure at all n locations
  Clone ID: PAT_TA_99038
tctttanaaggcangcgctgtncggttatgatgctcccaaaacaaaaaanccaccgtcaaggacttgcaactgctggccaaantggtgtgtgtgctgtttcngctttggtaacaggaagaacaanaagaaggttnccangcctaagacagagaagaagaagagattgtttttnannaaggaagaaaatcaatcacctgcntatgcactcagtnaaattgacnaagcanctgcaggagctgaaactcacaangctggtattgtnaattatcaaaagttnnanaagaaatttggccagtcnnctgtttttgttgcatcaactcttcttgagaatngtggtacccngaggggtgataatccaaccttctcttctgaanggaagccanaacatntcnntggctgtggctnatgaaagacaaanacanactgggggaaaaaagagantggnctgggatnctaatnggttcantttncnacanggantatcccccgncctggg

SEQ ID NO: 99039 - DNA, 512 bp, Triticum aestivum
  unsure (1)..(512): unsure at all n locations
  Clone ID: PAT_TA_99039
ccaagatctanctcagctcaagatccangcagggtaagccacagccagccatgtgctgcagcgagtgcggctgctacgatgcattctgcgactgctgctgcccctgcgtctcctacgacgcgcgcgagaccatcctctgctgcgcggcctgcctcgccgtgctcgccggcgtcgtcctcnttcnccgtcctcctcgcggcctacggcttcatccgccgccccnaggtcgccgtcgtcgacgcctccctcacgcggctcgcgctggccacgtcccccgccaccgccttcgcctanaaactctccctcacgctcaccgtccggaacaagaaactggggccattgagcgtcaaggaacaccaagccggctgggnggccgacttacagctttccaannggccagcgctttccaagcggggtcaaggcttctccganccaaggggntccancccacccccgcccgggtaangaacccaaaggtgttacaaaccttcgttcnccgggnctccggangg

SEQ ID NO: 99040 - DNA, 288 bp, Triticum aestivum
  unsure (1)..(288): unsure at all n locations
  Clone ID: PAT_TA_99040
cctccggcaagaggggcttcnccgagaccatcgacctgaagctgaagctggagccggccggcgaggaggcgccggccgaggaggatcnggccgacgtngccgtggtcgcggccgcggcggcggagaaccangaggagacggcgacggacgccggcgcggggaagatgaagaggtcgccnatccanaacaacntcgtcacctccgccgcgctgcccgaccccgccgagaagccccgcgcgcccaangcgcangtggtggggtgggacttcannntccctcttttctttg

SEQ ID NO: 99041 - DNA, 486 bp, Triticum aestivum
  unsure (1)..(486): unsure at all n locations
  Clone ID: PAT_TA_99041
gatttcgccaaattcctcgccggcttttcgaacattaccaagcttgtgatttgcactcggcattcaccgttaaatggggctataatactagagaggcttcaatgcaaatttggcaacttaaaaagcttgacactatatacacaattttgtgagcttccctccattctatcaacctattgcttactaaggaatgccccaaaccttgaaagactcaaaatactgatcgacaatagtgccgagcagaaatttgaggcacatgaagagtttcaaaattcacagtggaccggtggcatgtgtgccaaccttcagttngtgcagataactggtattcattggcttccnaatgagatgacttttatagagcttattctcctctaaagcaaggcttttttgcacattatttattactcaaggtgagaattgctcnatgtcnaatgaggatgcaatnaaacaagaatacctnaagttnccnnaaagagcttcnnc

SEQ ID NO: 99042 - DNA, 261 bp, Triticum aestivum
  unsure (1)..(261): unsure at all n locations
  Clone ID: PAT_TA_99042
ctaacccgcccccacctcgtcgcatcccctctctcccaacctcgccgtngccgcctcctcctcctcctcctccggtgtncgcccgccangcagcccccctccctccccccctccgcgctccangattttnggncgggangcancaacggtanccgccgtcccaatcgagcgggagaagaggggatnaangacagntggcggaggaggaaaanccntgntttnctcttngcggatacggannnaacctgggttcannacgtt

SEQ ID NO: 99043 - DNA, 341 bp, Triticum aestivum
  unsure (1)..(341): unsure at all n locations
  Clone ID: PAT_TA_99043
cagcaattatagccagcgcctcccccaccaccaccatcaccttccccctcctcctcctccgatngcatctcctctcctccgtcctcccctcccgtcgcccgtctcagcctcctccgagctcgctcgctcgctcgctcgccacgacattctgtaggaaatggntgacggtgaggacatccagccccttgtcttgcnacaatggnaccggaatggtcaaggctggtttcgctggagatgatgcgccaagggctgttttccctagcataagttggtcgcccctcggcacaatgggtgtcatggtatggatgggggcanaaagggatnnccnaatcttccggtgg

SEQ ID NO: 99044 - DNA, 433 bp, Triticum aestivum
  unsure (1)..(433): unsure at all n locations
  Clone ID: PAT_TA_99044
tctccaccccgcaacccaagcagacgcagctcnaccgaccacaactgtgcgcaacaacggcggncggcggagancgtatcgtaccatggcgatggagggctacgancgccagttctggcagttcggngaccanctccgcctccanacgggcancttctccggnctctccctcggcgactccatctggtcccccgccgacgccgccccccgcgcccgcaacgccgaacccggnctcttttccccctcccangcgggccaaaaaaacnccnggaaccngnttcnccgccgccaanatnaacggggagccctcaaagggcccggnctcancggggtccggcaagctcnccttntggggcnancaacaaacnancaaggnccggncgntacaaaaangntangccttcccgcccgncngccggnaggcaaaggcctt

SEQ ID NO: 99045 - DNA, 305 bp, Triticum aestivum
  unsure (1)..(305): unsure at all n locations
  Clone ID: PAT_TA_99045
gagcgancgagctgtnacgataaancccgggaggnagcaccgctcgggagcaatggagagggcgacgccnggtgcngagcccgcacanctcnaanggcgaactgctcacctggtcggccaggggngcctaancctccgccgcctcncccggcggcccgtncctccccaacctcaanccggctggggggattacnccggccatnttntgccgccngtgatccatcaccaagccgaggatcttancaacaattttaaggagattnnatgtncggntttaaaagatnaaaagaaaannantggcgagt

SEQ ID NO: 99046 - DNA, 321 bp, Triticum aestivum
  unsure (1)..(321): unsure at all n locations
  Clone ID: PAT_TA_99046
ccccgctccaaaccaaccaagccccgcccccgttctgcccccccgcaaaaccctagctccgtacccgcgccgcggnctccaccatnaanggcaaggctgacacctccaagaaaggcgagggcaggctcaaggccgccggcggcgccagcaagaggaagaaggacgccgctgccgctggcaagcccaaancgcccgccctccgcctttttcgtcttcatgtctgagttcaggcagcagtataacnccggagaaacccaacaacaagagtntctccaacggttaagcaaagcggcggggtgagaaatngangaactatgtctg

SEQ ID NO: 99047 - DNA, 432 bp, Triticum aestivum
  unsure (1)..(432): unsure at all n locations
  Clone ID: PAT_TA_99047
gtagtagtacactggcatgaaaccagttgaggcaataagtcatgcttaattgttagattattgcntctctttcattaacatgatgatgatgtttatcttcatatttgtttgttccctttctatatattacattcaaaaagaaaatgctgtcatttctgaaaaaccatataattgcaagagagtttgctataatagactatgaaaggcctcttttgacaaaaattgatattatctagagagataatatatgaaggttggatttgccaatttatgtagaagatacgtcttaagcctcccatctccntgattgtcctcaaagctaccgggaagatgtttacattaatatgaatgccnacaatgaaattgtgccaatgtagaaacnaccccatcatatacttttaataccgggnntcaaattcnggtttaaanttg

SEQ ID NO: 99048 - DNA, 444 bp, Triticum aestivum
  unsure (1)..(444): unsure at all n locations
  Clone ID: PAT_TA_99048
aaacttttgattacaattttagtgcacngcaangggaaataaattccgttncacataaggtatatttgcattaccatatacacacantattttcaatatatattgcntccanggttattangtntctaccgggtcgtcntgctatcanactgatgttgagaacaaaagaaactttgcttgagaatgtcagcacacgccagggaaaacttatactgcaaacaagcaggtatcttttcataatcacatacaaaatttgtgtgcaaactatangtattagccttgtttaanttgtttattacttcttctttgccatcatactatttgtccggagcaaaaaaaagaacaaaaccgtgctaatgtatgcaggtaaagacnggcacaaagtgggattgccnganttggttgggtgttngtgaactantttgtgagnagtggcccaaattc

SEQ ID NO: 99049 - DNA, 187 bp, Triticum aestivum
  unsure (1)..(187): unsure at all n locations
  Clone ID: PAT_TA_99049
ccccaccgtgccgacngcctccncctcncttcctncctaaacatncgccancancagatcnanatctcaagcaacaggncctgtcgnattccagcctccgccgccaccttccccaccccgagctcggattnaggccacccaccatcttccctgtaccatagctgcnctcatcagctnnggtctcgtc

SEQ ID NO: 99050 - DNA, 302 bp, Triticum aestivum
  unsure (1)..(302): unsure at all n locations
  Clone ID: PAT_TA_99050
caacccaatccccatcccctcccgctcctccacgcgcgangcgaactcttcaatcctcncccaagggagcgtanggaggcgaanantaaggagatncttcacatccagggcgggcagtgcgggaaccaaatcnggtccaacttcnnggaggtggnntgcgaccaacancggcatcnancccaccggggaggtanntcngcacctccgacctgcatgctggngcgcntcaacgtctactaaaacnangnctcaagcgtgncgcttntttccgcgccccntngttcatgngtntttgaccncgg

SEQ ID NO: 99051 - DNA, 479 bp, Triticum aestivum
  unsure (1)..(479): unsure at all n locations
  Clone ID: PAT_TA_99051
gaaccaagccgccgacgccaccatgggtatctcgcgtgactccatgcacaagcgccgggccaccggtgggaagcanaaggcttggaggaagaanccaaagtatgagctcggccgccagccagccaacactaagctttcaaancaacaagacaagtttaggagggtcccgtgttcgccngaggtaacgtnaagtgggagggctctcccgtctttgacactggtaacttttcatgggggtaagtgaggctgtngancccncaagacccntnctcctggnaatggtggttttacaatttcgtcaaaacaatgaacctttgttnagggacncaanaaccccttgttcaangaattgccanttngtgccaaagtttnaatnncctggcccccccttncnaaagncaagttnggtnaccctggaaccccaanttattgggagttcnaaaaatcccggttanggaangnaanaaaaagcctgcttg

SEQ ID NO: 99052 - DNA, 432 bp, Triticum aestivum
  unsure (1)..(432): unsure at all n locations
  Clone ID: PAT_TA_99052
gaccgcatcacccactcctctctcgcgtgcgtgctcgtgcttgccgctgcagtcgctcgcctgcgacccaacctgccagagtcccgccggcagccggcgccctcctcgtcgttcgtgctctcggacgccagagactgagctctcccagagaccgaagccaagaccgcgtgtgtcgcgtgcgatctcgacgagatcctggctcgtgcggaaggaggcggccggccaaggccgtcgctgcagcaacagagcctgcgctancccgcccgctcggcggcggatgtggaggttatgggatttgcggagcgctcgagcgcgaactctgccggatnnggcgcccaaggccggtnntccaangttacnggngctttgccgggggaagcaggggaaattttttggaggccnggcgnggtggnncaanggaanaatttccaa

SEQ ID NO: 99053 - DNA, 334 bp, Triticum aestivum
  unsure (1)..(334): unsure at all n locations
  Clone ID: PAT_TA_99053
aagccgccgagctcgtctcgccgtcgtcgcgctctatgcttttgtgatggaggccgagacggcggcgaaaagggcncgggagaacgagggcgctgcggcggcggaccgaacctgggancangcggggatctccgccgtcatccccggatngttctccgagatnagccccatgtngcccggcgaggcgcactcnctcaaggtngagaaggtccntgttccaaangcaagtcggnctaccaaanacgctgctggttttccantcctccacctacnggggaaangtncctcntccttngaatggggttgattctanggttgacctganaaggggaac

SEQ ID NO: 99054 - DNA, 434 bp, Triticum aestivum
  unsure (1)..(434): unsure at all n locations
  Clone ID: PAT_TA_99054
gcagcttaaatacgccgagagtaaagtaagagaagctggcctagaggaccacataacttttctgttgtgtgactatcgcctaataccaccttacaagtatgacgctatcataagctgtggnatgatcgancatgttggccatgaatacatggacgaattttttgcctgctgcgagtcntacttggctgaaganggcatantggtcctccanttcatcncaattgcagangaacggtactagcaatacaaaagaaggccancacntcgtcaaanaatacatantcccnggcggttgcagtccttctttggcccntgntatgtctnccatgaccacntcatcaaggttnancataaancatgttngangaatattgngccaaccactacanaactctgatgcacnggaggggagnacttcatttggccaacaaaan

SEQ ID NO: 99055 - DNA, 349 bp, Triticum aestivum
  unsure (1)..(349): unsure at all n locations
  Clone ID: PAT_TA_99055
ttgaaggaaggagaatancctatgattatgaaagaaagaanggcatcactccatgttgaggaaattccacgcccacaagtttnttgaaagaaagtcaagccaccnacatactaacatgttgctcctgctccctcanggttnctaccaatccacaatcaaagctaatgttatttntgaaaanggctccaagtgatnccgcnagcangggtggatncattcccttccaaagagancaacaaaggtggccgccacaagganggtaagcccgcncancccaagctacggcngacgangattttacccgtgggtggtgnnttncccaanacccctcaanggnncaccgttctta

SEQ ID NO: 99056 - DNA, 422 bp, Triticum aestivum
  unsure (1)..(422): unsure at all n locations
  Clone ID: PAT_TA_99056
gtcacacataagttctcaattggcagctattaccaatgagcatgccttttatngtgacccaattgaanccaaggctgggcaagctgctaantttttgaacattctacctaaattttgtgangctttttcctctatggttgaagggaaaaatgaaagatatatcaacaatcgagcnttctggtggagcacacattcactaaatttttcaatctancntcgtcaaaagcttanagggtgttnaccccntgttangatgtcanctgatnaaagacaccccncatggctatcaaaaatgcnacnggtcccnacgangtgcccttngtttgttccccgaaaggtggcccttctgtaangtccttttttcnccantgcnanaatccaaaattnccctnnattncaaanttcntcacccggtnggcggg

SEQ ID NO: 99057 - DNA, 454 bp, Triticum aestivum
  unsure (1)..(454): unsure at all n locations
  Clone ID: PAT_TA_99057
tccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcancaggccggcgccatccgcaagggtggacacatcgtcatcaaggcccgtccctgcaaggttgttgaggtctccacctccaagactgggaagcatggtcacgcaaagtgtcactttgttgccatttgacatctttaatggaaagaagcttgaggatattcgttcccttcatcccacaactgtggacggtcccccaangttgaccggcnaagntttntcnagcttgattggacaataaccggaatgattggaanantngtcaagnctttccaanctgaagaagttgggaaaccaccnanaggggattgtaccnttg

SEQ ID NO: 99058 - DNA, 236 bp, Triticum aestivum
  unsure (1)..(236): unsure at all n locations
  Clone ID: PAT_TA_99058
gctcttcgtgacatcttgagtatcgactacttcttcctccgccgagaagggaangggagcgccgcttgtgnatcaccggagccggactccatcancnatttctccgactgccgcctgcaggcggtaactgaaaagctctgtacaatctgccattgcncctctgcngatataagatngaggggntgaagttngacanaggcttnttttcttggtcctctgcancaaagcctgttctt

SEQ ID NO: 99059 - DNA, 201 bp, Triticum aestivum
  unsure (1)..(201): unsure at all n locations
  Clone ID: PAT_TA_99059
gccgtcgattcgaacctcccccaaatcagcagcagtcgaccggaggngccgccatggcccgtnccaagcaaaccgcccgcaagtccaccggcgggaaggngccccgcaagcagctcgccaccaaagcggcgaggaagtccgcgccgaccaccggcggagtgaagaagccccaccgctacaggccggggaccgtggggctcc

SEQ ID NO: 99060 - DNA, 419 bp, Triticum aestivum
  unsure (1)..(419): unsure at all n locations
  Clone ID: PAT_TA_99060
gcaccctcgttcctgcaccaacaccgcagcatttcaccatggtgagcgagcagacgccggtgaccacggagccggagctggagagcggcgacgcggcgccggtcatcaaggccgaggagcccgcggaggacggcgcgcccgtcgtcgaggacgtcaaggagggcgacggtgacgaggacnaggaggaggacgaggatgatgacgaggacgacgaggatgaagacggtaaccatgtccctgctcccttttgcatttccaccttaccttgtgatatcttctttcagttacactgtgtnaccgtgtaggttccattgtttaggaatgatgttagatcgtttccgtgcacccacctctgnttctttttgcacctgttattctactaanccntccggganttaattgggncatnttnccgtttt

SEQ ID NO: 99061 - DNA, 357 bp, Triticum aestivum
  unsure (1)..(357): unsure at all n locations
  Clone ID: PAT_TA_99061
ctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgtcccccgtgctgtcttcgtagatntcgagcccactgtgattgatgaggtgaggactggtgcttancgcnagctcttcnacccngagcanccttatcattggcaacgaggatgcatccaacaacttcnccccttngtcattncatcattgtcaagggngattgtttnatttccncccntnaattcgtt

SEQ ID NO: 99062 - DNA, 376 bp, Triticum aestivum
  unsure (1)..(376): unsure at all n locations
  Clone ID: PAT_TA_99062
agcaggaacacagttacacagaggtcctcggccgtggcagcacgttcacgttgaccaccagagctcaaacgcaacagccgcccatcatcagccagccgagccatcatcaggagagttcaggcctgcaagagctgcgggtgaaacaaaacgcatcgatccatccgtcggtcgcccaatcatgattctgggcttgggaggatgctgcggagctgccgccgccgccgccgccgtgtcgccggctgccgtcggcaagcaattgggaggccatctanaggccagtgagcggcagcagaagaagcggggggcaagtgatgangcanaagatgaacaagggaggcgagcagggagcggcggcagcagctgggggtaatngaga

SEQ ID NO: 99063 - DNA, 397 bp, Triticum aestivum
  unsure (1)..(397): unsure at all n locations
  Clone ID: PAT_TA_99063
aagcaagacccgagcaaggcacactctccagcaccagcaggccggcggcaagcagcgcaagcacaacaaccaaatggccaccatcaagcgccgccgcggcgaccaccgtcgtcgcccgtgccgccatcgccaggccgcaggccctatgtctgccccagctgaggacgaggagcgagagggtgaggtgcacctactccaaggacgccaaggaggcgacccctgccgccgccgtccgcggggctggcgcgtccctactctccgcngcgggcgcggtnaccgcgtccgccgggccggcnctggngctggtcgactancggatntttanccganggcaccgggcngaacctgtggggctgttcaaacaaancttctnggggtggatcttccctgnggcgtt

SEQ ID NO: 99064 - DNA, 291 bp, Triticum aestivum
  unsure (1)..(291): unsure at all n locations
  Clone ID: PAT_TA_99064
ccggcggcgtagacagcgccgcggcggcgcaggcggcctcgttcaagaaagccaacgaggggaggaaggcgtatatccnccngatcgccntgnatanggctttagctagctggctnnctacatttgtggtatgtctgcatgcattgcntttangccngncggncttctncncttttncttntgcgtttttnatttngttgtttcgttntangttcatgtgtttcggttgtgtaacggttngtgtcntcgttggnctnnccttctattnatcctnntatntttcttttttat

SEQ ID NO: 99065 - DNA, 413 bp, Triticum aestivum
  unsure (1)..(413): unsure at all n locations
  Clone ID: PAT_TA_99065
ctcatctctcccaaattgccgccatcaatcgcctcgtatccctcctccgacccacctcgccgccggcccttcccctccgctccttccacctcgcagctctagtggctgccggagccgcccaatccccacccactcatccctctcgcgtcccatctccctctcttcacacagctccttctacgccacctgcgacggttgactcaggcgacgtccggcgaaccccaccaccgtgaagcacagcctaagtccccctcgcaccacggcgccctcccatcaggttagatntggcgctcgcggtcaccaaagcccacccgcgaccctccccccatggctcttanggttttaggcgtcggctccggtggccgtcgtccaccttcccatccggtgagtgcatcccctccccctggntttan

SEQ ID NO: 99066 - DNA, 301 bp, Triticum aestivum
  unsure (1)..(301): unsure at all n locations
  Clone ID: PAT_TA_99066
ctctctcatcagatcagccacagantcacacaagcactanncttcagctanccagcctcagccactccgggcattttcttgcatccacgacggcaatggccaccgctgatgtccanaacccgacggccgcgctgacggaggaggcgcccgcggttggagacgccggtggccgccgaggaggccccgaagacggcaggaggtcccctgcgccgcgncgggaggccgaaggtcnaggcngtctgcccccgtccgagngntttaancgcgaccaanggatgganngttccgtnggtcncccggc

SEQ ID NO: 99067 - DNA, 207 bp, Triticum aestivum
  unsure (1)..(207): unsure at all n locations
  Clone ID: PAT_TA_99067
ccaatccactaacctagcgatgcctcccaagcgcaagtccccggttgcgacggcggcggcccccgcaatgccgcctaggatgacccggagcatggccgccgggaagcggggcgccgacgctccggctaaaaaggaggaagcanaggcggcgccggcggcggccggtggtaattttttttctanctcnctttntccacgctgtttctt

SEQ ID NO: 99068 - DNA, 412 bp, Triticum aestivum
  unsure (1)..(412): unsure at all n locations
  Clone ID: PAT_TA_99068
tactcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgangccccgaaatgtggcgctgcgcggatatgaaatccaccgtcgacggcacctgcggtggaccctgcaagaagtantgatcggttcatgccggcatatgaatatgttccggcctaaaatttaaataaaangcttgggacgataatgaagcaagcgtcattcctgct

SEQ ID NO: 99069 - DNA, 154 bp, Triticum aestivum
  unsure (1)..(154): unsure at all n locations
  Clone ID: PAT_TA_99069
ccggagcactcggcgatcttcaccaccatgcgcggcacacgcggatacctcgcgccggagtggctcagcaacgcgaggttttcgatgtcgcgtnntctcttttntnttacggnttctcttcctncatttntngantgactccgttactcncatc

SEQ ID NO: 99070 - DNA, 230 bp, Triticum aestivum
  unsure (1)..(230): unsure at all n locations
  Clone ID: PAT_TA_99070
ttccatgcgcatgtcgttgctgtagctcgactcatccacaactctcatacaaatcaacatgtctctagcacaggcaacaaaaggcgacatgccgtaccaagtgcgctctctttatcgctcactgctgcgacaaggcggccagttcgcctcctacaacttccgcgaatacgcgaaacggagaacacgcgatgccttccgggaccaccagaaagagncggtcggtnangagg

SEQ ID NO: 99071 - DNA, 371 bp, Triticum aestivum
  unsure (1)..(371): unsure at all n locations
  Clone ID: PAT_TA_99071
cttcaggtagtttcgtatgcgagtatgtaggtgaggtattgcaagagacagaagctgagaggacagaaaatgatgaatacctttttgatattggtcgtgacgatgacgatgatgaagaagaagaagaaggttcagaatcttctaaatccgagatgacggcggaaggcttgggctatacaatagatgctgcaaagtgtggtaatgttggaagattcatcaaccatagctgctctccaaacatgcatgcacaggatgttctctgggaccatgatgataggaggatgcccgcatgttatgcttttcgccgaaaagaatatccgtcctctacaagagcttacttacgattacanattatnacatnngtaaatgtg

SEQ ID NO: 99072 - DNA, 372 bp, Triticum aestivum
  unsure (1)..(372): unsure at all n locations
  Clone ID: PAT_TA_99072
cggcatcgagagatggatatttgaccagaggtttccgttggagacgattgtcgaggtcaccgagagtacacttgtggaacatggtgacctgaaggttgtggccactattggtggatttgtgtacttctctaccatggaaactttccttgatggtcataatcctagttggttcatgtctctatgcatggagacaggggagctggccacgctctttcanaggagatttgacggccatccccatccctacatcatggcatggcctccttgcttnatagacaaccaggtgcacccncaacttgaaggtgcttgatggaattgtggncaaanacggnagtcatnaaaactnanaggagcccncattggggggttaaa

SEQ ID NO: 99073 - DNA, 174 bp, Triticum aestivum
  unsure (1)..(174): unsure at all n locations
  Clone ID: PAT_TA_99073
tctanggtttcctgctaaggttttattccttcctttccancnggggcgcaannatgggtnaaganaatgaaaggaacccctnaangtggttcaaccttcaccaaaggggttcgggattcaantcccccngtaggacngcattcntaagnaactcttccgtcccacaaaantcct

SEQ ID NO: 99074 - DNA, 402 bp, Triticum aestivum
  unsure (1)..(402): unsure at all n locations
  Clone ID: PAT_TA_99074
caagactgataccccccgtttgtcacgatgctgctagcttgtttcagtccagtatctcttcttgatagtcttgataacataattcagtccagtaactctaattaattaactgaatttatttgtttaattaaattacattgaaaccttttaattataattaaagaagggtttcagtttaattaaaactaattgaaaccttttcggttaatcctgttgtataatgtagtaatagagtaagtaatttagtgtagagtaagtaattaaagataggcttgctgttagtagtagagtaagtaattaangtcctattgtttactgtnagacttgctgtttaagcaaggcttgagtaatttagtgtaccgcatctttagtttcaactgaaatttttatcatgcnactgtn

SEQ ID NO: 99075 - DNA, 410 bp, Triticum aestivum
  unsure (1)..(410): unsure at all n locations
  Clone ID: PAT_TA_99075
gttggtcaggttaaacaggagacaccacttgatagcatgacaggtgcaattgtatgtgtcactttatcagacgatgatgattacatgatggctgaggaagctcccaccatttccagcagcgatcaggtccgtgatccagaggtagcagaacgacccatggctatggtacaacctgctagttcacaagctgatttggctccgcaggcggattcccggaggcatggaaccaagaaacaggcctcccacagcaaaagctctggaagcacttgccttggggctcattggaaagcgcaagggcgaacccaaaagccctggaanaagcangcctccccagcgnagctcgcaaatccangtaaaaaatcggttcataacacctaccggtaagcgaaaccgacaaattccagcatggn

SEQ ID NO: 99076 - DNA, 431 bp, Triticum aestivum
  unsure (1)..(431): unsure at all n locations
  Clone ID: PAT_TA_99076
tcacaactcacaagcaagcaaggaagaaaggttctcctcaggccgccaggatgagctcctcctcctcctccaagctcttccactccgcctgcaaggccgccaggtccttcctcgcctcctcccccgcctccgcctccgccccgcgcgccgcctcctccgtcctcgcagacgggaggaacgccgcgctcgccaccctcgccaanctcggccggaactccaccctccccgccgcatacgcccatcacaccaacgccgccgcctcctcncacggggtacgcatggattgccgccatccccgccgccgtgtttatgctccanggattagggaggtgcaattgcccgcccnaagattgggaaacgcaaccttcatcggccaatcaaaggccctgaacggggggtncaataanaaggggcctcaaatttnttgtatg

SEQ ID NO: 99077 - DNA, 392 bp, Triticum aestivum
  unsure (1)..(392): unsure at all n locations
  Clone ID: PAT_TA_99077
agcccgtgtcccgcgcgcaccttctcgaagcctcctccctccctcccccatggcggaccanctcaccgacgagcanatcgccgagttcaaggaggncttcagcctcttcnacaaagatggcgacggttgcatcaccaccaaggagctcggaaccgtgatncggtcccttgggcagaancccaccgaggcggngctgcnngacatgatnaaccangttganncggacggcaacggcaccatcnacttccccnagttcctgaacctnatggcgaggaagatgaatgaaaccnantcccanggagggagctcaaagggaggggtttccccnttgttttnncaaaggaccaanaaangggntttatcttcctgtnggggggnngctttcnccccac

SEQ ID NO: 99078 - DNA, 341 bp, Triticum aestivum
  unsure (1)..(341): unsure at all n locations
  Clone ID: PAT_TA_99078
catctcatcactagctgacattggtacaaagtgttaatttgccactagctagcttgattcctgagattttgagaacatggcggcacctcttctttgcttcgccgtcgtggccgcggcggctttggccggcgcgtcggggcaggagctcacggcggactactacgacnaggcgtgcccgcaggcgctgtcggccatcaagctcgtcgtcggcgcggccgtcgtgaaggaaccccggatgggggcgtcgctcgtccggctgcacttccacgactgcttcgtcaacggctgcgacgggctccattctgctgggacnacaccgaggacatngtcgggggaagaaa

SEQ ID NO: 99079 - DNA, 365 bp, Triticum aestivum
  unsure (1)..(365): unsure at all n locations
  Clone ID: PAT_TA_99079
ngcgagcctcacactctctgatcacagtangactagcttcagctagcctgcagcgtctgccactccgggcattttcttgcatcaaccacngcaatggccaccgctgatgtncataacccgacggccgcnctgacggaggaggcgcccgcggtggagacgcccgtcgccnccgaggaggttgctaatacanangaggtccccccnccggtggaggcccgaagtccangcgcctgcccccntcgaggttgntgcgaacaaagaggacgcaccggccgccgcccgagacnaagggagaccaagggagcccnaaccagcanctgcttgccngacccngnaggccgaaggcgccctaaaaaancaanccg

SEQ ID NO: 99080 - DNA, 376 bp, Triticum aestivum
  unsure (1)..(376): unsure at all n locations
  Clone ID: PAT_TA_99080
agccgacctctccagcancgtancgtaacgcccgcttccgccgttccgacccgccgccatganggagtgcatctcgatccacatcggccaggccggtatccaagtcgggaacgcgtgctgggagctctactgcctcgagcatggcattcagcctgatggacagatgcctggtgacaaaactgttgggggaggtgatgaatgctttnaacaccttcttcnagtgagaatggtgctgggaagcatgtcccccntgctgtctttgttgatcttnaccccacngtnattgaattangtgaagggactggcnacttantntnccagcctcctttcacccctgtaagcaaccttnatccaatntgctnaaggganggggatt

SEQ ID NO: 99081 - DNA, 426 bp, Triticum aestivum
  unsure (1)..(426): unsure at all n locations
  Clone ID: PAT_TA_99081
gtttctttggtcgagagattaaagcagatgggtgcacttgttgccggcggtctcgtcccactggtagggttccaagcaagatgctcaagaattttctcatgaaagtggatgaataacgtcatggccaggatcttcaaaggaccaatgttgcatagcctttacccactctgcactgccgtaacatttcaagtagcgactactcctggtacatcntgtgttgatcacgagcaacaccaanagagatgtatggactatttgcatgcaagattacctccaggtgattgattatgaatgtggtatggtcctttttccagcccatgggcaagatggtntangtacatactgatgaagaaggatagatcattttaaggaatgaatggttacnanttttagaatgggncgnataaccaaaacgtngtttnattn

SEQ ID NO: 99082 - DNA, 205 bp, Triticum aestivum
  unsure (1)..(205): unsure at all n locations
  Clone ID: PAT_TA_99082
aatgggacatgctgtgagaaatactgtgggtgtccgaaaatgtgcaagaatcgttttcgaggttgtcattgtgcaaagagccagtgtcgcagtcgccagtgtccatgctttgctgctgacagggaatgtgatcctgacgtgtgcagaaactgttgggtagggtgtggagatggttcattngganttccccanccccctgnggcga

SEQ ID NO: 99083 - DNA, 423 bp, Triticum aestivum
  unsure (1)..(423): unsure at all n locations
  Clone ID: PAT_TA_99083
gttacacgaccatctatctactgaccggcgccaagagaagatggcgaccaagctcgcagcgatcatcgtcttggccgcgttcctcgccgggccggcggcgtgcgagggcgccagcatttgcttcaacggttggatgaggttacccaccttcaacccgcggctctgtgctcncggccccagggtgaaccgctggcagcggggggcttctcccgcggggttaggactcagctacggctactacgacaacaggaggtcgacgtcctactgccccagggcggaagggatcttgaggggtgcccgttgagggaggcccgtngccggccaaccctgggtcatttggggccgggcctcaatcccgtctcttcttttcancgaacttggcttccnttncggggggtggccgattgcttttccgtcccctcn

SEQ ID NO: 99084 - DNA, 183 bp, Triticum aestivum
  unsure (1)..(183): unsure at all n locations
  Clone ID: PAT_TA_99084
cacagtcacttcactgctcaagtagctggcaanagctttnaacgcgttgcaaccttgcatcccggtcgatcgatcgatggcgtccaaagtcgagctggtggtggaggtgaantcccccgcggagaaactgtggacggcgatgcncgagtcnacngagctgttccccaanatcttccccnagca

SEQ ID NO: 99085 - DNA, 322 bp, Triticum aestivum
  unsure (1)..(322): unsure at all n locations
  Clone ID: PAT_TA_99085
ngagctcccaangtcncgccgcggntcctancccgcctcncccaangtatcccgccggtcncttgcctcgccccgccgnccgccgccgcaggttnacatggggttcntgtccttcnccgggagggtcctcttcgcctccgtcttcctccctctccggcctacnancgagttcactgaatttggaaccttgatngggcgngggccaagctgccaaaagaaatctttgncgccctaaacttttnaacaatttttcaanccaaanaaaaatatttttctcgttaanaacctcnggacgattngttgggggttcccttcatncgct

SEQ ID NO: 99086 - DNA, 383 bp, Triticum aestivum
  unsure (1)..(383): unsure at all n locations
  Clone ID: PAT_TA_99086
ctaacgccgccgctctccaangtcccaanggtccanatttccctccttnncagctgcctcggtggcctttggngcncacgaaatggnggaagaaaccccgacaccagttgttgccccaatagangcacctaccctggttcttggtgagccaatggncttgatgactgccctacagcttgtnatnaaaaantcaantgctcatgatggccttntgaaagggctcccgttgaggctgccaagtncaantganaancatgcngctcagcnttntntgctggctgacgattgttaccaancctgattacgttaancncgttaaagcactatnccctgagcacaatnttcncctgggttantggtgccaacgtgctaanaacctcctt

SEQ ID NO: 99087 - DNA, 418 bp, Triticum aestivum
  unsure (1)..(418): unsure at all n locations
  Clone ID: PAT_TA_99087
cctcccgcgtgccaagccaccgaccaacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacnccgccaagatggccggcttcgccctcgccacctctgccctccttcgtctccggcgcgancgcggagggggcgcccaanaggctgaccttcgacgagatncanagcaagacctacaatgggaggtgaanggtanccggnaaccgcgaaatcnaatgncccgaanatccaacngngggcgtcgaantcctctcccccttcaanngggcnggggnaan

SEQ ID NO: 99088 - DNA, 408 bp, Triticum aestivum
  unsure (1)..(408): unsure at all n locations
  Clone ID: PAT_TA_99088
agttgctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaaagaacctccataaccaggcgcgatnccagagcgatngccaaagcgcttgcaactgcctcaaggggatngctcgtggcatccacaatctcaaccaggacaacgccccgcancatcccccccaaagtgcgggtgtnaancctcccaataacaccaatcaagttct

SEQ ID NO: 99089 - DNA, 412 bp, Triticum aestivum
  unsure (1)..(412): unsure at all n locations
  Clone ID: PAT_TA_99089
gagcaaccgtcgtcggatncccaaanaaacaccaaagcccgagccatgtngtcggngtccctcggngccaggctcctccgccgcgccgcctcttcgtngcgggtctccaccctatcccgacgctgngcccactcctccgcgatgtnncgcgcgcccgtttntcttgcccgttttancccgccgccgccgccgccgccgcctccccttcaaggagaaaatgaccgccgcttcctctcntnggcaatctccggngtcttnctccaaaatttnnccngacganaanctgagggggggtcatccacnctgaaatanaagtgcggtcctccaanccggaggagggngtncccccaccaaaatttttttacccnaaanaanttccctttnaganaaaatgatnaccctgngtgagtca

SEQ ID NO: 99090 - DNA, 168 bp, Triticum aestivum
  unsure (1)..(168): unsure at all n locations
  Clone ID: PAT_TA_99090
ggcacgggcgagctgaatggcgatgaggcggcggctgtggcgcatgggcggcagggtgctcaactgcttcgccgcgtgcgtgggcgccggggccggcgccggctgcggctgcctttgcgcgcgggtgctgggggatgaggtggatanactctatgttnttcttttcct

SEQ ID NO: 99091 - DNA, 331 bp, Triticum aestivum
  unsure (1)..(331): unsure at all n locations
  Clone ID: PAT_TA_99091
agcacttcccgccccgggcctccgccgggagccgcggccccgcgccgccctaccaccaccaccaccaccaccagcagcagcagcatgtcgcgccgcccgactaccagcagcagcatgtcgcgccgcccgactgccagcaccagcatgccgcgccgcacgggncaccccgacccgctggcctccgtctggatccgccgcctccacctcgctccccccaacccgccgccgccccgcgccagcctcgcgcccccgctgtnccacgaccacgangccgtctccgcccgnagcgccgggttcggccccttccgctggagcccgcgccccgccggcg

SEQ ID NO: 99092 - DNA, 194 bp, Triticum aestivum
  unsure (1)..(194): unsure at all n locations
  Clone ID: PAT_TA_99092
agccgccaagcaaagcgcccgcacacggcacgcggcggcgatggcggacgacntngccccgtgcaccgcatncggctacctcgacccctcctactgggacgggcggttcgggaatgatgttccactnattttggntnaangatttccccnatttctnttantttcntttcncgctngtttntcattcnctcttt

SEQ ID NO: 99093 - DNA, 257 bp, Triticum aestivum
  unsure (1)..(257): unsure at all n locations
  Clone ID: PAT_TA_99093
cgtccccaatcaatcaatcatcatcaacaacctaaacctccgctccgtctgcgcctccgcgcaaaaccctancggatncgtcgattgacctcccggagaagcggagangcgggagggggtccnaaaattcaaatnttcctttaanacgctgaccggcaagancatcacgctcgaggtnnagaagcaagcggacaaccanctacaatgtncnaaggccncaaatttnatggatnaanggagtggnatntcccccccaa

SEQ ID NO: 99094 - DNA, 266 bp, Triticum aestivum
  unsure (1)..(266): unsure at all n locations
  Clone ID: PAT_TA_99094
ctccagaggaaactctgacccccgggtcaggcggtggcggcgcgctaacgtcgtaaccttcttggaggcgccgccttggagctctcggttcgtcatatgcggcttcatctcttcgcggtggcgtgtttccggtggagatccctgattgctcttgtagtgttaggggtggttttgcctgcccacaacnccnatgtatccccgccctgggtgtgtgcgtntgttgtcagtgagggtgtgncctgtactttggngttntnggttgaatt

SEQ ID NO: 99095 - DNA, 208 bp, Triticum aestivum
  unsure (1)..(208): unsure at all n locations
  Clone ID: PAT_TA_99095
agcttaaccacaccgccgacactcatctgatcacccactagctagctagcagcttaaggaacttccagctagcgatcgatggctcgtctcaacagcaaggctgtggtgtccgccgtggtcctggcggnggnggtgctaatnattgccggcaagggaggnnacagcactntcttgccggcatgtgggacnccaatctccgcgcccgttc

SEQ ID NO: 99096 - DNA, 472 bp, Triticum aestivum
  unsure (1)..(472): unsure at all n locations
  Clone ID: PAT_TA_99096
ngtctgttgagatgcaccatgagtctctcctggaggcgcttcctggtgacaacgttggcttcaacgtcaagaacgttgctgtgaaggatctgaancgtgggtttgttgcatccaactccaaggatgaccctgccaaggaggcggccaacttcacctcccaggtcatcatcatgaaccaccctgggtcagatnggcaatggntacgccccantgctggactgccacacctcccacattgctgtcaagtttgctgagccggtgaccaagatntacaagngattntggtaaaagagctggaggcgcctgccccaaanttcctgaaanaaanggtggacgctgggtatcntccaanatnaantccccaccaaagcccaatnggggtgtgggnngnaactttttnccaacctaacaccccccccctttngggncngcccntctcctggtngcggnttnaaaaatgnanaaaaaaaaa

SEQ ID NO: 99097 - DNA, 254 bp, Triticum aestivum
  unsure (1)..(254): unsure at all n locations
  Clone ID: PAT_TA_99097
gccccgtggtccccaaccgccgtccgccgccgcagaggggagaggcggccgcngcccncctacacancaccgtatgccccgtcncccccgcgcacctcnncgggtttgatnccatggtgtccaaagangatcctcaatgagctnaaggaccttcnggaacngnctcccctcaccctcatncangtcaggtcctgttaagtnnatggacnctttttctactgtgncacngcaattagccattgggcacccctctt

SEQ ID NO: 99098 - DNA, 453 bp, Triticum aestivum
  unsure (1)..(453): unsure at all n locations
  Clone ID: PAT_TA_99098
agcggcggcggcgcgtaaaacaggagaaagagcangcggcggcggtgcccnaagagganaagcacggcgacctancccgagctcgcaaccatggctaggggtttgaagaancatctgaagaggctcaatgccccntctcactggatgcttgacaagcttggtggagcttttgcccccaagccatcatctggtcctcacaanggcagggagtgcctgcctctgatcctcatcctgaggaacagactgaaatatgctctcacctancgttaagtgcaaatctatccttatncaagcntnatatcatngttgaatnggaaaggtccncactgacaaagaccctaccctgcctgggtttatgnggcnatcantttncanttccccaangactgggnngngaactacaaggcnntcttttttttgacaacccaaaagggttcgcctttncgncctttt

SEQ ID NO: 99099 - DNA, 446 bp, Triticum aestivum
  unsure (1)..(446): unsure at all n locations
  Clone ID: PAT_TA_99099
agccgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctatgatgttggcatgaanaagaagggtgtcgatganttctctcactgtgttcaccttgtctcatgggagaaggagaatgtgtcnagtgaggctcttgaggctgcccgtattgcttgcaacaagtacatgaccaaagcangcaggaaaggatgccttccncctcacggtcagggttcacccgttccatgtgctccgtatcaacaagatgcttttcgttgcncccggggctgataggctccangacngggtnattgaggggtgcttttggngaaacccgcacggaagtncnggtgccccnttgt

SEQ ID NO: 99100 - DNA, 179 bp, Triticum aestivum
  unsure (1)..(179): unsure at all n locations
  Clone ID: PAT_TA_99100
gtggggacaacaacaaaggnggnaacaccaaaaaaaaanctgttgacaaancgcntcaaaacattgccaacaaacgaagatnctaccgangnatgaagttcttggnggngtaaanccttgtctgccacaatgataccaagcagganggntttcaangaaacaacnttttttgnttgcca

SEQ ID NO: 99101 - DNA, 237 bp, Triticum aestivum
  unsure (1)..(237): unsure at all n locations
  Clone ID: PAT_TA_99101
agccacctcccagcgaaacaccacgcgcaccccacaatcccacgggtctccccggcgaagtancagcggcatccatggcccccaaggnggagaaaaanccggtggcgganaaggccgagaanacnatngcagccancaagaccanggccgangaagcggncgccggcgttcaaggagggcggtcgagaatanngggaagaagnngtccaanatgcgcgtgggagacttannagattt

SEQ ID NO: 99102 - DNA, 441 bp, Triticum aestivum
  unsure (1)..(441): unsure at all n locations
  Clone ID: PAT_TA_99102
gagttgctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccanaagcgatcgccaaaagcgctttgcaactgcctcaaggggatcnctcgtggnatccacaatcttaacgaggacaacgcccgcagcnaccccccccaaattgcggntgttnaaccctccccnatacaccatnaagttctncaaanattcgnactngcnagncaaagggg

SEQ ID NO: 99103 - DNA, 395 bp, Triticum aestivum
  unsure (1)..(395): unsure at all n locations
  Clone ID: PAT_TA_99103
gggagttcggcctgcactccctcgggctccggggcggccatgcanggacntcggcgccgatgctctggccaactgcgttcttggacaacggcaatgtngacacntggaangtgtccggcggcggggcggctgccatgttggcnccggagttctcttctgcnccnacggtagcacangtcngcggnaatggcatgtttcatggcggggcccnnataatgggacaactgtgagantggtcantantttgtgcncgtacgtgatggntcatgcatgtgtctgcnggattgtttgtgtaggtgttaatttgttgtgcaagtgcanangcncctgtcnctgtcntgttcacntagtacntaatggtacaaaagganaangccccttncnanttttaaaat

SEQ ID NO: 99104 - DNA, 327 bp, Triticum aestivum
  unsure (1)..(327): unsure at all n locations
  Clone ID: PAT_TA_99104
cgggagcgccggcgaggtcanggacgtccacatcagcgagaccaccaagaccctcctcaagagcgacgacctctacgactacatgctnaatacgatggtgtatncgcgggagaacgagttnatgcncgagctccggcaaatcaccaagcgagcacgtcttcnggttcatgtcctccccnccngatgangggctgctgctgtctcttntgctcaaagtgatnggcgccaaaaggaccatccaagtggggggnntacaccggggtgctccctttctcccacngccgnctcgccaatccctgggtcgaaagggaagggnttttttttccc

SEQ ID NO: 99105 - DNA, 289 bp, Triticum aestivum
  unsure (1)..(289): unsure at all n locations
  Clone ID: PAT_TA_99105
agccctagccgtcgcctcacagctcgccgccgacgcatcgagttcttcctccancgccgcaaccatggcgacccagatcagcaatgaagaagaanntttgtgagcgatggcgttttctaccccgaagctgaacnagatgcngacccgggagcttgccgaggacggtctactccggcgtttgaggtacccgttgangccgcatggcgcacnngaggattaattcatcaaggggccancncgggacgcangaaacgtgncttgggtnangaaggggccccccngggattca

SEQ ID NO: 99106 - DNA, 407 bp, Triticum aestivum
  unsure (1)..(407): unsure at all n locations
  Clone ID: PAT_TA_99106
natggcatcttccaanancagtcttgcaatgttcncnctggccataatcatggccgtggtggccggcgtctcngcgcaaaacaccccncangacttcgtcaacctgcacaaccgccgcccgcgcctcggacngcgtcggcgcggtgacatgggacaacancgtggccaggttcncgccaggactactcnaacaaagcgcgccgccgactgccggnctgcagcactccgcgcggggccgtttcggnganaacatccttctggggggtttnccgtggcaantccctgggacgtgcccggccnaactncccgntngaaanttccttgggggttnggaccganagaaaagccggggaannttantcacccttnctaaacaaccaaancnacnctttggnggttctgcccgg

SEQ ID NO: 99107 - DNA, 447 bp, Triticum aestivum
  unsure (1)..(447): unsure at all n locations
  Clone ID: PAT_TA_99107
accagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaanatgttccccgacgtggaggccaccgccggcgccgccgccatggtcatgcccaccgcctcccacaaggggagctccggcgggttcgagacggccggggagaccggcggctgcgactgcaccacctgcaangtgcggcaccgcgtgcggctgctcctgctgcagctgcaactgaagcccggcgcccangaagccggccggcanaggccnatcacgaagggatgtagngaggacnaaagcaangcaangccaccaatnatccaaccaagttncacccaaccaacccaagnccgtttttct

SEQ ID NO: 99108 - DNA, 284 bp, Triticum aestivum
  unsure (1)..(284): unsure at all n locations
  Clone ID: PAT_TA_99108
tcctggagcggttggaggcggccttcggggcgccggtgctggaggngtacgccatgacggaggcctcccacatgatgacctccaacccgctgccgcaggacggggcgcgcaagccggggtccttggggcgcgcngcggggtcncctggaggtggcggtgctggaccaagccggcatccanggtccccgccggcgtagcgcggggaggtgtgnntccccgggccnaaccttacggncgggtataatcacntgccgatcccggttgctaaanaggcggcgnttcct

SEQ ID NO: 99109 - DNA, 501 bp, Triticum aestivum
  unsure (1)..(501): unsure at all n locations
  Clone ID: PAT_TA_99109
gctatatatattgcanatggcaatggtgctcttanagaccttgagggctctacncgcctgnctcttttcatgcaaaggaagaccgtgacccgattatgacagtggcgatcaataaaactgcncaaaggcatatcaattgtgatacctattncangttatggataanggacaangangtttggggtgacgacgcanatgaattcaatccccctganattttaanaatgggattcaccggggggcagcaaanngttcccacaactggnccctgctagccttttcaaattcnggttccaaaggtctttgcaatcnggttaancaaacttttggctnttgttncganangccganangttcgtactantttggaccccnggaatgncccccaaagaanagtttcttcaatttccanccccttttcccncgnganttactcgtgnccatnccaccccccnntccgaataatnatnntacctccnctngnaccccatannggtttgg

SEQ ID NO: 99110 - DNA, 333 bp, Triticum aestivum
  unsure (1)..(333): unsure at all n locations
  Clone ID: PAT_TA_99110
ctactccaccccagccaaacttctctctcgccttcgaagaancatcagccgccgccgtagcatccatggcacccaaggctgctgagaagaagcctgtggagaagacccccgcgggcaanaagcccaangcggagaagaaggtgncggcgtccaangagggcggcgacaagaaggggaanaanaatgccaagaanagcntcgagacgtacaagatntacatcttcaaggtnctcaatcaggtgcaccncggtcatcgncatctcctccaagggncatgtccatcatttanctccntcaccancgacatcttctanaatcttncccggccantct

SEQ ID NO: 99111 - DNA, 442 bp, Triticum aestivum
  unsure (1)..(442): unsure at all n locations
  Clone ID: PAT_TA_99111
gatcacccatagctagctagctagcagcttaaggaactaagcttgcagctaccgatcgatggctcgtctcaacancaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcnatcaccaangagtgctgctccggcgtgcacgggcttaatngcatggcccccancaancttcggnncgtaacgataactttnanggttgcctcaanatcnncccccaccancattcaannttccatcaantcatngcncaatngtctccnngcctttccncctgcaangntnccgggctccagtcgtgtgccctttcncccacnatncactggtcnacncnaaccg

SEQ ID NO: 99112 - DNA, 280 bp, Triticum aestivum
  unsure (1)..(280): unsure at all n locations
  Clone ID: PAT_TA_99112
gggtgccagctcaaaacatgttctatgtgccggcaganaaacgtgagcanttcnggtacttgacggactacgggatgttccggttctgcgtanccaacacngagctggactggcngccaggcacccnagcantacaagttcatccagcactgcttgttantncgtggaccggcanaagcaagccgtnggtcaatcttcctcncccaccgcgtccctggggntaatccttcggccaccttcctactngngcccgaaagggacgancggnggaacccccagg

SEQ ID NO: 99113 - DNA, 491 bp, Triticum aestivum
  unsure (1)..(491): unsure at all n locations
  Clone ID: PAT_TA_99113
cgaacaaccgccgcgaaatcccaaatcancaaccaaatcccctcctcccgcgtcccgacgaagcaccagccgccggacatggacgcctcagccaccggagccggagcgaattccaagaagggtgcggcggggcgcaaggccggcggccccaggaagaagtcgngtgacgcggtccgtcaaggccgggctccagttncccgttcggccgcattgggcgctaccctcaagaacggccgctaccgcgaaagcgcctcggcnacggggcgcccccgtctaactcgcccgccgtcctcnaagttncctggccgcccgaagctgcctggagcctcgccgggaaacggccgnccaaagggacaaacaaagnaagttctcgcaatcgtttccccagtgtaatctgcctgctncngccgttgatnggaancgaaccaaggnagccttccgggaagggcctgnctggcccgggtgtttacccaatcnncgcaacgggcggg

SEQ ID NO: 99114 - DNA, 455 bp, Triticum aestivum
  unsure (1)..(455): unsure at all n locations
  Clone ID: PAT_TA_99114
cccggcggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacanactgaaatatgctctcacctaccntgaantgcaatctatccttatgcagngtcatatcnatggttgatgggaaaagggtccngcactgacaagacctaccctgctgggttcatnggacaatcaatttccatttcccaaacgacctgggtggaggaanctaacanngcttcntttaattgaacacncaaaaggggncgnctttcccncccnttt

SEQ ID NO: 99115 - DNA, 470 bp, Triticum aestivum
  unsure (1)..(470): unsure at all n locations
  Clone ID: PAT_TA_99115
aacccacccacccttctctccctcccgaagcagcgatggcccccaaggcggagaagaagccggcggcgaagaagcccgcggaggaggagcccgcggcggagaaggccgagaaggccccggcggcgaagaagcccaaggccgagaagcggctgccagccggcaagaccgcctccaaggagggcggcganaataagggcaagaagaagagcaagaagagcgtcgagacctacaaaatctacatcttcaaggtgctgaaagcaggtgcaccccgacatnggcatttcctccaaggccatgtccatcaatnaactnccttcattaaacgacatctttcgaagaaagctncgcccnggggaagggctcccaaanctcgccccgcctnncaaacaaaagaaagccccaacaattnaacccttnccccgggggaagaattcnanaacccttcccgttccggccctccgttccttccn

SEQ ID NO: 99116 - DNA, 151 bp, Triticum aestivum
  unsure (1)..(151): unsure at all n locations
  Clone ID: PAT_TA_99116
cttcttctttcttgcgagggagagagggtancnagcaaccagggagctangngtcnatggcgaccatanccacnatgancatgctcaagcccgccaagatcacngncangtcggcgccttcgtnntnaccgtcgtccaacancaaggtggg

SEQ ID NO: 99117 - DNA, 333 bp, Triticum aestivum
  unsure (1)..(333): unsure at all n locations
  Clone ID: PAT_TA_99117
taactnattngctctcctcgctctccttctcccncggcaccaatgancatcaangaggcanngcgcaccccaaaagntaagctctgctcaatcaanttttntccaaantcaccntacacacagagtaccaantattncatggncgccatcagtggcctgttccttcttcttcgaccgccgaagctgcacggtgagccccnntatnccgtcgatggnacgcgttgcgcgctntggtnccaaagccngcnggggccgcnacangccgaacgttcttcatgntacaaangggggacaangggcctacctgccaaggcgagggagtngcncgcccac

SEQ ID NO: 99118 - DNA, 434 bp, Triticum aestivum
  unsure (1)..(434): unsure at all n locations
  Clone ID: PAT_TA_99118
gtggtggctgcccccaccaagatgggcgtcaaggcattgtttggtagcagtggtgcggtggctgccccttccaaggtgggcagcgtantagcaccgttagttggtaagtagtgcagttgcttctggtgctgctggggtggtgagacaaagcagtgctgctcttggtggtgctgctggggtggtcatacagagcattgccgcncttggtgctgctgcaggggcgagcaanagaactacctggctgtcnaggtgnggtnaactcctgcctcggattgatnccaaatacccgttcttgctgcctntnactgtaccanttgcccccataantccctccntgcnnggtancggancgtncantccctttcnaaaaatcacttntnatccaacaatnttcatntttggttncctggattcctccgccgcaaagagggttt

SEQ ID NO: 99119 - DNA, 238 bp, Triticum aestivum
  unsure (1)..(238): unsure at all n locations
  Clone ID: PAT_TA_99119
cttcgcctctccgtcgccatggctctctcatccctcttcntctccnctccncctccccatcccgaagccgccatntanctccaaatcaaaccgcttcctccctatccgggcctctgccgccgccgccaccgnctccccatcttttgacctgcnccgctacctggacntcggctgatctcggaggtcnanggcgagtctcgatggccncgatgccaatctcgcccgtccgggagaatat

SEQ ID NO: 99120 - DNA, 471 bp, Triticum aestivum
  unsure (1)..(471): unsure at all n locations
  Clone ID: PAT_TA_99120
ccaccctatcacgccgaacaaacgtcgccatgttcgccgcccgctccttcgcccgcgccgcgcctcgtcaggcactcgcccgcgcccctgcccgcgccggccgccgcaactacagctccgagagccccaagcaatttgccggaaccgaggacaacgagttcaaccgcgagcgtgcccacattgctcagcacgccgctgagtctggcgagttctggcgcaagctgtcgctctacgttgccgtcccctgcatcatcgtcgccagtgtcaacgccaaggtcaggtgggatgctcattgggagcacgtancccacgaggaacacgagaacccccgctccgaagaggcccgaagtacncataccaagaacatccgtaccaagaactacttctgggggaggatggtgacaagancctcttctggaacgataaagtcaactaccacaagaagggntgagtaagctnttgcacagtact

SEQ ID NO: 99121 - DNA, 322 bp, Triticum aestivum
  unsure (1)..(322): unsure at all n locations
  Clone ID: PAT_TA_99121
ctaaagcaccgcctttttctgaagctgctanaagctgttctcaaaactggaaaccgtttgaatgacgggaccttccgtggtggtgctaacgcgttcaaacttgacacccttctgaagttgtcagatgtcaagggtgccgatggaaagactacactgcttcactttgttgtccaggagattattcgatctgaaggtgtccgcaaagcaaggttggccatggaaagtgaaaggactcaaccttcaggagatgattcnaacggatctgttcaagaagatggcgangtactactccangctcgggcctaaagatttgtatcagggc

SEQ ID NO: 99122 - DNA, 424 bp, Triticum aestivum
  unsure (1)..(424): unsure at all n locations
  Clone ID: PAT_TA_99122
cactcatctgatcacccactanctagccagctagcagcttaaggaactaagcttgcagctagcgatccatggctcgtctcaacancaaggctgtggcggccgccgtggtcctggcggcggtggtgctgatgatggccggcagggaggcctcngcggcgctgtcgtgcgggcaggtggactccaagctcgcgccgtgcgtggcgtacgtgacggggagggcgtccnccatnancaaggagtgctgctccggcgtgcatgggctgaacggcctggcccgcaacagcccggnccgcaanataacgtgcaggtgccttcaatgaaccttcnccaccaacatcaagtccatcaacaanggncaagggtctccngcgtgcccgngcaaantncgtgcgtcanncgttncccctttccncantcaacatgt

SEQ ID NO: 99123 - DNA, 314 bp, Triticum aestivum
  unsure (1)..(314): unsure at all n locations
  Clone ID: PAT_TA_99123
agtntcaacaaagcattaccactaacacctctcaacaatctgctctttgggnttcacaagcttccttcgacaccttcggtccaagaaactctccgcgggacaatgggcgggcggggaaagcgcaancatcggcctcggcgaatgggactaactcgccggtccaagccaaagggcgggcgaatganggtggggtggtccnangaaccctgggttgtaaanggccgggngaacannggattcatncctncattccaaccgtccctaaccccaaaggggaggcaagaaccgcccaagnccnncaaagggggggcttc

SEQ ID NO: 99124 - DNA, 405 bp, Triticum aestivum
  unsure (1)..(405): unsure at all n locations
  Clone ID: PAT_TA_99124
gttatttcattttgcgggtttgtacgaactanttattagctttnagtaactanaggagtatccccctctccaanaaataatccaggttancttaaggataccaatatntgctttgaggcatcangctgtgtgttatttagtcacaacccaactgctgtagtgagtagtgacatgatcttcatgnttttangtcatgtgcctaacccttcattgcaaacataaatattctcanggtccaagaaactgtncaagaacttgttacatattcagttttcaagttgntcaacgctattncctgaattcangggccaaacctttaagtttacccagccangtttaatcncttggangaaatancaggctggcttcagcttttactgantagcccattctgnttngctggca

SEQ ID NO: 99125 - DNA, 428 bp, Triticum aestivum
  unsure (1)..(428): unsure at all n locations
  Clone ID: PAT_TA_99125
agccaccaccggcggcggngccgcgcaactcnaggaaggaggcgaacatggtgaagttcttgaagcccggcaaggcggtgattctgctgcanggcangtacgccgggaanaaggcggtgatnctgcgcgtgttcgaggagggcacccccgaccgcccctacgggcactgcctcgtcgccggcctggccaagtacccgaagaaggtgatccgcaaggactctgccaagaatacngccaagaagtcccccntcaangtgttcctcaagctcgtcaacttcacccaacctcatgcccacccgctacaacctccgacgtcgacctcaaaggaggtgggcttctgngcgcgcccgactcccctcancttccaangacaatgaatgtgggngcaagccaatngccgncaaangccaagctctngnaataggttt

SEQ ID NO: 99126 - DNA, 272 bp, Triticum aestivum
  unsure (1)..(272): unsure at all n locations
  Clone ID: PAT_TA_99126
tttgtgttttgtcgtgaggtctaggatgaacaagtcgggctcattggagatagttatactatgatagctagttattttttttgtagttgtgttacctgatgtgaactttttattattgtaaacctgatgttaaccatggttcattgtaataatgtgccaagtttggctctgtttgattgtattcatgatgtgaaccatgtttttccggattagatatgctttgacgcanaaaaaanaaaaaaannaaaaaaaaaaaaaaaaaaaaaaaaaaa

SEQ ID NO: 99127 - DNA, 396 bp, Triticum aestivum
  unsure (1)..(396): unsure at all n locations
  Clone ID: PAT_TA_99127
gccgtcgccccgccnaagaagccggctgccaccgggagatntccagacctctcnctccgtcgcccgcccggagatctcnccggnctctccctccgccaatcatgggtaaaacacgtggtatggngaagcccnggcgcaagctcaagacccatcgcaggaacccagaggtgggctgacaaggcatacaataagagccaacttgggcaaatgagtggaaagaaacccctttgctggantcgttctcacgccnaagggcattgttcctggganganagattggtaatttgagggnnaangcaatcctaactcctggcccattccgntnnagttgttgcctcngtggtcccaagcttggttgaacctaaacntggtganacganngtattcttctggccc

SEQ ID NO: 99128 - DNA, 488 bp, Triticum aestivum
  unsure (1)..(488): unsure at all n locations
  Clone ID: PAT_TA_99128
cccggcggcggcgcgtataacaagagaaagagcangcggcggcggtgcccgaagagganaaacacggcgacctagcccgagctcgcaaccatggctaggggtttgnanaancatctnaagaggctcaatgccccntctcactggatgcttgacaancttggtggagctttttcccccaanccatcatctggtcctcacaaagccagggaagtgcctgcctctgatcctnatcntnaggaacagactgaaatatgctctcacctaccgtgaagtgcaatcctatccttattcagcgtcatancatggttgantggaaangtccgcnctgacaancaccctacccngctgggttcattngacantcatttccattcccaagactggtgngaactacatgcttctttnttacanncaaaggngttngctttccgcccttcantcctgttnagnggaatganggatggctaactttanncctctgccagngt

SEQ ID NO: 99129 - DNA, 200 bp, Triticum aestivum
  unsure (1)..(200): unsure at all n locations
  Clone ID: PAT_TA_99129
gtttccaccgggtanaggtggtaatttccgangtgaaggcatgagaggccgtggtanttaccctgccagggagaggctatngaangggcnaagtacancaantatcgatttgattttngcgtgcacangcggtggtanangctgcccacgtccntggcacgtcatcttncgcnaccatnccgngtctatcanctcnggca

SEQ ID NO: 99130 - DNA, 411 bp, Triticum aestivum
  unsure (1)..(411): unsure at all n locations
  Clone ID: PAT_TA_99130
ctcctcctcctcctcctccgggagcananagcancgccggcaccnaggaggagtcgcggtggctcgcgggcctctccgagcccgagctcgatttgctcatcagcctnaagatgctggccgtgaagcggggcggagacngtcggncgcccacacctcnccgacgccttcgatctgcgcacactgcgggccctcggtgtcnttttgctggaagatttcaaacaacngctaagagaagaaacctcactcgatgcaaccggncttgatagacttgcgctatcnanggatnctgctacggnngctaacgtcggtagtactagcantnattccgaagtgttttagggcggcgcaaccaaaanatttatcaangcaatnaaanctcaagccgggnnccaatanggaaancgaanagct

SEQ ID NO: 99131 - DNA, 468 bp, Triticum aestivum
  unsure (1)..(468): unsure at all n locations
  Clone ID: PAT_TA_99131
ctggaaccatggatggattcgctggatgatgatcggaccaagcgcatgccgcttgaggaggtagcaanatattgacattggctatgatgcacctcctccatcgtttactgctggattggagctgcagaagcggaggagagcacggattgaagatgcnaagtgtcgaatcgctgcaattangaaggctcctgctgcaggcactgcaaatgcaattganttcaccggctgttcatggaaatgaanatgcttgtccaccacaaaanaatatcatgaagaagctgggtccaanagagacganatggcanggatcatcatatcntgtatggagatcatcnagcggagatgttagacgcccctgactctganaagaagaaacnttnaacagaccccatgtggctggtattgctcgngggaanattgcgtttcnccaaccccnttttatttacctcnggtgcnnaatgctngccc

SEQ ID NO: 99132 - DNA, 395 bp, Triticum aestivum
  unsure (1)..(395): unsure at all n locations
  Clone ID: PAT_TA_99132
acttacncaacaaatgggngagcacccagagcaanacaagcgttatgaaccaatttcatccctggtncacngcctctgccaaggggcctggggttggtacaangtggttgcggngcttcaggcatgcggggcaccntgtnacccgcggtcgacctngccgcgtccggngctcaaccgggngcgcatcgaacgangtgcaactccgtttcgaaggaagtaactcncaanccctcntgcttgaacgttagtggncccgccgngccaagtacggtngaccgggcgcancaaggctgaattctgggtcgngggcaacacnccaccgggcgggggcttcagctttgggcgcctaagccatnggatgaaggtttccccnggnaaacgttcnccctccnncc

SEQ ID NO: 99133 - DNA, 481 bp, Triticum aestivum
  unsure (1)..(481): unsure at all n locations
  Clone ID: PAT_TA_99133
cagcctcctcantcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccancgccggcgccgccgccatggtcatgcccaccgcctcccacaaggggagctccggcgggttcganacggccggggagaccggcggctgcgactgcaccacctgcaagtgcggcaccgcgtgcggctgctccttgctgcagctgcaactngagccggcgcccangaggccggccggcaagatgcgatcacgaggatganggaggacaagcaacgcaagcaccatcaccancangttnaccaccaagccancgtatcattcaccaagncgccgcattgctctncgcgggcgcncgtcgctngaataaaatant

SEQ ID NO: 99134 - DNA, 442 bp, Triticum aestivum
  unsure (1)..(442): unsure at all n locations
  Clone ID: PAT_TA_99134
gcncctaagaacnaattgggattcccccggggctggcaaagaaattccggcaaccaagcaaaganggcaanggccaaggggggcaaccctccctcaagccctcaaagcaaaccaaacggcnagtttctttccaacccgaataatttcccttcccctcncccgggcancccgcccggacgaatntggcaagccaatgggcaaatgggcttaacaaanatgggcgaaccgggagtggggaatgaaacaatcaangnggaagggagntgcaaagncgggtgggttcaacgtggagcaatggaaagttgggnaagaaaanggtncaacncgccntccgttgggtctacaangaatccnacnaagccgtgnaangccgcccccgattgcctgggttggcaacaaagggttggngctggncccccnnggngaagtggtgtatccctcc

SEQ ID NO: 99135 - DNA, 430 bp, Triticum aestivum
  unsure (1)..(430): unsure at all n locations
  Clone ID: PAT_TA_99135
ttnttgtgctattaataaaatcgatcaggccacgangacnagaggtgagatntcnacttgggaactcncacaagaagacgcccagacgagaggagaggatgctgctgaggagctcctccacgccattcctgcgctccttcctctcctccccttcgcccccttcctccctccagctccggngggccttctccgacgggcacctnccttcgctcaacccctcctcctccggnganaacgacagcaacagaaccaccggnctccacaccgagctctccttctccatctacaacaccttcagcaaagccaagctggagccccaccatgagcangagatggatgaggagcacgagcatacngcgnagccttntctgctngaggntggccggctgtttccntgttgaagggggnatgggcatnnntccgcctntcc

SEQ ID NO: 99136 - DNA, 477 bp, Triticum aestivum
  unsure (1)..(477): unsure at all n locations
  Clone ID: PAT_TA_99136
atnccggcggcggcgcgtancacaggagaaggagcaggcggcggtggtgcccgaagacgagaagcacggcgacctancccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggnaaggtccgcactgacaagacctaccctgctggtttcatggacatcatttccattcccaagactggttganaactacaangcttcctgtntgacaccaagggccgctttccgcctttcactctgtcangggattgaggatgctnagttcaangctcctgcantg

SEQ ID NO: 99137 - DNA, 467 bp, Triticum aestivum
  unsure (1)..(467): unsure at all n locations
  Clone ID: PAT_TA_99137
gcccactcataagctgttctacccaatcaacaccacatccacaccgagacacagcacaccgcaaacatgcagatcttcgtaaagaccctcaccggcaagaccatcacgctcgaagtcgagagctccgacactatcgacaatgtcaagagcaagatccaggacaaggagggcattcccccggaccaacagcgcttgatcttcgccggcaagcagcttgaggatggtcgcaccttgtccgactacaacatccagaaggaatcgaccctgcatctcgtcctccgccttcgtggaggtatgcagatcttcgtcaagaccctcaccggcaagaccatcacccttgaggttgagtcctccgacaccatcgacaacgtcaagtcgaagatccaagacaaggagggtatcccttcggatcaacaacgcctcatcttcgccggaaaagcaactcnaggattgcncaaccctgtccg

SEQ ID NO: 99138 - DNA, 479 bp, Triticum aestivum
  unsure (1)..(479): unsure at all n locations
  Clone ID: PAT_TA_99138
ctaccgagaagaagagagaaaaaaggttcgagtgcgttccagagtgaggagtgagaagagatggctccggtgaagctgtacggcgcgaccctgtcgtggaacgtcaccaggtgcgtggcggcgctggaggaggccggcgtcgagtangagatcgtacccatcaacttcggcaccggcgagcacaatagccccgaccacctcgccaggaaccccttcggccagggtgccagctttgcaggatggtgacttatacgtcttcgaatcacntgctatttgcaagtacgcgtgccgcaagaacaagccaaaactgttgaggaggggcgacatcaaggatgtcagcaatnggtggatgtntggctccaaggtggaggnncatcangtacaactngcccnccnctgangccccatttcctcctcggantncccttaatccaatcccaatgcnttgggggggagccntcntatccnnaaangtttat

SEQ ID NO: 99139 - DNA, 170 bp, Triticum aestivum
  unsure (1)..(170): unsure at all n locations
  Clone ID: PAT_TA_99139
ccaaatcgagccgagccaagccgccgcctgagctgagaggcaggaatggggtggaaggccgcggagaagctcatcangcactggaagatcctccncngcgacaacntgntgattataangggcaaggacaanggggagagcnggcnnatcaatcaggtcatccggtcgca

SEQ ID NO: 99140 - DNA, 499 bp, Triticum aestivum
  unsure (1)..(499): unsure at all n locations
  Clone ID: PAT_TA_99140
gtgcagcaccaccttgatgtcgccaccgcgccgctcaatcaaagcgccatctggcgtaatgatgctctgaccatggtgttgtggttgcacggcgtggtcaccgaanaactcatggacgtggtggcgtccccggacagctccgcctacaacatctagacgcagctccacctcctcttcatggacaaccagccggggcgcgccgtcgtcctcggcacggagttccggaacttggtccagggcgaagctctccatcgccgaatacagccgggggctaaagaccctggccgacgcactcgagcatgtcngcgaagcacatctccgattcaggnccctgacgctgcagcctcattcncnggcctgaaacccgcangttccaagatcatggngattgcttcttcccaangcnaatccgcgcttncccccnccttnnttgcaanccgcggttcctcgncctcctcaatngggagggnagaatttcccgncgcnacgaagaaggggg

SEQ ID NO: 99141 - DNA, 371 bp, Triticum aestivum
  unsure (1)..(371): unsure at all n locations
  Clone ID: PAT_TA_99141
gagaagaanaacaanggatggngcntatgaaggtgtacggctgggcngtgtcgccatggatggcgcgggtcctcctctccctggaggaggccggcgccgagtacgagctcgtgcccatnanccncaacggnggcgaccaccggcggccggagcacctccccanaaaccccttcggtgagatnccggtgctccaanacngcggtctgacnccttatcaatccccccnccattgcaaagcatattctcctccaatacacaaccccgggcttttanngatcatgcaaccctcgaatgagtctgcnaatggnntgatgtttttnggtctactgttgnatgccccaccnacctngggtgccccatannaaagncgc

SEQ ID NO: 99142 - DNA, 487 bp, Triticum aestivum
  unsure (1)..(487): unsure at all n locations
  Clone ID: PAT_TA_99142
ctgcctccagcaaactcacacatctcaccaccggagctcccaatcccacccgaagcggcagccatggcccccaaggcagacaagaagcccgtcgccgagaacaaggtggagaaggcggcggagaaaacccccgccggcaagaagcccaaggccgagaagcggctgccggcgggcaagacggcgtccaaggaggccggcggcgaggccaagacgaggggccggaagaagggcagcaaggccaagaagagcgtcnagacgtacaagatctacatcttcaaggtgctgaagcaggtccaccccgacatcggcatctcctccaaggccatgtccatcatnaactccttcatcaacgacatcttnnaagaaagctcgccggcgagtccnccaangctcnccgaaggtttaacaatgaangccccaccatnaacctccccgggaagatncaagacctccgttccggnctccgtccctncccgggcgaagctnt

SEQ ID NO: 99143 - DNA, 425 bp, Triticum aestivum
  unsure (1)..(425): unsure at all n locations
  Clone ID: PAT_TA_99143
gcccgccgccgccgccgccgccaagcaaccagcccccagcacccatcaccggccggcgaagatgaagacgatcctggcgtcggagacgatggagatcccggaggaggtgacggtgaaggtgtcggcgaagatgatctcggtgacgggtccccggggcacgctgacccgcaacttcaagcacctcaacctcgacttccagctgcangagggcgggcggaggctcaaggtggacgcctggttcggcacccgcaagaccatggccgccatccgcaccgccatctcccacgtccaagaacctcatcacgggggtcaccaanggctntccgctacaagattcgcttcctgtatgcntacttcccccatcaangcccnccatcaancgcccgcncaanccgcngggcatcntatnattantgaaactttcc

SEQ ID NO: 99144 - DNA, 465 bp, Triticum aestivum
  unsure (1)..(465): unsure at all n locations
  Clone ID: PAT_TA_99144
ctctcctccttcaatcctccagcgaaaccccaccccgccccaccccaccgtcagcatccatggcgcccaaggccgagaagaanccggcggcgaanaagccagtggaggaggagcccgcggnggagaaggccgagaagaccccggccgggaagaagcccaaggccganaaccngctgccggcgggcaagtcgtcggcgtgcggccaaggatggcggcaangcnaacaanaaggccaagaagagcgtggaanacgtacaagatctacatcttcaaggtgctgaaagcaggtgcaccccgacatcgtgnatctcctncaangccatgtccatcatgaactcccttcatcaacgaacatcttcgaagaaagctncgccggcgagggcngctaanctggcgaaggtncaacaaagaaagcccancattcncgttctccggggaagattnatancctcccggtccgccttc

SEQ ID NO: 99145 - DNA, 475 bp, Triticum aestivum
  unsure (1)..(475): unsure at all n locations
  Clone ID: PAT_TA_99145
gttcaagggctgtcctgagaagctcaaatggctcccaaagttgctgttgccaagaagggcgatgccaaggcccaggccgccaaggttgccaaggctgtgaagtctgggtcaatcaacaagacggcaaagaagatccgcacttctgtgacatttcaccgccccaagaccctgtccaaggccagggaccccaagtaccccaggatcagcacccctgggaggaacaagctcgatcaatatcagatcctcaagtacccgcttaccactgagtctgcaatgaagaagatcgaggacaacaacacactcgtcttcatcgtcgacctnaaggccgacaagaagaagattaangccgctgtcangaaaatgtactacattcangccaanaaggtttacaccctcatcangcctgattggcaanaaaaaaggcgttacnttgaaanctggacacccaaacctaccatgcctcctntgntgtntg

SEQ ID NO: 99146 - DNA, 531 bp, Triticum aestivum
  unsure (1)..(531): unsure at all n locations
  Clone ID: PAT_TA_99146
tgggattccccccnggccngcaaggaaattcggcaacgaagcaaaggaattganggaaagggcaacaaatcaagcaaactggacctggtaaataaccttaacctaacctaanggtgntagttttgttttgaagccaanagaatgtttgggcgngtggtttcancnggcnaaagttgggttnganggtgccctgcgggagctnggtgggcgggcccggggagcccgggacgccatcnccccaaagaacaacagggccgtcgggagcttggtgaagcgcttcctccccggcaaacgancccgggcccgtgtccgtgnaagctggggatcaactggggcaaacctcngcctactcccacgcccaaaccaaagtccctcctcctcccaaagggtctttcncttgcaaaagggattgaagaatctttctgcctggttcgaanggggaagtccctggacaaacntngggggcgggttggangcccaaccaagtaacgnggcctcctcccaaagggggngggnaaacggaanggntgc

SEQ ID NO: 99147 - DNA, 496 bp, Triticum aestivum
  unsure (1)..(496): unsure at all n locations
  Clone ID: PAT_TA_99147
aagaccctcaccggcaagaccattactcttgaggttgagagctctgacaccatcgacaacgtcaaggccaagatccaggacaaggagggcattcctccggaccagcagcgcctcatctttgntggcaagcagctggaggatggtcgcaccctcgctaactacaacatccagaaagagtccaccctccaccttgtcctgcgtctgcgtggtggcatgcanatcttcgtgaagaccctcaccggcaagaccatcactcttgaggtggagtcatctgacaccatcgnacaacgtcaaggccaagattcaggacaaggagggcaattcccccggancancaagcgccatctttgcctggcaatgcanntgggagggatgggtcgcacccctcgctgactacnacatcccagaaagggaggtccaccctccaaccttngtctctggcggttctgcggtnggtggggaaatgcaaggatnttccgttgaaangaccccncct

SEQ ID NO: 99148 - DNA, 261 bp, Triticum aestivum
  unsure (1)..(261): unsure at all n locations
  Clone ID: PAT_TA_99148
gaactggcctcatggctctaccgcgctccccgctacacaacagtgccnacgtggaggaaatggaggcgcaggatgttgtcgacaacagtctgctccctccaggttaaacgtcttgaaatgcgggcggtaccaagtttgttcagtgtcaacatatgcgggcgtttaatctacgtgtatagtatggcgttcaatcaaggcagaagacggcattccaagtcggagcgcttcattcatttgagaccaaaaaaaaaaaaaaaaaaa

SEQ ID NO: 99149 - DNA, 550 bp, Triticum aestivum
  unsure (1)..(550): unsure at all n locations
  Clone ID: PAT_TA_99149
anacaaaactcccgcctgctcacgcaacacactcacataggacnanccatcactcttacatatatccaagangngttccaagttcaaggacgaagcacccgtncganaactcgcaaggccgnngcggagcgcattcgccatgaantacancganccgcattcccgttcatctgcganaatgtccgaagaantcgggacattncgaccatcgacaagaagnantacctggtacccgccganctgancngtcgggacacnttcgtntacnntgatccgtaagcgcatcaaagcctgtccaccttgtagaaagggncacnctttaatccttcgttggatggagggtttttgcncgcnctacctggccnncctcctnattgagctcnnattatatgcaggggangcacaatgggnttangtgaantgggnttccctgntnacaatttaangttacttccgggnttgaagaaacaanatntcggncgaanggccatnctantggggaagcctcantntnccaatccgcgcaattcncccgttattctannncggg

SEQ ID NO: 99150 - DNA, 483 bp, Triticum aestivum
  unsure (1)..(483): unsure at all n locations
  Clone ID: PAT_TA_99150
gtaacatgaagttctgcctgaacggcggtctcatcatcggaacctgcgatggagccaacatcgagattactcgcgagattggcgaacagaacatcttcctcttcggtaaccttgccgaanatgtcgaggacctccgtcacaaccacatgtactctcagtaccagctggacccccagcttgccaacgttttcgatgcgattcacaatggcatgtttggcgatgcggaccagttctctgctctgatcaacggcatcgtggatcatggtgactactacctcgtcnctgacgacttcgcatcgtacattcaagacacaggagctcatcgatgaagagctacaataatactgagggagtggacaaccaatgaccatcancaacgggtcgcgcgcatgggggtttcttctcaaggtgacaagatgtatcgacgaagtatgcgggaggctatctggaacgtccagccgctggcanggtcaaagaagcgat

SEQ ID NO: 99151 - DNA, 200 bp, Triticum aestivum
  unsure (1)..(200): unsure at all n locations
  Clone ID: PAT_TA_99151
gtgtcnctgaagcngcaaangcgcctgagcctcgagcgtccntaagtgcngcanaggcaangtcnggctcgaccccaatgaggtcaancanatctccatggccaactcccggcagaatatccggaanctggtgaaggatggtttcatcatcnggaancctcaaaagatcnactcnaggtcncgtgnaacgaggggcacat

SEQ ID NO: 99152 - DNA, 437 bp, Triticum aestivum
  unsure (1)..(437): unsure at all n locations
  Clone ID: PAT_TA_99152
aagaaaaancaagaggagctcaangagaanttccaggggctgtncaaggtcatcaaagangtgctnggcgacaaagtggngaaagtcatcntccctnaccgtgttnttgactccccctgctgtctggtnactggcgantatgggtgggaccgccaacatggagaaggattaataaaggcccacgccttganggactccancatggctggctacatgtcaatcaagaaagaccaatggaggattaatcccttnagaaacgccatcttggtcgaactccgcaagcgccgccgacgcccgacaaaanaacgaacaaagtcaagttcnanggaaccttggtgatgcttgcctcttccaagaaactncccttgcttcacctcccggctttntccntttanggaaccccaaacaanctttccggtaaccaangattcanncgc

SEQ ID NO: 99153 - DNA, 173 bp, Triticum aestivum
  unsure (1)..(173): unsure at all n locations
  Clone ID: PAT_TA_99153
gcggccctcgaccttggccacgagctggtgaggaggggcgtcnanctggtctacngcggcggcagcatcggcctcatgggcctcgtcncgcngacggtgctcnacngtggccgccgtgtcgtctgggtgattcncanggctctcatgcctgtctagatattaggtgagagtgt

SEQ ID NO: 99154 - DNA, 309 bp, Triticum aestivum
  unsure (1)..(309): unsure at all n locations
  Clone ID: PAT_TA_99154
nggcataacantacaaattacangcgaatgtggatgttgcacactattgtgaaggtgtagcactgcccaattaaatttccacntcacanatctacttnaatttctaccaaaaattcacctttttaacaatcaaacccngggcaaanaaatcaaacnggcgagggatgagcaaaaagcatcatacgggcgaggaggagcaagaaacatcaaacggcgaggactccatctnggggcntttgttttctcccaaacaaactnccagcatcaantgcttggnggggaaattccccgcngcagcanaaaaggaaa

SEQ ID NO: 99155 - DNA, 417 bp, Triticum aestivum
  unsure (1)..(417): unsure at all n locations
  Clone ID: PAT_TA_99155
cggttgacccgccatgtcctcatcatcgtcctcctctctccccgtgccaagcggactggctgctccctctgatgccctgccctctgtgtggcgacgaggttgtcaccgccgtcgctaggaccggcaacaacgccggtcatcgtttctacaagtgcatccgctacgattgtcgtttcttcgagttccaagcgcacatattgcaggaggatgactcaggaccaaattgttgctgcgcggcatcaagccggatggcaccggctgggcatggatttgcanttcatcatggnaacccncctgtnccaaaatggttccaagctgtcaatancaaaaccccaaggccgcaaacancaacgccccaaacccgcatntttncncccgcaagattcaaagctgcgatngcaccaagtnacccgcaag

SEQ ID NO: 99156 - DNA, 434 bp, Triticum aestivum
  unsure (1)..(434): unsure at all n locations
  Clone ID: PAT_TA_99156
agccccgctcctcctcccccaccccacacanaccgcacgcgtttgacattttccgcccaccaccaccgganggagcgaggctccagncatggccgccaatgtgctanccganggtcagcgatgagtacctggcggtggtcgccaaggccaagcgcaatgctccgcggcttcatcgccgagaagaactgcgcgccccctcatgctccgcctcgtcgtggcactcggcnggggaccttcgacgtngccacnaaanactgggcgggcccctttcggcaccattgaaagttcccccgtcggnagctcttcgcatcggcgnccaanctccngggcctcgaanatccgccgtcanggnctgcttcgagtcccattcaaagggagccagttccccantccttctccctaacgcccgnaactctctanccaagctctcctgg

SEQ ID NO: 99157 - DNA, 269 bp, Triticum aestivum
  unsure (1)..(269): unsure at all n locations
  Clone ID: PAT_TA_99157
gcggctctctgtgactcaaacccccgcagcccggcgccggcgcgaagcgaagcgaagcgagaagaanacatggggcggccgtacgcagtcaaggggaagaaaaancggnagctggaaggcggngaagcctcgcgcgcccctccgggcgacnccgaagcggtggnagcaagaggtgaaggaaaatnangangtgattnctncctcttttccnntccttggtttcctcatcctctnctntntctcnttctttctccccccntttttttttt

SEQ ID NO: 99158 - DNA, 405 bp, Triticum aestivum
  unsure (1)..(405): unsure at all n locations
  Clone ID: PAT_TA_99158
atccgcagcggctttacctaccgagaagaagagagaaaaaaggttcgagtgcgttgcagagtgagaagagatggctccggtgaagctgtacggcgcgaccctgtcgtggaacgtcaccaagtgcgtggcggcgctggaggangccggcgtccagtacgaactcgtccccatcaacttcggcaccggcgagcacaaaaagccccgaccacctcgccangaacccctttggccaagtgccanctttgcaagatggggacttgtncgtcttcnaatcacgtnctatttgcaaagtatncntgccgcaagaacaagccaaaanctgttnnaggagggggacatcaaggggtncncaatgggtgatntntngctccaanggtngangggccaacaattcanccnccgctc

SEQ ID NO: 99159 - DNA, 406 bp, Triticum aestivum
  Clone ID: PAT_TA_99159
cctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcatcgccaagtatgtgggggacaaagcacggcgcgtctctgccggccaacttcaagaagatgctttccatccaactccgttgggtccgcagccaagggcaagccgttggaaggtcaaggctttcgtacaagctctccggacgccgcccaaa

SEQ ID NO: 99160 - DNA, 416 bp, Triticum aestivum
  unsure (1)..(416): unsure at all n locations
  Clone ID: PAT_TA_99160
gcagcatctgcatcccccgtcgccttcgatccaaaccccacctccccacaacctcgaatcatcagcagcagccgctcccatggcgcccaaggcggagaagaagccggtggctacggagaagtccccggcggggaagaagcccaaggctgagaagcggccgccggcgtccaaggagggcggcgacaagaaggggaagaagaaggccaagaatagcgtggagacgtacaagatctacatcttcaaggtgctgaacgcaggtgnanccggnacattggcatctcctccaaggccatgtccatcatgaactccttcatcaacgacatcttcgagaagcttgcccggngattccgccaaagcctggccnttttttcantaatggaannccaaccatncaacctccccgggggagatccatt

SEQ ID NO: 99161 - DNA, 427 bp, Triticum aestivum
  unsure (1)..(427): unsure at all n locations
  Clone ID: PAT_TA_99161
gtacaatccccacttcttgtcaactttacagctcaagaatcacaaacatgtntcctccgtcggcaattgagccccangcaggcgacganaccaaagcccaacacggttgccccnaacgaacctggtctgaaccaaaaagatggaaaggcgggcgatgcttaaattccccaagccgccaaagtttgacgatcccgtacaaagagcgcgcatanctgaanggncggacttgcngctgccttccgcatctttgggcaaaaatggctttnngaanggtgtggctgggtcacatcnccttgagggaaccctgttgatncgacaaacaattttggggtcnaacccattccngtgttgctttcaagctttgatnaaaatcttttccgattttnaatccctggtcaaaatgaataaaaaggcgaaagtncatcnt

SEQ ID NO: 99162 - DNA, 420 bp, Triticum aestivum
  unsure (1)..(420): unsure at all n locations
  Clone ID: PAT_TA_99162
gagagcaagcaagcaagcagccaccgaagcagcctccgctcccctccccgaccccgaagcaatggcgcgcacgaagcagacggcgaggaagtcgaccggaggcaaggcgccgaggaagcagctggcgaccaaggccgcccgcaagtcggccccggccaccggcggcgtgaagaagccccaccgcttccgccccggcaccgtcgcgctccgtgagatncgcaagtaccaaaagagcacggagctgctgatccgcaagcgccgttccaacggctggtgcgggagatnncgcaggacttcaaagaccgaactccgctttccaaaagctccgcccgtgttcgcnctgcaaggagggccnccccaaggcgttnctcngtccggggctccttccnaaggaaaaccaaacccttctggcgcctaatt

SEQ ID NO: 99163 - DNA, 326 bp, Triticum aestivum
  unsure (1)..(326): unsure at all n locations
  Clone ID: PAT_TA_99163
acaaggctcgcagctagccagatncaccagccatggccggcggcaaggnaagcgctcctcctcctcctgtgcgcggcggggctgctgaccccngcctccgcggcggacgacggcctgaccaaattcaaactgtactggcacgacntgctggcggggacganccccaccncgatncggatngcgcangcggngtccaacaacanctcctccaccttcttcngcgcggtggtggncatcgaacgaaccgctcaccannngttccccgcccgtcacngggntccgccaaantccaaagacnaaaattgtccgcccncangggganccta

SEQ ID NO: 99164 - DNA, 376 bp, Triticum aestivum
  unsure (1)..(376): unsure at all n locations
  Clone ID: PAT_TA_99164
cgtccccaatcaatcaatcatcatcaacaacctaaacctccgctccgtctgcgcctccgcgcaaaaccctagcggatccgtcgatcgacctcgcggagaggcggagaggcgggagggggtccgaagatgcaagatcttcgtgaagacgctgaccggcaagaccatcacgctcgaggtcganagcagcgacaccatcgacaacgtcaaggccaagatccaggacaaggagggnattcccccacatcagcaaangccaatttttgctgaaagcagttggaaagatgggcgaacattannctganttanaacatttcacaaaagaatccgaccccccccatttnggtccnnaaggctcancggggtggggactattatt

SEQ ID NO: 99165 - DNA, 624 bp, Triticum aestivum
  unsure (1)..(624): unsure at all n locations
  Clone ID: PAT_TA_99165
cgcgggtgggcggcccgctcctaagaactaagtgggattccccgggcctgcaaggaattccggcaacgaagaatcaatgaccgaaagcctttcccgaactcctaatggttccttccaaaatcaatccaaagtcaagcaacaacctgggaaactccaanaagcgcccttccctgggcctttcctgaacgaatgttgggtggctgggatttaataancctggggcaatgggcaancccaaatctggcaatcctgttaccccncaagggtaanacngttggaatggggccctccctaattngaaagaaatttaaatgggcatggggggcctggtctaaaaggnggataaaggggcaagattnaaaaaaaaaggggttttccttttngacccttggggcaanncancaaaacaaagggggccnattaattttgaagggattttccncaanggtcccccnggggagccccgaatttgtttccctcccnanaaaacctttgcccaaccttttcctggggnnttttgaaaanccaacttttcccaattgaannaaanggggnggggggacaaaccntttttttncgaattaatnaaatggaaaangggnccaanaacctttgaaaanggaa

SEQ ID NO: 99166 - DNA, 417 bp, Triticum aestivum
  unsure (1)..(417): unsure at all n locations
  Clone ID: PAT_TA_99166
cagcctcctcactcctcacagtcgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccngcgggttctaaacngccggcgggganaccggcggctgcgactgcaccacctgcaagttcggcacggcctgcggctgctctgctgcaagctgcaacttgaagcccgggcgccccaaaaaaaggccggcccggttnttgctanncacccaanggatnaagggagggacaaactnggnccaaggcaaacc

SEQ ID NO: 99167 - DNA, 233 bp, Triticum aestivum
  unsure (1)..(233): unsure at all n locations
  Clone ID: PAT_TA_99167
gcgaancccttaatcccntctcccaacccttatctgcatntctccccatggccacggcggcggncggcgaagcggaaaccggtnttcgtcaaggtcgaccagctcanagcccgtcacnaagcnggncacacgctcgttcgccaaangtgcttcanctcccnaaaaccgtccctccanaaagggccccgcgcccggctnggcgggccccgggcccngggnccgccnaaancccc

SEQ ID NO: 99168 - DNA, 410 bp, Triticum aestivum
  unsure (1)..(410): unsure at all n locations
  Clone ID: PAT_TA_99168
ggcggcggcgcgttgcacaagagaaagagcaagcggcggcggtgcccgaagangagaancacggcgacctagcccgagctcgcaaccatggctaggggtttgaagaagcatctgaagaggctcaatgccccgtctcattggatgcttgacaagcttggtggagcttttgcccccaaaccatcatccggtcctcacaaagccagggaagtgcctgcctctgatcctcatcctgaggaacaaactgaaatatgctctcactatcggtgaaagtgcaatctatccttatgcaagcgtcatattatggttgatggaaaaggtccgcactgacaaaaacctacccctgccggtttcaatgggacatcatttccattcccnangactgggtgagaactacaagccntctgtnttaa

SEQ ID NO: 99169 - DNA, 195 bp, Triticum aestivum
  unsure (1)..(195): unsure at all n locations
  Clone ID: PAT_TA_99169
acaaagccggaaggccgaaggccgggaaaaaaccccgctttccctaaganccngcgctnangtccaaccccaangggantggtgtcccccctaaangggtcctngtaaaacccgcancttttccacggggcgangttnaanccccccctccaaaaggctcctnggggcggngtnntggaaaattccnggccaacc

SEQ ID NO: 99170 - DNA, 392 bp, Triticum aestivum
  unsure (1)..(392): unsure at all n locations
  Clone ID: PAT_TA_99170
agtcgtcgcggctccanctaaggtttctcgcccccgccctcccgcctcaacgccggncccgtccgccatgtctaagcaaggagggaaggccaagccgctcaagcaagccaaggtcgcccgagaangactaccacgaagaatgacctggcatacctccngaagaagaaagatgagcaaaangccctgaangagctnaaggccaaagcaagccanaaaggtgcgctgggaggatncngtctcaacaagagtgggaagaaatgatctncccacccattcgtaatacccanaaaatgataatctatctatcnacctatctgtgtcgcgcttcaactctccngtgggttgtaaacaaaaccaccttcaactttgttgnncaattngtncaatncgtc

SEQ ID NO: 99171 - DNA, 366 bp, Triticum aestivum
  unsure (1)..(366): unsure at all n locations
  Clone ID: PAT_TA_99171
cccattattggttcttgcgaggagggggcggagaaacggaagcaggaggcggagaggagatnannccagcccttcaagcacaaagggcggcgagggagggcgcgatggcgtccaanaggatacangaaggagctcaaggatntgcaaaaggatccccccacctcatgcantncaggtcctgtgggtgaanatatgttccactggcaggcaacaataatgggcccatctgacancccatattctgggtgggagttttnctattttnttatccacttcccctccctgaattatccttttcaaaacccnaccaaaaagggtggcanctnccgcaccaannggtgtttnccattccnaaaacnatcaaac

SEQ ID NO: 99172 - DNA, 254 bp, Triticum aestivum
  unsure (1)..(254): unsure at all n locations
  Clone ID: PAT_TA_99172
gcctgatgcacgtaccaccaagtngtggccggattggagccnactccgccaaggtggnntgccntgcagctcgtggntctngagttcnatcacgatctgaancaggagagcatgcacaacancacacagatcatnaaccacttgatggatacaacgattgccacntttccaccggaggtagcctctcttcnactcatcgttaanaggantgtacaccccnatgtantccanggnatgatatacactgcactcct

SEQ ID NO: 99173 - DNA, 259 bp, Triticum aestivum
  unsure (1)..(259): unsure at all n locations
  Clone ID: PAT_TA_99173
aattaatcgaacccatcccagcggagaagaagaaaaggagaaggctctccttctcctttaancttcgaatcatccttccttcccccctccccctccctccctcccacttnatctctccgcgacgaagcttccaaaacccccaaaaggatnncccaatcttcgcctctgncnccggcccgatnaaactctnatcaacggttgncgcncggctcngccccgggatctatggngaggtacaagcctgcttcaaggacatcgt

SEQ ID NO: 99174 - DNA, 420 bp, Triticum aestivum
  unsure (1)..(420): unsure at all n locations
  Clone ID: PAT_TA_99174
gcgtcttcgtactcgcctctctccgcgcatcctatccttcgccctcctccttccccatttcgccagcggcgcagcccaccaaccacccccacccgccgccatgagggagtgcatctcgatccacatcggccaggccggcatccangtcgggaacgcgtgctgggagctctactgcctcnagcatggcattcagcctgatgcgccatgatgcccggtgacaagaccgttgggggaggtgatgattctttcaacaccttcttcancgaggactggtgctgggaaagcatgtccccccgtgctgtctttgtanaatntcgangccccaccnggtgatttnattgagggtgagggannttgtgctctaccgccaagcntctttcgnccccngngccanccctaatnaagttgngttatnggggg

SEQ ID NO: 99175 - DNA, 408 bp, Triticum aestivum
  unsure (1)..(408): unsure at all n locations
  Clone ID: PAT_TA_99175
cacctctcgccggagtcccagcaaggagcgagcaagccaggaagatggacgccagcaagctgaagaangtggccgggaaaaaattcggcgggccgaggaaaaaatccgtgaccaagtccgtcaaggccggcctccanttccccgtcggccgcatcgggcgctacctcaagaanggccgctacgcccaacgcgtcngctccggcgcccccgtctacctcgcccgccgtcctcgantanctcnccgccnangtgctggagtttgtcgggaacnccgccaangacaacaagaagacccgcntcgtgcccaagcacctgctgctggccatccgcaacgaccaatancttccggaaggtgctgtctgcgttaacaatcncncaacgggggngttaatccccaaacaatcaaac

SEQ ID NO: 99176 - DNA, 198 bp, Triticum aestivum
  unsure (1)..(198): unsure at all n locations
  Clone ID: PAT_TA_99176
gaaaaggacctcactccccagctcagcccacccctcccngcncgctgcacagtccaaatcnccgctctcggcccggcgaccgaccgaggatncccngcctccatgncccanagctgctcttcctcctgccgctcctcctcctcgccgcggtcgctnantcttcaccggtcgtcccggnttcttgctggcgaggggtcc

SEQ ID NO: 99177 - DNA, 316 bp, Triticum aestivum
  unsure (1)..(316): unsure at all n locations
  Clone ID: PAT_TA_99177
cttccgtccaggcttcgctcaccgaaatggctaaaccctcccaatcccgcctcctccttcgtcttccccgtcgccnccgtcctcgccgcggcnttcctcctcccgctcgcccgctccnactcctccgggcctaaccctaccgccttacnactagctccgcctccgcgngcttcccgctgcggcctgctncctggcnaacgttctccgnggtacangctcgaactccnngttcggggggaanttcgccttnnacctcggacctccaagcttncccgcaatcgttngcctncctggcnnggngagctaccttcngcca

SEQ ID NO: 99178 - DNA, 385 bp, Triticum aestivum
  unsure (1)..(385): unsure at all n locations
  Clone ID: PAT_TA_99178
ctcacatctcatctcccgaccatccgcgcctcgccctggattncccagctcngccgctccacggnccgccccactgcgccgctcccaggccagccccgctcggccgctcccctgcccaccccgttccgccgctccacttcnatttccccgtctgtaccgcattggtgacctaantcacaccanggtcgcgaagggcgtggtggccctggccatgtctgctgggtgacngngtcgtgccactggcggtgactccatctgcgacgccctcaactcntgctgccgcccttgatngtggtatncggtgcctncccccgcngaattgnantgganaatccgggattttgcgtgcctgttgtncgccnactgnttnccatccattaatgat

SEQ ID NO: 99179 - DNA, 411 bp, Triticum aestivum
  unsure (1)..(411): unsure at all n locations
  Clone ID: PAT_TA_99179
cctccattcccagatcccccaagagctccctctcccccacccacgaagcgcctcccatcccgatggnccgcacgaagcagacggcgaggaagtccaccggcggcaaggcgccgcggaagcagctggcgaccaaggcggcgcgcaagtccgccccggccaccggcggcgtgaagaagccccaccgcttccgccccggcaccgtcgcgctccgcgagatncgcaagtaccanaaagagcaccgagctgctcatccgcaagctgcccttccagcgcctggtgcgggagatcncgcaggacttcaagaccgacctccgcttccangagctccgccgtctccgcgctgcangaggtcgccgagtgcctacctcgtcgggctctttnaggacaccancctctgcgccatccacgcca

SEQ ID NO: 99180 - DNA, 477 bp, Triticum aestivum
  unsure (1)..(477): unsure at all n locations
  Clone ID: PAT_TA_99180
ngagccagcggcactcacactanactcatccactcacaanctaatctaagcggcgtagctcacttcagtccangtcggcatggcggctccgangggcgcggcactggtgctggcgatggtgctcgcggcgatgctggtggcgccgccggcgacggtgcacgccatatcctgctccacggtgtacagcacgctgatgccgtgcctgcagtacgtgcatcanggcgggtcgccggcccggggctgctgcaccgtgcatccagaacctgctggccgaggccaacaacagccccgancgcccgcaccatctgcggctgcctgaataacgtcgccaaacggcgcctccggcgggccctaaatnanctctgcgccgccggcgctcccctcccaaggtgcaancgtcnccctcccccttacaanattnatccccagccgntcnacttgcaaagctcgaatccaactngaaaccnaanttnaatt

SEQ ID NO: 99181 - DNA, 462 bp, Triticum aestivum
  unsure (1)..(462): unsure at all n locations
  Clone ID: PAT_TA_99181
atagctactatgggcgccaaagtcccgcgtaacttccgtttgctggaagagttagagaagggcgagaaaggtctcggtgccgangcctgttcatatggtcttgacaacggcgatgacctcctgatgtccgactggaacggtactatacttggtccaccacacagcgtccacgagaaccgtatctacagcgtatcgattcactgcggcccatactaccccgacacncctcccgagatcaagttcacgtccaagatcaacctgccctgcgtcaaccctcagaacggaaaggtcgatgcgtcaaatctgccatgtctggctcantggaagcgggacttcaccatggagacnatactgatatagcttcgaacgtacatgggcgctgccgcacaacaaagaangcttccccanccgcncgaggganccacattcttaatgaantattcgnngcacacggccntgtnt

SEQ ID NO: 99182 - DNA, 366 bp, Triticum aestivum
  unsure (1)..(366): unsure at all n locations
  Clone ID: PAT_TA_99182
cacacacacacatcatctcctccacctctctcaaccaagccanggccaagagctgagtgaagcacccgcggccatggagggcaaggaggaggacgtncggctgggcgcgaaccgctactcggagcaccagcccatcggcacggcggcgcatggcggcggcgcggacganaangactacaangagccgcccccggcccccttcttcnaggccggggagctcacctcctggtccttctaccgggccggcatcgccgagttcctggccaccttcctcttcctctacatcttggtgctcaccgctgatgggcgtggtggggaaaccccgtccgggttcaaagttnggtannggcgggcattccaacggga

SEQ ID NO: 99183 - DNA, 353 bp, Triticum aestivum
  unsure (1)..(353): unsure at all n locations
  Clone ID: PAT_TA_99183
ctccctactgatgcgctgctgctgccccgacgccgctgccgacagcgcccangccacgcctcactagctccacccgctgccgcgctcccgccgttgttgatgctcaccatggncggagcancactcccgcccgcgctcgccttcttctggccgtgcccgcgccgcacccctgcgcctcgcctttttctggccatgcctgcgccgcacccctgcgcctcgcctttgcccccaccggcgcgtgcttcggncgcggccacccgtccgagggctatcaaataaggcgcgacgccggagctggacnccntcttggaacgnccggccgccgagaanaggaagatggnngacgagatctt

SEQ ID NO: 99184 - DNA, 196 bp, Triticum aestivum
  unsure (1)..(196): unsure at all n locations
  Clone ID: PAT_TA_99184
cggaaccctagcccctaaaatctgccccgatctctggattccntcctatccggttccttcccccctcctcctccccancatcgccccgcngccgccttcatggnngccgccatccggattccgcctatnattcccnagtgcggcggttacnaagacnccgttctcctcnacatgcggtgctacatcgcctancttc

SEQ ID NO: 99185 - DNA, 476 bp, Triticum aestivum
  unsure (1)..(476): unsure at all n locations
  Clone ID: PAT_TA_99185
ttctcttcctctgcccacaaaaccctagccgtcgcctcacagctcgccgccgacgcagcgagctcttcctccaccgccgcaaccatggcgacccagatcagcaagaagaagaagtttgtgagcgatggcgttttctacgccgagctgaacganatgctgacccgggagcttgccgaggacggctactccggcgtggaggtacgcgtgacgccgatgcgcacggagatcatcatcagggccacgcggacgcagaacgtgcttggtgagaagggccgcaggatnangggangctcacctccgtcgtccagaagcgcttcaacttcccgggagaacggcgttgagctttacnccgagaangtcgtcaaccttggcctctgcgccatcgcccaaggcngagtcnctccggctacaangcctccctcggtggggctttgtccngttnccgccanggcatnctannggtggttccttnccct

SEQ ID NO: 99186 - DNA, 316 bp, Triticum aestivum
  unsure (1)..(316): unsure at all n locations
  Clone ID: PAT_TA_99186
cttgcgcatccggggcagccgatcgaccccgcactcgcgcagccacgcccacacccacgccaccagtatctgtccttggccattgtgccgcccgaattcagagccatcttcgatcacaatccattgcaacangtagcgagcccttcnggttagtccctatatgtaccacgtacaagttgtctgctgctgatacaatcaggcagcggcggacatactcgttgctctccgcttggnattgagacggtccacgccggccgatcnaatgtggacggagaggagggcgaggaggatcantctcatggnccngcgggcnggg

SEQ ID NO: 99187 - DNA, 377 bp, Triticum aestivum
  unsure (1)..(377): unsure at all n locations
  Clone ID: PAT_TA_99187
agctcccactcctctcccaaaggaaccgaaaatactttgaccctccccttgacccgcgtctcgccctccgcgtggacaagacagaggacaganaagccggcccatggcgacggcggaggcgggcagcgccagcggcgcgggcgccgccnaccaggaggagcgccggaagcggatcctcgacaacctcaaagcacctcgaggatttgggcatatcgaaagatggccaagagcctgatccangccacnangcagcatganaattcccctcnggcgangcccaaagtccatnaagaagttcganggncaccactgaattcaggcnctcctccaatgggcaaggancanctgttttccnacaaaggatggattttcncgtg

SEQ ID NO: 99188 - DNA, 289 bp, Triticum aestivum
  unsure (1)..(289): unsure at all n locations
  Clone ID: PAT_TA_99188
cccggtcgtcncggctacagctagggtttctcgcccccgccctcccgcctcaccgtcggccccgtacgccatgtcnaancaaggagggaaggccaagccgctcaagcangccaaggtccccgagaaggactacgacgagaatgacctggcatacctccagaagaagaaagatgagcaaaaggccctgaaggagctgaaggccaaggcangccatcaatggtgcgctgggaggatccggtctcaagangagtgggaacaaatgaggctgcccacccattcntaatgccca

SEQ ID NO: 99189 - DNA, 256 bp, Triticum aestivum
  unsure (1)..(256): unsure at all n locations
  Clone ID: PAT_TA_99189
atctctgattctctctgnagctatcccgtgctcanctccggngattgccgcggnggcaaccccaactcgccaccccgtttgtgacgcggatgcggngccgccatangatgacgccggagacgggaagcatcctcccgcctcatctcctccgcgggntccanccccctcgagnancganctgcctgcgggggangancggtatcctcngaggggcantggngaactgtngtgngncgacccgcaacgaactgtaatt

SEQ ID NO: 99190 - DNA, 403 bp, Triticum aestivum
  unsure (1)..(403): unsure at all n locations
  Clone ID: PAT_TA_99190
ggttgcttccatgcttgnagtggcgctcgtccttgtctccttggcancatttcctanaggggtgcactccancggggtntgnaacggcgtgatcntggaacaacctgccggnaccgagcgacgtcgtnaagctatacaaanccaanggcatnaacgccatgnggatttacgngccagagagnaacgtcctnaangggctcancgggtcgggcatcggantcctcatggaacgtcgggaacgggngcgctccccgggctcgccaaacgancccctccgcccgcgggccgnctggggtnaanggcaacgtccanccctaccccggggcggtctccttccgntaacatcgccgtngggaaacgaaggtcattgngtcaagcnaancgtccantaangaccatncct

SEQ ID NO: 99191 - DNA, 242 bp, Triticum aestivum
  unsure (1)..(242): unsure at all n locations
  Clone ID: PAT_TA_99191
ggggggggcccttgtntcagtatgncngtnaaggntcntattnatnaagttgcccctgcccgcggggaanggcaanttctanccactagcgggcttcccggggctgcaagaatttcngnacgaagaagcctaccaagncttanccacaaaccantaagagnaatggggccctccaagntcgctctcttcctcgccctgaacctggncctcctcncctncgtgtcanggctgcgngatcctaa

SEQ ID NO: 99192 - DNA, 482 bp, Triticum aestivum
  unsure (1)..(482): unsure at all n locations
  Clone ID: PAT_TA_99192
cccaatcaagaaatctcaagcttagcacagaagcaaaacaatggcggggcagaccttcatcatgatcaagcccgacggcgtccanaggggcctcatcggngaggtcatcanccgcttcgagaagaagggcttctacctcaaaggtttgaagctccanaacgtggngaantcgttcgccgagcancactacnccgatntgtcctccaagcccttcttcnctgggctcgtggagtacatcgtctccggcccggncgtcgctatggtctgggagggnaaganccgtcgtctccactgggacgcaagatnattggnggcancaaccccctggcctctgagnccggcaccanccgtggngacttctccgtcgacatngggangaacgncatccatggaaagcgactcaattgagangtgncaangnaggngatngcccccnggtggnttccctgaagggcaattgnccgntnggggacnaannccat

SEQ ID NO: 99193 - DNA, 474 bp, Triticum aestivum
  unsure (1)..(474): unsure at all n locations
  Clone ID: PAT_TA_99193
aatctcccaagcagttcatctcctcaaccctgagcccgccgcgcccgcctgcccgccccgatggcccgcacgaagcaaacggcgaggaagtccaccggnggcaaggcgccgcggaagcagctggcgaccaaggcggcgcgcaagtccgccccggccaccggcggngtgaagaagccgcaccgcttccgccccggnaccgtcgcgctccgcgagatncgcaagtaccanaanagcacggagctgctcatccgcaaagctgcccttccagcgcctgggtgcggggagatngcgcaaggacttcaaggaccggacctccgcttccaanagatcccgccgttnttcgcgctccaaggagggccgncganggcctacctcgtgggggggtgttcngagggaaaacaaaactcttgggggcattcanaccnaaagnggggtcnaccnntcatngtccaangggtnatncnagctnctccc

SEQ ID NO: 99194 - DNA, 265 bp, Triticum aestivum
  unsure (1)..(265): unsure at all n locations
  Clone ID: PAT_TA_99194
ttcccccaaactgaaggatttcgcaacaaggacgggaaaatgtggcagnctntngactnccngcaagaagcaacaactntgccaacaaagttccaaccaaaaccggggggtnntcaangaccccaanggtggggaaagctcnctgttnncaagtnacaaccaangaaanaagggcgaagccgggcccaaaagttngccctggttnccngggggaaacnaagattcaagggggattccccacctnnaggncctactngnatacaaa

SEQ ID NO: 99195 - DNA, 411 bp, Triticum aestivum
  unsure (1)..(411): unsure at all n locations
  Clone ID: PAT_TA_99195
ccaatcagaaatctcaagcttagcacaagaagcaaaacaatggcggagcagaccttcatcatgatnaagcccgacggcgtccaaaggggcctcatcggcgaggtcatcaanccgcttcgagaagaanggcttctacctcaaaggtttgaangctccanaacgtggagaagtcgttcgccnagcaacactacgccnatctgtcctccaagcccttcttcgctgggctcgtgggagtacatcgtctccggcccggtcgtcnctatggtctgggagggcaangancgtcntctccactggacgcaagatnattggggccaccaaccccctgggcctctgaggcccgggaccanccggtgggggacttcgccnttcgacatcgggcanggnacggtcatccatgggaagcgaact

SEQ ID NO: 99196 - DNA, 459 bp, Triticum aestivum
  unsure (1)..(459): unsure at all n locations
  Clone ID: PAT_TA_99196
ggtggnccgaggtaagaaagaancanncgcagnccgcagcgcgaccccgcgaggaaaccctaccgccgccgcaagcaagagcaagcatgggtatcnacctcntcnccggcgggaggaacaagangaccaagcgcgtcncgcccaagtccgacgatgtctacctnaagctcctcgtcaagctctaccgtttcctggtgaggaggnccaagancaagttnaacgccgtcatcctcaagangntcttcaagancaagantaaccgnccgncgntctccatgcgccgcctctccaacttcatgaagggaaaggngggngaaagaccattgctgtgggctgtctggnanaatcacangatncatgcnnggtccaatagggtccccatgaaatgnaggggtatccgcctctgtaggntttacanatacancncaggggcaaagggatttgntcaaatggctgggt

SEQ ID NO: 99197 - DNA, 197 bp, Triticum aestivum
  unsure (1)..(197): unsure at all n locations
  Clone ID: PAT_TA_99197
agctttcgcancacaaccaacaaacaaatttgtaactcncaaaaggaaggggangnaaaatnaaccctanccgngnaaatcgaaggcagcnagacggctatncggccggcgatngcacganaccaagattgccgcctctantcgcgcncaccccgcccgctcgctttcgccgttatgaaggncgccncggcgcaaat

SEQ ID NO: 99198 - DNA, 153 bp, Triticum aestivum
  unsure (1)..(153): unsure at all n locations
  Clone ID: PAT_TA_99198
ccctaaactccgagcgcacgaggagagagaganggagatcncaaggtcgcggccatggnnatgcntgcggctgtacaacgagatccgcncgatgaangtgcgcgaggtgccggcgtanctcaagccgcgcctnacctgggcgaacgtgaacaa

SEQ ID NO: 99199 - DNA, 359 bp, Triticum aestivum
  unsure (1)..(359): unsure at all n locations
  Clone ID: PAT_TA_99199
tctaaaaatangcngattccccgggncggaagaaattcggnaacnagcgatgggngtgnagtccacaccgagccttgtnanaattttccaancgcgatggatctctgggagangggcgcggtccttcgccgggcggangnggtgaaacggtcgcaaganctgtcnctggaggcggncaancgggtcntcggtgctggtgtcngaganggcgaagaagtccaaggagatnttctcggngaccgccntcaagtcccgcgaagatngccgccggatgcgancaagcanggncgncctcctcgccggccanatnatgcacctcgcctcgggcatccccgtcncctccatcncgcccatccccg

SEQ ID NO: 99200 - DNA, 376 bp, Triticum aestivum
  unsure (1)..(376): unsure at all n locations
  Clone ID: PAT_TA_99200
gaatgtgcagggtataatggnaaccaatcgggcanatactctanatcctgctctgttgcgtccaaggaagactggacaagnaaatccagttccccctgccnggnccggaggganaagaagcttgntttccaagtttgtactgctnagatcaacttgagtgaccatgttgatttnggagattatgtctccaaacctgataaaatcantgcctgcctgganatcactgcctattttgccaangaangctgggcatgcatgctgtnccgcanaaaanncgctaatggttattcctccccaanggacttccgagaaaggggtatccggnatccaacggtcaaagaagccctggagacaagncttcggacttctacaaaat

SEQ ID NO: 99201 - DNA, 171 bp, Triticum aestivum
  unsure (1)..(171): unsure at all n locations
  Clone ID: PAT_TA_99201
ccccgggctgcaangaattcgcaccataaagaatgnctggcanatactcactccaagagaatcctttttttgcaattgactgggccccgtctccgtgcaattngcnggntaataggattcctggttggccnttgacnatttaaacctcaaanccttaaaggggcaaggatt

SEQ ID NO: 99202 - DNA, 374 bp, Triticum aestivum
  unsure (1)..(374): unsure at all n locations
  Clone ID: PAT_TA_99202
tnnggcccnatcntttcttgcctgccccngtaaagnanttctananccggcgnnttccccgggnntgaagnaattcggnacnagtcatnattaataaggattgcctggggccttctgtngttnaacttgggaaagctgtttcaantgctgccccaagttgccgcttgaatnnaanaaattaaaaaagacttgtttgaaanncattcacaanctcaantaatgttggtttgccattgggganttggnaaaaggttcccttacnctggtnccacaactgggnntcccttcaaggtctttgggagtaactcgttgggcaaaatttancttgacctggccttctggggctaatgnnctttttgggccaatccnaaggg

SEQ ID NO: 99203 - DNA, 475 bp, Triticum aestivum
  unsure (1)..(475): unsure at all n locations
  Clone ID: PAT_TA_99203
gncgcacggtcattnttnagccacctccaaatctacaccacggggatgaanaccgnatcaccgcgtcatcttcgnaaacctctgntcgtcctcctcttcctcgcaagcaacaacancancccccgtngcccaaattgccatggngggcgagccggancaagcgccggcggngcaagaagcgggcgtgcacatcgtgtacgtggaccgccccgaggacgccgaccccgaggagttncacatncgcaccctcgcccccgtcctnggnancgaggagaaagggcaggggcgcggncctctaccantacaagnacgccgccagcgggnttctncgcaaagctcaacaccggagcangtcgaggacctnannaagcaacaagtgtccttcaagttgtgnccgggccaagaccgtccaactcatgggaatgntggaggganatggcangnaaaacncgnaccatnggggccntatgtgnan

SEQ ID NO: 99204 - DNA, 203 bp, Triticum aestivum
  unsure (1)..(203): unsure at all n locations
  Clone ID: PAT_TA_99204
aagttgcncgtgtnagacctgagantcanggagatatggctgggattggtcctancaagcangactgggagccnatattngngcggaagaaggcgcanaacgccgccgacaagaatgatcgaaaagggcgtcaacgctgcccgccnctcnggcgccngagattttacaccaccaaagaaagtacaacnctngaacgaacaaag

SEQ ID NO: 99205 - DNA, 298 bp, Triticum aestivum
  unsure (1)..(298): unsure at all n locations
  Clone ID: PAT_TA_99205
ggactgggaggatcaccttgccggtcaangcaantcnccgttgagggtcanntcgagtttccgcgncatcctcttcgttcccaagcgcgctcccttcnacctgttcgaggaccanngaanaccaagancaacatcaagctctacgnncgccgtgttttcatcactgacgacgncaccgncctgntcnccgagtggctcaacttcgtaaagggtggcgtcgactccgaggaccttcccctcaanctgttctcgtgagancctccagcaagaanaagattatganggtcaatnccgcaag

SEQ ID NO: 99206 - DNA, 323 bp, Triticum aestivum
  unsure (1)..(323): unsure at all n locations
  Clone ID: PAT_TA_99206
catgcaaagaattcngnacgaggccatcccagtctccgctcgaggaaaactanaancttggggggaaaaaaaaaatctccgatgggtccgtccgnttcgcacgccggngncgcgttggtgngcctcccancccnccgngcgncgagctccctgncgcanncaaggntttggccgcnccggaaccttgcgggtggccgtgcggtgccaccaagggactcgggacgtggttcanaagtctggtctctgagaaaccccgagtggnncggccgccggtgccngcgaantcgggaggggctgnatggtttcggcccggggaggggaac

SEQ ID NO: 99207 - DNA, 514 bp, Triticum aestivum
  unsure (1)..(514): unsure at all n locations
  Clone ID: PAT_TA_99207
gaattccggcacnaaggatcgatnatcnatggggaagnaaggtgttgcttccatgcttgcaatggcgctcgtccttgtctccttggcagcatttnctagaggggtgcantccatcggngtctgcaacggngntgatcngnaacaacctggcggnaccgagcgacgtcgtgaagctntacaaatncaagggnatcaacgccatgcggatntatgcgccagagagcaacgtcctcaaggggctcancggctcgggcatcggnctcctcatggacgtcggnaacggggcgctccccggnctcgccaaagaaccctccgccgcggncgcctggggtcaaggggcaaacnttcannccctacccgggggtntccttccgctacatcnccgtnggnaaacgaangtcatngncaagccnacgggncaanaatgaaccatcctncccnggccatnnaagaaatcctccaancgggcggctccgcccgntgggctcggganctccngggggccgctggtcnn

SEQ ID NO: 99208 - DNA, 422 bp, Triticum aestivum
  unsure (1)..(422): unsure at all n locations
  Clone ID: PAT_TA_99208
cccantgctctgcctgtttgtggctttgccgtttcctgttccccactcatcgncggngatacaatcttctcgtggattgtctcgtggaggcgggancgatggggngtccgtgcgtcggcgctctcctggcgtgcgccgccgttgcancttcttgctgcggctgcttccanttccagggtgttgctgcggcggggaccccgtngttcggggacaacttcnacatcaccggngccgangaccacgtcaagacctccccccgacggccagacctgggtaccctctcccctcgacaacaangacnaggcgtttggggttccaagacggaagcaaaaantaacctggttcggggtggtttnancaatnaaagctcaaagcttcgtncgggaaacgnntnccgcccgggnggtncgtcaccggcctta

SEQ ID NO: 99209 - DNA, 331 bp, Triticum aestivum
  unsure (1)..(331): unsure at all n locations
  Clone ID: PAT_TA_99209
cccgggatgcaagaattcggcacgagcctctccaaccaanaacttntccgaggcgntaccaacttccttccaacctccttccttcccnncgaggnttncttcgatcgggancggtggcgtgttccctgggttanccgtgcgtttccgtttgcatggggctggncctcggcgaaatngtggatgcccctcganctggggctcgacctcaanntcttccncgccaanaccgccggncggctggccagccgcnaggcaangaangcnccgccgtncaacncctgnatccgcgtggctncatgaggagcgncncacaatttaaggncttccgccg

SEQ ID NO: 99210 - DNA, 189 bp, Triticum aestivum
  unsure (1)..(189): unsure at all n locations
  Clone ID: PAT_TA_99210
caattnatcaagcatcnaaagntgnanaggaaataaaaggttcctctaaattacgcaaagtttggattnantgatctaaaatgcgncacacggaacttcanacccgagagtcttctcgntgaaagggggtttgnatgtgtgtttaaagggtgggtnnaacaaaangggactgcnccngngaaacctggg

SEQ ID NO: 99211 - DNA, 405 bp, Triticum aestivum
  unsure (1)..(405): unsure at all n locations
  Clone ID: PAT_TA_99211
agcgcatccacacacacanacaccacagaccacctctccccgcccaagcatccccatccgcatcctcatccatggnccccaaggcagccgagaagaagccgggtggagaagaccccggcggggaaagaagccaaggcggagaagaangtgccggcgtccaangagggcggcngggacaagaagggcaagaagaatgncaagaagagcgtggagacgtacaaagatctacatcctcaaggntgctgnancaaggtgcatccgggncatnngggatcttcctcaaagggccatgtccaatcatgaaacttccttcattcaaccgacaatctncgaanaaanctngggccgggncgagttcgggcnaangcctgggngccncttncnaacaaaggaanggcccaacca

SEQ ID NO: 99212 - DNA, 214 bp, Triticum aestivum
  unsure (1)..(214): unsure at all n locations
  Clone ID: PAT_TA_99212
gtcgtcangcatggcgctctccctctccanctncttcctccccgancccaagcgccgcgccgtctnngagaaccgcaaaccncaacctccgctccctcgtccctcccaaggggatgaggtgctcgatncggcaaaaagggctgcacccggagatnttcgacgacnccaaaggtgtnctgnaacngttnancttngtgcttggtganngggggga

SEQ ID NO: 99213 - DNA, 398 bp, Triticum aestivum
  unsure (1)..(398): unsure at all n locations
  Clone ID: PAT_TA_99213
gagatcacttacnccctggcccgggacaagcattggngtacctntgccaaaattggatttcacaccatccattgctcnntggtgcctggaaagtgcncntgcacttacaagcgccaanttaaagtggncgncctaancagcgtcaagtgtcaaanatttcggggatcnatggncacactgttcatantgncnttgatggggggaaacttccttctggacgctgctgggtcaacaattgggtgcccnaatnacaccaaggnagtnctacaanatatttganagaatggaatgttcgagggaaggaaaccaaccgnctgtgnctgggaanaanttggccttggtntgaanncttcataacangctggccgnccttcaatactaaaattcccgnttaatta

SEQ ID NO: 99214 - DNA, 296 bp, Triticum aestivum
  unsure (1)..(296): unsure at all n locations
  Clone ID: PAT_TA_99214
gggaacgagcgccgctcgaggccctctcnnccttcgnggccgccgncgctgcaagnaaccntcgtcgccgtcgccgccgtcgccggagctaaacccctcgcctgacgccanggggngcatgcananccgngggaagggtatctcgtcgtcggtgctgccgtacaagaggactccccccagctgggtcaagaccgccgtcnctgatgtcgacnagttgntcacnaaggctgngaanaagggtcagatnccctcncaaatcggtgttctgctccgtgaccaacacggtatcccccttg

SEQ ID NO: 99215 - DNA, 168 bp, Triticum aestivum
  unsure (1)..(168): unsure at all n locations
  Clone ID: PAT_TA_99215
ggaaagccaaacacacgacgggctcnntgaagacctcttctcgatttgaactgaacaacagagagcgcccctgttgngagtcnagcganagaangangtcccggnccgatctccaatcttccccggnggngatgccggctggctgganagaatgnanctccntttgcc

SEQ ID NO: 99216 - DNA, 465 bp, Triticum aestivum
  unsure (1)..(465): unsure at all n locations
  Clone ID: PAT_TA_99216
ccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaaagattatcaagctgattgacataactgatgatggntatgtcagccntcctcactgaggaagtgggaacaactaagggntgaccctgaagcttcccaatgatgatgttctgcttgggcaagattaaagaactgggttt

SEQ ID NO: 99217 - DNA, 462 bp, Triticum aestivum
  unsure (1)..(462): unsure at all n locations
  Clone ID: PAT_TA_99217
ggatgtcgctctggcacgagcacctcggcaagacgcacgatgacttcctgcgcccggaaagcctagagtgcgtgcagagggtcaacaagatggccgatgagtactggagcctctacgtcggcgaccagctgccggaagacctcccaggccacctgctcacctaccccgtctcggtagacaaggccggcaatgtctcaagcggtcacgggatttgaattcttccctgacacagaggctcgcgtgcttggtgagccaaacgggaataaaagattattttctgagcaaaaaagctccaagtttgncgctccnancttggtgttgaataaatccctgggaactnccggggnttttttttttcccaanccgggtangctatccttaggntngnaattaacctatttnggccaaaaaaaaatgggcctttttttgggaaaggnggccgggncaaattttccccaaaag

SEQ ID NO: 99218 - DNA, 217 bp, Triticum aestivum
  unsure (1)..(217): unsure at all n locations
  Clone ID: PAT_TA_99218
ggagagagagggttcgagagtcttccanagagcggatccatccagagagtgctagggttttctctccgggcggcggngatgtcgatggcggcggcggcgagggcggcggagcgggccccgggcagggcggcggcgcggttcgtgcagaccaggctccgctcctccggcaaggtgctcagcgaggaggaganggccgccgagaactctacattcaata

SEQ ID NO: 99219 - DNA, 483 bp, Triticum aestivum
  unsure (1)..(483): unsure at all n locations
  Clone ID: PAT_TA_99219
ccattctctagtcgatcacacacgctctcctcgccgccaagatgttcgggttcgggcaccaccacaaggaccaggcgccggcggcgtcgggccccaaccagatcttcaagatctactgccgggcctcggaggactactgcctcgccgtccgcgacggcgaggtggtgctcgcccccgtcaaccccaaggacgagacccagcactggctcanggacatgcgcttcagcaccaccgtcaaggacgaggagggcatgccggtcttcgcgctcgtcaacaagggcaccggggctcggccggtcaagcactccatcgggccangtcccaaccccgtgaaagctggtggccgttcaanccgggncgtaccagggacgcgncggttctgttggacngganaagnaagggacgtggggcaaagggtttcccgcttncatccgcantgggtcaaaaaacaacccggcctcaactttcgnaggccccttcaag

SEQ ID NO: 99220 - DNA, 456 bp, Triticum aestivum
  unsure (1)..(456): unsure at all n locations
  Clone ID: PAT_TA_99220
ccgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgaggggtggcggatgaccaaggccgtgaaggtggttgacattgttgacaccttccgtcttcaggagcaacctgcttttgacaagaancagtttaactctcacaatgaagcgctacatnaangaaacctctctggcaagcttgaangggggatganctaaatgttttcaannaagaatgttngagtccggcaaaaaagtatccttctta

SEQ ID NO: 99221 - DNA, 354 bp, Triticum aestivum
  unsure (1)..(354): unsure at all n locations
  Clone ID: PAT_TA_99221
agagggttttgccattggatcagctgctcttgtgtccctggcactttttggtgcttttgtcaacaaagctggtgtnaaggtcttgatgtcctatctcccaaggggntcantggncngattggcggagccaagcttccgtaatggttctctgncaatgancaanaaaaatgntggnaagtgctgcccncaaaaatggtttgaggngggccccaanggcaattnaaaaacaattcctgggactggatgggagggaaantggcaaaccccgnctattgncaactggtgtcaaagattntccaaaggaaggcttccancaaaggngatggnttccctncgggggggntttgggcaaag

SEQ ID NO: 99222 - DNA, 317 bp, Triticum aestivum
  unsure (1)..(317): unsure at all n locations
  Clone ID: PAT_TA_99222
caagaagcacacagacacagagagagagatagtactactgtgctagctagctggattttgggagacagtgcgcttgtgtgtgcgtgtggtgatggaggcgcacatggagcgggcgctgcgggagggggtgacggaggcggagcgggcggcgctggaggggacggtgcgggcgcaccacaccttccccggggcgggcgcggggggcacctgcacgtcgctggtggcgcnancgccgtggcggcnccggttcncccggtnntgnccatcgtgcgcaagnttcngaaacccccanggggnaaannaattcgtnccgcacc

SEQ ID NO: 99223 - DNA, 466 bp, Triticum aestivum
  unsure (1)..(466): unsure at all n locations
  Clone ID: PAT_TA_99223
aaaatatagctacgatttttaatttctgtgctgagaaattataattgtctaaattatgtatcgcgcttatctcgttgatgttagcaaattcagccaaccagctgctacttttcttgtataggctgtaagtgtgatgttcatatcctttagaggtgaatagtctatctttggtaggagggggtaagttgatgttcatatcttaggaggtgtgtatagttagttggttactagcatctttccttgttttgtcatgagattgtatctggcctgcccttttttttcatgatttttttaatttttggttagcctggactaacttttgctcccatcctgggcatgatcttaggtcttgcgtgcatcactgggatgtttgttacnacatggctggatggcactggtcaacaaatttgggtggaaaaagaanancccggcttgccttggcggttccctcaaaatcctccggggt

SEQ ID NO: 99224 - DNA, 316 bp, Triticum aestivum
  Clone ID: PAT_TA_99224
aaggagtcgccggtgggcgacgaggtgttccggctggtggtgccggaccctcgccgccttggcacgccgctggccatggggatcgtcatggccctcgacgagatgttcggcagctccggggccggctgctccaccgctcgatcactgctgccgaggagctggtcgatgtagttagatggatggcatggggaaatatttgagggcccacttgtcatctacaatacagtgtgccgcgcacaagggaagaaccacaagcgcacacgggccatgccacgaaataaaaatgaatcttgcacagttcctgcaaagaaaaaaa

SEQ ID NO: 99225 - DNA, 448 bp, Triticum aestivum
  unsure (1)..(448): unsure at all n locations
  Clone ID: PAT_TA_99225
gtatagnggtcattcgcttcgatccctaggcgctcttccctcccccgctggatggangtccgctncnaancgttnccatatctctctgtgntctctcctcccccccgcctcgcgaatccgtcggaaacccctcgccgctcccgcccggttctagcgcagcgcagagatggtagccgcgcgcctcctcgcgcgggccacgaggcaatgcgccgccgcggtggtggcgtccgctgcgaggcggccgctcggcggcgtngcggaggtggacgctcgcccgctcgccttcttccttcggcccccgncaggggttccatataatntnnaagtcangccaattgagataactcaaagcaaaaattctttcaaaaagggtttgggnttttnaatccttcgaacccccccaaancaaaaaattgatnnaggggggggnncaacgaacccccaaaag

SEQ ID NO: 99226 - DNA, 476 bp, Triticum aestivum
  unsure (1)..(476): unsure at all n locations
  Clone ID: PAT_TA_99226
aggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggngaaaagttcgccgacgagaagttcgtccaaaagcacaacaaagcccgggattctctccatggncaacgccgggcccaacaacaaaggntcccantttttcatctgcaacgttcccttgcaaattggntcnaacggnaagcncctt

SEQ ID NO: 99227 - DNA, 474 bp, Triticum aestivum
  Clone ID: PAT_TA_99227
cttcatgagaagcctgcttaacccttcctctttccaacgcgtaacaactcgagctttcactacgaccgcacgcatcatgggtgtccagaagaccatcatccaagagggcaacggcccatccccacagaagggtgacaaggtcaccatggagtacactggctggctcaagacccagtccggcgacaagggcaagcagttcgacagcaccactggccgtggtcccttccagacccccatcggtgttggtcgtgtcatcaagggctgggatgagggtgttgttcagatgaagctcggcgagaaggcgaagctggacatcagcagcgacttcgcttacggcgaccaggagttccctggcttgatcccccctcactctgacctcatcttcgaggtcgagctcaagaagatcaactaggtctacgaagcatccaacgacgggaatacacgatgatcgctatcagtgaatgggaacaagca

SEQ ID NO: 99228 - DNA, 475 bp, Triticum aestivum
  unsure (1)..(475): unsure at all n locations
  Clone ID: PAT_TA_99228
gtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcaaagtccaaggtgttctatctgaaaatgaagggtgactaccacaggtaccttgcgggagttcaaggcaagcgctgagaggaaaagaagcaactgagaacactcttgtagcaaacaagtcaancccaaggacatcccngctggctgact

SEQ ID NO: 99229 - DNA, 474 bp, Triticum aestivum
  unsure (1)..(474): unsure at all n locations
  Clone ID: PAT_TA_99229
ggacaccacatcttttggttagcaaattccgccatgcaaattttcgttaagaccttaacgggtaagactatcaccctcgaggttgagtctggtgacactatcgacaatgtcaaggccaaaatccaagacaaggaaggaattccaccagatcaacaaagattaatctttgctggaaagcaattggaagatggaagaaccctttcggattacaacattcaaaaggaatctactcttcatttggtacttcgtcttcgtggtggagccaagaagagaaagaaaaagacttacactactccaaagaagatcaagcacaagagaaagaaggtcaagatggctaccttgaagtactacaaggttgacggtgatggaaagatcaagcgtctacgtcgtgaatgtcctgctccaaaatgtggggccggtatcttcatngnttggcactcctgacaaacaatactgggggtaaatgccatcctn

SEQ ID NO: 99230 - DNA, 470 bp, Triticum aestivum
  unsure (1)..(470): unsure at all n locations
  Clone ID: PAT_TA_99230
ggcgtcttcgtactcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgtcccccgtgctgtcttcgtanatctcgaacccactgtgattgatgaggtgaggactggcgcttaccggcagctcttccancctgagcancttntcaagtgggaaaggagggangaaccaacaacttcngcccgtgggcattacnccaattggnaaaggaganttggtggntctctgcccttgannt

SEQ ID NO: 99231 - DNA, 425 bp, Triticum aestivum
  unsure (1)..(425): unsure at all n locations
  Clone ID: PAT_TA_99231
gttctttccaaaaagacgctccattccaggcctcccacgcgtccttcaagagaggagctcgtgtggcagacgatgatgaggaggacgaggagaagactcctgcggacgatctcggcgcggccagggccacgccgttcggccggcgatcgcgcgcgggctcgtcggtcaccgacatgtcaagcaacgcgtccatcatctacgggaagtcggcgcggcaggacaggttcggcaacgagggcttctggtgcggcgctttctgcatgcaactgcccggcctgtccangcggngggcgaccatgcaacaacagcantccatgancctgagcgaanncaaacnccccggcgaagcangggccgggcttaacaacctanccgggagcggggtggtgtccaaaggggcctccatgggagaaggttcggcaaaa

SEQ ID NO: 99232 - DNA, 474 bp, Triticum aestivum
  Clone ID: PAT_TA_99232
attcccccctcgtttccccttcggccccttcctctactacgcgaattccacctccgaagtgcgtacggtgaccactacctcgccttcgttgtcatggccaccgacctctccggtgtgcgggaacacgtccaggaggtctgccgcagccgtcttcgtccgttcaggggaccaactcaagccgggatgcccctcctcaacgcttgcatcgtcttcctccgtctcggccatcgcatctcgggtcaccattgccgctgctccgagccgtcccctgtctccccaacctcgccgtcgcgctctcgaccccaagactgccggagacccccagtacgactacggtgttgatgactcctctctcttgccagaagcaaccagacgttggagcccaggagccagacgcccgtcgtcgacgatgactactactactcgggaggtgcctaatactacgtgcagcccgctgacgacgaccaggagtat

SEQ ID NO: 99233 - DNA, 468 bp, Triticum aestivum
  unsure (1)..(468): unsure at all n locations
  Clone ID: PAT_TA_99233
ctcggctcgcattcaagcaacaataggaggaagtgcaaaagcaaagcaagagatggaggcggctgggtatcgctcccgcatcgtggctgaagtcgacccccgcagtgaatgggttcatggggacgagttcgacacgctcatcgtcaacgtctcaggattcaccagggaccaagctcaaggtccaggtggagccgtcggggagcctcaagatcagcggcgagcgcgccctcaacggcggccgccagtggtgccacttcctcaagcggttcgacctccccggcgcctgcgacgccgcggcgattaaggtccagctcgacaagggggtcctctacgtccaagtgccccgttccacgggacgacaagccaaagaggacgcccttgcganaaaaagaggacgctgggcgccttctggaagcngggggcacacggggggcgttngcgggcccnaatnaacaanccggggttggn

SEQ ID NO: 99234 - DNA, 467 bp, Triticum aestivum
  unsure (1)..(467): unsure at all n locations
  Clone ID: PAT_TA_99234
gcggaatgctagtagtccgtactcctcgccgctacgaccctgaccgcgccgccgccgccgccgccgcctcaactgtgacggcgagcagccgcgtcgcagcggtctgagcaagggtaccaccacccggatcgagctccggacatggcggcgggggcgtgggccgcgctcaggtcggtcgtgaagccctgcatcgccggctccctcatcggcctcaccgtctccgaccgctacttcacggtcgccgccgtccgaggcgcctccatgcaccctaccttcgagggcaggacaggtgaatacgcgttggtggagcggctctgcctcgagcgctatgacttctccgcggcgacgtcgtcaccttcgtgacgccggtaaaacaacaaaggaaggggatnaaaaaggttatttgggctgcccggcgactggattaacgtnccgggagaacggnggaattcgggaaaatancgggg

SEQ ID NO: 99235 - DNA, 477 bp, Triticum aestivum
  unsure (1)..(477): unsure at all n locations
  Clone ID: PAT_TA_99235
agatcatcagctctacttctctcactgtcatacttcagacattttctcacatacccatacccatcttcacacatcaaccatgcgtttctccaccatcctccccgcagcctcgctgctcgctctctccaccgccgcacccgtcgacaacctctcgacccgcgccgcatgctcctcctacaccatcatcaacacccgtggtaccggcgagatccaaggcgaatcctccggcttccgcaccatgaaccgcaacatccagtccgcagtctcaggcggcaagatctacaacaccgtctacgccgctggcttctcgcaaaactctgctgccggcaccgcagacatcgtcaacaaagtccagtctacactacgcacaaacccggatgagtgctttatcctcgagggatacagtcagggtgctcanggcgaacggggaatggcatgtctcaagctcaatgggngcgaacttcgntgctggtaang

SEQ ID NO: 99236 - DNA, 662 bp, Triticum aestivum
  unsure (1)..(662): unsure at all n locations
  Clone ID: PAT_TA_99236
acaatcaccttttccacaacaacaacaacaccaacagctgggtgcaacaacanatccctgttgttcaagccatccattttgcaagcagctaaacccatgcaagctattcctccaagcagcagtgcagccctgtggcaatgccacaacgtcttgctaggtcgcaaatgttgcagcaagagcaagttgccatgtgatgcaacaacaatgttgccaagcaagttgccgcanatcccccaagcaatcccgctatgaggcaatccgtgctatcatctactccatcatcctgcaagaacaacaacangttcagggntccatccaatctcagaagcagcaaccccaacagttgggcaatgtgttccaacccaacaagagtcgcagaagcaactcgggaacaactcaacaacaacanttggacaaggtaccttttgaagcacacaagntnctcaacttgagggtgactcattgcgctcgtacctgcaacatgtgaatggttatgtgccgtgtcaaaacaacataggggcaatncgcgttgaaccgggttgngccnncggtaaggaagtnccagaaataaattggcnccgtggtnacctggggaatccngaangngcaatnantgncaaagncttgtggccccatantnttantcgntnataaataaggtt

SEQ ID NO: 99237 - DNA, 704 bp, Triticum aestivum
  unsure (1)..(704): unsure at all n locations
  Clone ID: PAT_TA_99237
caactaccaccattttcacagcancaatcaccgttttcgcaacaacaacanatagtactacaacaacaaccaccatttttgcaacaacaacaaccaagtctaccgcaacaaccaccattttcgcagcancaacaacaactagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttgggccaatgtgtttccaaccccaacagcagtcacaacaacaactcgggaacaacctcaacancaacaattggaacaaggnaccnttttgaagcacacagntngctcagcttgagggatgacttcantggctccgtacctgcaacgatgtgccgtgcaatgtgccgttgttagaacaccactaatgtgcaattcgggttggaccgggttggtctactataaggaaggccctngattaaaagttgttacgttgttancatgtt

SEQ ID NO: 99238 - DNA, 223 bp, Triticum aestivum
  unsure (1)..(223): unsure at all n locations
  Clone ID: PAT_TA_99238
ctcatactgtacatccaagactaaccaggatcattgaggctaattatactgccccaaaaatggagtaaccagctagtatagtcgatcggtccaatcggnaccacacatacggnactcnatnataatgcatactagagtactaagatngattcacacatncagtacttaatatcccttggnagttagaactactcncaatncctcctgagcngaatgatgggca

SEQ ID NO: 99239 - DNA, 372 bp, Triticum aestivum
  unsure (1)..(372): unsure at all n locations
  Clone ID: PAT_TA_99239
catgcggccactatttcagctcgtccagggtcagggcatcatccancctcaacagccacgctcaattggaggtgatcaggtcattggtattgggaactcttccaaccatgtgcaacgtgtttgttccacctgagtgctccancaccaaggcaccatttgccacgcatagtcgccgacattggtggccantgnaaaatgcaagcgttatgctaataggtanatggatcatcgttgcttanttgatgcaccaatcgttgtaacgatgaaaaataaagtggtgtgcaccatcatgtgtgaccccgancangtgctacgttcangcttgggaatanaagacaaacagagttcttgtttgctaaaaaaaacaagngc

SEQ ID NO: 99240 - DNA, 657 bp, Triticum aestivum
  unsure (1)..(657): unsure at all n locations
  Clone ID: PAT_TA_99240
atcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggccgtttcagctgctgcccctgctgctggaggtgctgctgcccctgcagctgagtcaaagaaagaagagaaggtcgtggagaaggaagagagtgatgatgacatgggcttcagtctgttcgactaagttgtggggcaccttgtgtctgaagtaactaacccttggcaagaaactagagtcaatgangtttagccttattaacttgagttgtgaaanactgggaaagacaatggttttgaaaggaaatcaacccccgggtgccgggtanttaacngngaacaancccttgnaancaaatttggcccttanaaagngntggtttgnggtctgcaaaaaaaaaaaaaaannnccccgggggccgnacaattcccaaanggggc

SEQ ID NO: 99241 - DNA, 564 bp, Triticum aestivum
  unsure (1)..(564): unsure at all n locations
  Clone ID: PAT_TA_99241
agccctcactcctcgccatgagagccccgtgcccgatcccttacctcctcccgatccccatctctcccccctcgttcccgtgccgccgccacacatcgatgccagggagagcgcccgaccccctctgcctgctcctttcctcgccagcgcgccccgtcaccgggtcgccggacctcgtcgcccgatcaccgctcctgtcacccgacgtcgccccgtctcctggtgccgggcccgccgccaagctctgccccgcgcccgatcgcctcctgccgcgagctcgcctgacccgcacgggcatggnaacgtcgggctccatggntcgnctgcgcctgnccttctcaaagtcctgntcgtcctcgccgnaacggcatcttggctcctggtccgcgncctggtccctcctaacaagannttcaactcncanggggtgntgntggctgnaactcgtcccganggcaaaaagcgggcggcgtcctcaaggntctnccntccttctggcgcttgancctttcgaaagccncgtgctgaaaccgnttaanaaanaantcnttgtccgtgaaaaaa

SEQ ID NO: 99242 - DNA, 700 bp, Triticum aestivum
  unsure (1)..(700): unsure at all n locations
  Clone ID: PAT_TA_99242
ccaagcgctcccccctcctcaacaacctcccggcgcatctccgactccatggcccgcaccaagcagacggcgaggaagtccaccggcggcaaggcgccgaggaagcagctggccaccaaggcggcccgcaagtccgccccggccaccggcggcgtcaagaagccccaccgcttccgccccggcaccgtcgcgctccgggagatccgcaagtaccaagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacacaaacctctgcgccatccacgccaagcgcgtcaccatcatgccaaggacatcaagtcgcccgccgcatccgtggagaganggcctaagctctgtgcgtcgtctctgttagtctcgtcntagcagatgtgttcagcggtgaaaattgtgcgtgtttgtatgtcngtcgtgcatgtggatgtanggtccngattgatgcaactccttgtgnaacattactgaattgaaatntttgtaaccggtcaaaaaaaaaanaaaaatncaggggggccgtncaaattccctaaggngcnttnaccngccanggnttctttaagtcggtggaaactgg

SEQ ID NO: 99243 - DNA, 531 bp, Triticum aestivum
  unsure (1)..(531): unsure at all n locations
  Clone ID: PAT_TA_99243
gccaaggccgcccatgagctgaaaccggtgaaagggaggcgtggcggcgctgcaggatgaagcaggcgagtggtgctgcgaagacatctccgtcatgtgtggcgaggccatgggggcactgctatgacccgttctagccatgagagctaccccaagcggcacagcaccctgctaccgcctgctcgctcgatgctacaaccagttcgtctgatgttacaagacggcataacaccttgctacaactggcgtcgccgctggtagagctatctgaggccggtcacaagtgaccttccatgccgaaagctacaaacacctctccacaagagctggaacctgcggcgcccaaagttgcaaccactctggggaaaagctgtaaccatggncaagattttgcatttttggnactaccgtttaattttttgctggnccaacacaaagttttgctaccaactgtttttgggtttgtttgaaccaatcccaattttgtaattttgctacaacggcgtttaagtttgctggagcgancttcaa

SEQ ID NO: 99244 - DNA, 520 bp, Triticum aestivum
  unsure (1)..(520): unsure at all n locations
  Clone ID: PAT_TA_99244
ggcctcttgatcccggaaaaagaacggttgcgcgaaccaacctgtagaattgctcccaccgtttacagcattttcaactttattgtgatgatttttgtagccatacttgtgtcacactgatgtattgtgaacacctttgagattggatcttccgtggtacacacatgacaacttattataggtaacttgtggcacactatcatgctatcttggnaccatcaaaacaattttttgagtgatgtatattcttatatccagtgttgtttatgggtcaccacgggcttgttgtgcaaccactcgcccactcgcgttcgcgacgcaagctcgctgaactgntcatgatggnttacttccgggcaangcttttggggaaagnatacacgggaattaagtggngtttccgggnaaatcctaagcaaacatatggggttacanccnatcnaaatttaantgnggtataaacaancgggaacaagnangtttttggtggaaccntcctttcaacagntaaaaatcttgg

SEQ ID NO: 99245 - DNA, 194 bp, Triticum aestivum
  unsure (1)..(194): unsure at all n locations
  Clone ID: PAT_TA_99245
ccggcctccacgtcgccgtcttcctcctcctcctcttctctancgggcgtgtccgtgtcganccccgtcgtcgacaggccgaggccggcgccggtggaggtcgagctcgccgttgaccttgctccggcgaggaagtccngtgaancggtgntncaaatngcggnaaacgcgtgggggtnaacnggggtnccggt

SEQ ID NO: 99246 - DNA, 405 bp, Triticum aestivum
  unsure (1)..(405): unsure at all n locations
  Clone ID: PAT_TA_99246
ccgccccgccccgcccctcctcttccccctcttcgccgccgcccccgctccggttcgcctccgccaccgccaccgccaccccgcaggtccgccggcttcgcttcgcgtcgatggcgggaagaagcagctgccaatgcaaaagaaagggaggnnggagggatttaanaacgggnccctggccctggtcctgatgagcgtcaaagaacaatactcangtgnttatcaactgncggaacaacaagaancttcttggncntgtganggcatttgaccgtcaatgnaacatgggtcttgngaatgttcggganatntngactgngggtncaaagnctggnaaanggaagaagaaaggccttncaatgnacaaagggnaggntcaacanacaanatgttcctccnngggga

SEQ ID NO: 99247 - DNA, 505 bp, Triticum aestivum
  Clone ID: PAT_TA_99247
catctgatcacccatagctagctagctagcagcttaaggaactagcttgcagctaccgatcgatggctcgtctcaacagcaaggctgtggtggccgccgtggtcctggcggcggtggtgctgatgatggccgggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccgggcgtgcccggcaagtgcggcgtcagtgtgcccttcccatcagcatgtccaccaactgcgacactgtcaactagttaatatataacccttctacgtgcatgcatggacgcgcttgtgtggagcttaatgtctatgttgatggagtgc

SEQ ID NO: 99248 - DNA, 503 bp, Triticum aestivum
  Clone ID: PAT_TA_99248
gtacagagcaatggcgagccgtggcggcaccggagcagatcgccgccgccgcgtcgacaccgtcgccgtcgccgtcgcttctccattctcttcccttgagagaagctgcaatctgcacatgtcctctgcaatgtccgggcctcaaggttgggctgacctcccagaagatctgcttcactcaattgttaccctgttaggatcattcactaacctccttgccttcgcggcaacgtgtcccgcttggcgtgctgccttctcctcctatccatccaaatcaacgctcgcgccaccgctcctccttcaacctcatgtccctgtgtgctctcctcgtccttgcccttttagcaacagcctcgtacgtacacgtgcatgctatgtcagtgaccttgccaacgaggacacatacatgtgttgtcaagattcctctacttcttgattttggtgagatgaatgccacaccgaggcatcttgacagttatcatttattcggtgcttcctgtggc

SEQ ID NO: 99249 - DNA, 448 bp, Triticum aestivum
  unsure (1)..(448): unsure at all n locations
  Clone ID: PAT_TA_99249
gctgaggaaaacaggatggtgttcctggggacatttatcggcctctttgcactcgagcttcactcattgcagttcaaaaagctatctgaaaccaaaagaaaatctcactaccatccatttgaaagtgtgtatactgcagatgttggaggtgaacatggtcgagctgaacttttgaacaatgcttaaggtgactggctgatcagatacactatcatgatatattggttgatcaggtacctggagttaccgttctggtggctgagatgcagacggcttgtttgctgtaggttcgctgtagtggacttggtaggaattaatttgaacattttgttcgctcatgactataatgtaatctgaacatcatgttaattcacgcatgtaatgtattttctgtaaaagttagttaattggcatgaagacacaagtgacttgcttggntgaaaaaaaa

SEQ ID NO: 99250 - DNA, 533 bp, Triticum aestivum
  unsure (1)..(533): unsure at all n locations
  Clone ID: PAT_TA_99250
aggccgagccctggcgcccgccgccccgcgccggcgcggccggcgggcgcgctggggaggcgtcctccgccgtcacgggccagagcagcggcagccgcccgcggaggaggcagcgggagcctcccgcctccgaggacgactcggcctccgccaagcccgtctccacctccggcggcggcggccaggatttgactgatgcanaagcaaagcgtttcaaggcaaataaatccagtgatgagaatggcagtttcaagaaaagatgctgaagctgattcaagaaatgctagtaangcttgtttgatcaaaatcctcnaccaccaaagcaagatttcatccaatgttgangggcaacaaggggtcaagcaactganaagccataacctttgcntanggggcacgacgttgagaaaataanccgancgggtgaaaaatctccaangatcctttcccctgnattttattaaggttattggnaaagnaanaagtnctcnattaggataatcaattangtccaagccttttggaacgtcaaa

SEQ ID NO: 99251 - DNA, 519 bp, Triticum aestivum
  unsure (1)..(519): unsure at all n locations
  Clone ID: PAT_TA_99251
ttcctttcctctcctcgcaaggaccttaatggacatggccatctcaagagtatcccaagcccgcccgccctccccgtcatcggccacctccacctcctcaagaagccgctgcaccgctccctctccgcgctcgctgcccgctacggcggtggccgcgacggcgtcggtctcctgagccttcggttcggcgcccggccggtcctcctcgtctcctccgcggccatcgccgaggagtgcttcaccgtccacgacgtcgcgctggcggatcgccccgggctcgcgtcacggcggctcctcacggacgagtgccccaagcatcgccttgtctaactacggccctctctggcgcaacctccgcctcatcgtcaccgtgcacgcgctctccgcgcaacgcctctcactgacgtctgccgtgcgtgcgaccgaggtacgcgccatggtaaaagcggctctacggggcgcgccggcgccaacgccggttaacgttaaggaagaagggttacganttcgtggtcaaan

SEQ ID NO: 99252 - DNA, 429 bp, Triticum aestivum
  unsure (1)..(429): unsure at all n locations
  Clone ID: PAT_TA_99252
atctggaggaggcactgtttacatgggggcggcgacacatcgttcagcgggaacgacaacagcttgtccaccgtaccacatcatataatgatgtttctttgtggagggtaaaacctgactaatgatttggaatggcaggaagtagtaatatcgaggaaataaagaaagcaagacttccatcatgattatacaaaacttccgaatctaatatatgatcggaacttaatattcagaaagttttacaattgtagaactctctttattaagttgttttaacttgtatcgtagttttaactgttataaatctactcctgtcaataagtaagatcttaaggaatctatcaactgaacaatttccatgggatgtactccatccggtcccaagttaatgggggggccgggtanccaantcgccctaaaagtgaagtc

SEQ ID NO: 99253 - DNA, 530 bp, Triticum aestivum
  unsure (1)..(530): unsure at all n locations
  Clone ID: PAT_TA_99253
ttttttttttttttttgaatcttccataaacttttccggtttgaccatccagaggcatataattacagcctgacaaagacgacattgctccgtgggagtctttgtaaattcaactcaaacaaagcagtgctatcaatggattcagacgattaatcttagggtggctactgtcctctggcccaagtgaaagaatcagtttgggaattggaaacatgggtaggtaccttgatggagcgggatgttcagaggctaaggacgccttggagaagacacctacacggtgagcacaaaaattgcagggggagatctggctgtagggcacggtgcagcgttcgaggtccatgagcaccgtgtggggcacaaatcgaccgcaagagggctcaantgggttggacgttgaccgctcgagctgcaagtccggaggtgncgacataanancccggtgggggcaatgtcctgctcnaagcaagaccaacaancaagaattggnnccgatttgattaacggaacccaacggcgctgggttttgn

SEQ ID NO: 99254 - DNA, 515 bp, Triticum aestivum
  unsure (1)..(515): unsure at all n locations
  Clone ID: PAT_TA_99254
gttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctcaaggtcaaggagctcaagaacggccgcctcgccatgttctccatgttcggtttcttcgtgcagggcatcgtcaccggaaaggggcccgtagagaacctcttcgancacgtcgccgaaccggtcaacaacaacgcgtggggncnttcgcaacaaacttcgccccgggaagctaaatgtgntaagccatctgtcccgtcatcggccaagatatgcaagtgtacttgtacgtctgggttaaagtgtaacttgacgtacnttgggngttaatttgnccaat

SEQ ID NO: 99255 - DNA, 487 bp, Triticum aestivum
  unsure (1)..(487): unsure at all n locations
  Clone ID: PAT_TA_99255
ccagcacagcgccggcctgtacctctgaagtctgaaccctaccgccaacggtgcggcgcgcggccggccggagcatagcctcgccggcgtgccggcgccgccactagacgctgtccgccgcaatcccgcaccatccagtgctcactcccccgtgccccgcgcgtcgtcaagaccgtgtcggccgctcggagcccgtgaattgcctcgcccggtcgtcctcggggctcaggctgtccaggcctctccacttccacgggcaggcgtctgctgtgtctactgtaaattccagagcaaggggcaaggctcatcatggactcccttcatcatgtgcacatcaaaacttctgggctgccgaccttctcacgctgactccccgacatacatcgccgccttcctttggtccgctgtgggcgtacagttgctcgtgccnaggttgtccgggtccgttgttcaacgtganccgcaaggaagaanttttctgggcctn

SEQ ID NO: 99256 - DNA, 516 bp, Triticum aestivum
  unsure (1)..(516): unsure at all n locations
  Clone ID: PAT_TA_99256
acgaatactatcataccatatacatctctactttccatacctttgctgaaaagttcttgattttactaggagctatggatcctaatggctcctatcctaacaaagttagatctagtgaaagtgaggccaacatttctcccttgcatgatgcaccgagaggcagagcgatcatgtcgattttgagtgatttttttcccccgaattccacaccatcagattcaacttgggtatggaacaccccacctaccattgatgcaccacatgtagttaccatgccatcaatcaaagattcttccatcatgccatatcaaaccagtgtatcactatcatcactacctccacagttgcctaatgcaaagtttactccttcaactagggtcaatacccttacttctcaagcccaaccatagggaaatctttgagaacccgccaagaaatantctcgcancaaggatttcctgtcaaaccctaatangaactactttagtcaacggntnaagaggaggaccttttcaa

SEQ ID NO: 99257 - DNA, 481 bp, Triticum aestivum
  unsure (1)..(481): unsure at all n locations
  Clone ID: PAT_TA_99257
acggaaaggaagcaagtttgctagtagcttcgtgagccgagcgggatcgccgagcagagcgggcggcagcgctggcgaggctgatggtccaccaggacgaaggctcctcctcgtcggtcacctcctccccgctgcacaacttctccaacatgccgctccacccgcaccctggcgcgaacggcgccggcgcaggcgccacgccgccctggatgctccgggagctccgctccgacgagcgcggcctctgcctcatccacctcctgctcaactgcgccgccgcggcctcggccggccggctcgacgccgccaacgccgcgctcgagcacatcgccacgctcgcggcgcccgacggggacgccatgcagcgcgtcgncgcgggcttcgcggaggcgctggccggcgcgcgcttccgttncgtggccggncttgtggcgcgcgnngntcctggnccgtccggggnccnaangcccngccaaggtcc

SEQ ID NO: 99258 - DNA, 354 bp, Triticum aestivum
  Clone ID: PAT_TA_99258
gagggacctgctcaagctatgggtcgtccgtgcctctgacaagctgcatggctcactcagctcctggactgtcaagtcccctctgcagagctaatccctcccctcgccttctcatatctctttatctagtaggcacactgtggagagtctctgggctaggaagaagaaagcaagtgtcaatttttcagctttggtgcggctatggctcatttatcgcgagttggaaggacagatcgcctacagcgcttctgtctatgggccaggcagcccaacatgagagggagtggcgtcactctcttcccgccacgggcaaattacatgcacgtgttatttttcaaaaaaaaaaaaaaaaaa

SEQ ID NO: 99259 - DNA, 410 bp, Triticum aestivum
  Clone ID: PAT_TA_99259
ggggatcccggtcgtgcattgaatccatcgcaaaggatctcgaggcctgccaccccgcccggcgcacccatctagaggcacatgctctccacggatccattggatcccttgccgcctctcctcctctgtgcttcgctggagaagccttggccttgccctggatgctagattctgcgattcctcacctgcaatatggattatggaagtgcatctgcacctggggcgctagctgctgatggccagagataaccgcgatgtgtacaggtccgtaccttgcatcaaattccagcccttacggccactcggagcgcttttcactgtacaaacagcatgcagagaagctaatggagtcttgttcaggttatcaccgcttttgctccagcaagaaagtacgacgagtcttgcgaagg

SEQ ID NO: 99260 - DNA, 445 bp, Triticum aestivum
  unsure (1)..(445): unsure at all n locations
  Clone ID: PAT_TA_99260
atctcgcgaggttgtgaattcatggctccccgggtcgccgtgctgctcgtggcagcggttgcggcctctgccctcgcgtccgcgtgggcgcaggacttcatggcgccttcgtcggcgccggctcccgccccggacacgggcggcgcggcgaccggcgccgctccggcctccgccctcgccttggtgtcgttcgcgctggtgtccctgctgggggcgaggctgatgcagtagacggccatgtcggccggccttcgccggcgtaccgatttggatcggatgccaatgacggctgcttgtatatttcttttgagagattggcgtcccttgtaggctggtctcgtgtgggcattctcttgtatcgtactcctaccatctctgatctttgtgagactgtgaataaagctggctcgattctgtgttcatcttaaaaaanannaaaaaaaaa

SEQ ID NO: 99261 - DNA, 524 bp, Triticum aestivum
  unsure (1)..(524): unsure at all n locations
  Clone ID: PAT_TA_99261
gtttcccgtaccgatcgatggccgtcgccgacgcggtgcttccctcaccgccgcccccgcccgtgcggatcgtcgtcgtgatgctgctgctcttgcgcttcgcccgcgtcctacgcgtcgcggcgggggccctcacctacgtgtgctcgtcggtcgcgtgtgtctcctcccgggccgcggctgcgctgctcgtcgcgcaccgcgcctggggcacgcgctccggccccttcctgttcctccaggcgctcatgtacgggggtctcaaggtctgcgtcctcagcgtccttgcgtcgttctcgcttgccgtcctgatgtgtgcgtccagcgcgtggcatacgagattgcaagttcgaactggatccacttcggaatacaataaggtgtcgtgcgaattaacaaactccctgtgatctttattccggtccaattgcaacagtatatanggaagtgttatgattaagatcttcggagtaatcaagttccatatataatggtggcaaaattaanttcgtgcntcanggtgn

SEQ ID NO: 99262 - DNA, 520 bp, Triticum aestivum
  unsure (1)..(520): unsure at all n locations
  Clone ID: PAT_TA_99262
acaggccggagattgccggcgcagacggtgcgcttactgttcaacatcttgtctaccagtgctgtgctgaccagatgacccccgcggcgccaggggagatcgtctcccgctacctcctgcctgccgcctccggtgaagatttgctaatggtgaagaggttcgtcgatccggcgagaggcggcactaggcggttcgaggtcttcaggctagagaagcaacttggcagaacctcctggcgcttccacaagatggaggggcaggtgctctttgtcggccggagctgctccaaggccttcgacacagggcgcagcggcaatccgggctacatctacttcctcgacgatgtctatggtggncgtccgatgagcgttctccaacagaacgaatatccctgcaccgacatgggtggntggagttgctcccctggacgacgaggaaatcaaaccgctgctgcatgggccgcaacccttcggncangtcaacgtccaattggaactncattgtctaccangaggttggg

SEQ ID NO: 99263 - DNA, 527 bp, Triticum aestivum
  Clone ID: PAT_TA_99263
ttttttttttttttagagaattttcttcaccattgattgcatccatcacaaaaatgttaccacacgcacaaacaacctgggccaacacaacattttgcaattaggcaagagcaaacctaccacacttgatcatctacagtccagaggatggcttgccctttcaagcaaaactaaaccacaagacatgacacatgactcccagattaacccaaccagtagtgtggtccgtgggaacacttcttcagctcattacagtacgttcatatccctacgtggttcacaaagtccaccgctgcttcagtaacagtgaacgtcaccttcccagacaagaaaaccagaaatgcgcacgccacattagcgacagtgttgcgaaagaccaccgtggcaaagtccttatctgacatatccgtctgcagctcctgggacctccttctgcgtgcccgccacggcagtcttcaagcacccacttgggcactggtgggaggtcttcagctcctgcagctccttcttcgtgtccgccacactgg

SEQ ID NO: 99264 - DNA, 526 bp, Triticum aestivum
  unsure (1)..(526): unsure at all n locations
  Clone ID: PAT_TA_99264
gaggaactcaacgccgtattcgcctgcctcccgctggcggcgctcgtcggctgcgagggtagtaacaagaacaagaagaagaagatcctgtgcgtgcacggcgggctctcgccggagctcgagagcccggaccagatccgccagatcaagcgcccgctggccgacgtccccgagcacgggctcgtgtgcgacctgctgtggtcggaccccgccgcggacggcgacgattgggggtggggggacccgcgcaggtgcacgtccttcaccttcggcgccgacgtggtggaggagttctgcgagaggcacgggctggccatggtgtgcagggcgcacgaagatgaaggacggcgggtacgaccaagggttcgccggcgggaaagcttgtcaccgtgttctctgcacccaactactgcggcaagtgcggcaacgacggcgccgtcatgaccgtcgccggtganctcgcctgctccttccgcgtcttcaacctgagaatactggcaatcctcctccgggtcctantttcttt

SEQ ID NO: 99265 - DNA, 315 bp, Triticum aestivum
  unsure (1)..(315): unsure at all n locations
  Clone ID: PAT_TA_99265
gtcgtgcgtggaactgaaccgagctaagtaaggagctatcgtgagtttggcgtgtgcagaaatatagcgtatatttcgtactggtttctgttataacccagccgtgtggttgggctacactcctttcgtgtgcacatgagttgtccacgtgcatttggaacggcgagaggcctcacccaccagggctagagtggtagacgatgcataacttggcagttaaaagacggtttgctatttctagaaagggttaattatccttttgctctaaaaaaaaaaaaaaaaaaaaaaaaaaaaaaaaaaaaaaaaaaaaaaaan

SEQ ID NO: 99266 - DNA, 260 bp, Triticum aestivum
  Clone ID: PAT_TA_99266
gtgagctcaagctccatgttcaaggatcaactcatgaggtactgaggtgacaactgatgacaagttcagaggaatgcatgctgatatattgtaccacatgcagcttttaactggatagatctcctagcacttcatccgtctagtgttggacctttgagtttgatatatatatggaccttttcctctctgtatgatcatcggccatatgattatatagaagctgcttggttatatataaaaaaaaaaaaaaaaaaaaaaaa

SEQ ID NO: 99267 - DNA, 536 bp, Triticum aestivum
  unsure (1)..(536): unsure at all n locations
  Clone ID: PAT_TA_99267
aacaaaccctccctcgccttcccaggccccttccccttcccctccgccctctcctcttcggcggcaaattcaagctcgggagctcgcaaccgtgggagtacatatttctctagggttttagcgggcccgcgaaggagcggacttaggcggagccttcctgatggcggccgcgaaggcagatgcaaaggcggaaccaaatggcggcggcggcggcggcggcggcggctcgttcaccgaggagaggctctccgagaagctcaataagctcagcagctcagcggcgagcatccagacactttcaaattggtgcatatttcatcgaaagagagccagaagggttgtcgatacatggcagaggcagtttaataatgcaacaaccgataagaaagtatcattcctgtatctgtcaaatgacatcctgcaaaacagcaaacgcaagggaggagaatttgtgaatgagttctggaggattcttcctgggttactgaaagatttctacgnaaaatgggggacaagatgggaangaaagtnatggg

SEQ ID NO: 99268 - DNA, 524 bp, Triticum aestivum
  unsure (1)..(524): unsure at all n locations
  Clone ID: PAT_TA_99268
gccagcctcagctcacccgaagcaaagccagctagcacgcagcgcgcgatggcggccgcgaccatggcgctctcctccccggcgatggccggcaccccggtgaaggcctccagggcggcgcccttcgtcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgaagtgctcgnccgcaacggggtcaaagttcggcgagggcgtctgggtcaagggcgggtccanattttcaagcgaagggcgggctcnantacctcgggaaacccaagctgggtgcaaggngcanagcatcn

SEQ ID NO: 99269 - DNA, 522 bp, Triticum aestivum
  unsure (1)..(522): unsure at all n locations
  Clone ID: PAT_TA_99269
cgcagcgcctcatccccttccctgacaccgccgccgccgccgccgctgaagggatctcaggcagcggcgcccttccctcctcttgctcgctctgcacctagctaggcgattgcgcaaccctctcctcctttgtccctccttttttacctccggctccttgtgctacctccccatggcgcctccctgtcccgttgttccatgaaggtcgaaggtgtgacaaagatgagaggatgagcacgggaggatgggaagacgagtcgatctggagcaaggcggggacttcccagccgccaatgtattcctccccgtcaccttcgacgagtcgagctggagcaaggtggntgggtgctcatctgcaggtcatgaccactggtgatgtcctctcctccaatggaagttgatgtcaaatcccctcctcgaaggtgacaatctactcaagcanatttgcttctccgggtaaaaacatttgtgcgaatgangcaanatgagatattanggaaggaaagctaaaggtcaaggtat

SEQ ID NO: 99270 - DNA, 533 bp, Triticum aestivum
  unsure (1)..(533): unsure at all n locations
  Clone ID: PAT_TA_99270
gctcaccgcaacccatgtagccggacatggaggtcccaacgatgtccggtatgactcacgtgttgtcggatggcagtcaggtcccagtggaggtaggtcgctgatgacaagacgctctggaatcatatgcttggcagatcagcgacactggttacctgacataaacatctgacgtaatccacatcccaccagttagcaggtatcaaccaaaagaagcaatatacatcttgacaagctctgggacctgcttccatcgcggcagctgctgacctccatggagaacaagcacatggagcttccatggcttcccgtgtgtggttgtggagaaggagccttcatgacggcgtgacagagcaatcagactgcatctgtcgaggccattgacgaatccacttgatctggacgccgccaacctaaggcgaggtgaggtgaggaagagacggtcgcgtcgtcgaccgagcacaagcatgtggaggggaagtcgtcatcatcaaggtgancgtggcnggntaaatttaaaagccgctaactgg

SEQ ID NO: 99271 - DNA, 337 bp, Triticum aestivum
  Clone ID: PAT_TA_99271
aagcaacactagttaacaccaatccacaatgaagaccttcctcgtctttgccctcctcgctcttgcggcggcaagtgccgttgcgcaaatttcacagcaacaacaagcaccgccattttcgcagcaacaacaaccaccattttcacagcaacaacaaccaccattttcgcagcaacaacaatcaccattttcgcaacaacaacgccacccaccataagaaaatcatgaacatattgcaaaccctacagcggggatccctcacgcttgcgcgacatggagagcaccataggacaacaccaataataaaacatgcaactcaaaccaatcatagaaatta

SEQ ID NO: 99272 - DNA, 509 bp, Triticum aestivum
  unsure (1)..(509): unsure at all n locations
  Clone ID: PAT_TA_99272
cttcttgtcaatcaatcaatcaaatctcaaacacaaggaagaaacaagagatgatggaaacctttcttcttcatcacaagaaggcaaaagcaggatccatggcaggatccggcgaccctgccctcggatctacacaacttccttgttatggctggccgtcagtggcacatccagatgtgttggtgcatcccttctgcctttctgatgtcaaagtgcatcccttcttcctttctgatgtcaaagtttggttcagacagaaaagcttatcgtcagagagaagcagcaggcagacagagaaacagccaattcagcccaagagtccgagcccgagctcaccatccagcccaggagagcccaccatcttcaaaaaaggggaggnccatcgaatcccgaggnctcaacctataantacaaccgnaaagccctaaaccaacancgggtcctctttcccaattcngncccccggccgcccgggtgaggtgagctcccccgcccgggatggnaacccg

SEQ ID NO: 99273 - DNA, 495 bp, Triticum aestivum
  unsure (1)..(495): unsure at all n locations
  Clone ID: PAT_TA_99273
ggagcacttgataaagggagagagatacacacttatatagaagagaagagtgtaacaacagacgtatggcttgaaagtgccctggtggatatgtatgcaaaatgtggttgcactgatacagcttctcaaatattcagtacaatgcagcacaagcgaaccctcacatggaatgctatgattggaggtcttgccagcaatggacagggaaaagaagcagtggagcactttgaacaaatgctgaagctaagagacccaaagcctgatgctatcactctaaaggtagttcttggtgcctgtgcacatgtaggaatggttgatgaggggctgcattacttctatttgatgttgagccttggtatttgtccctgatattgaagcactatggttgcgtagtaagacctcctgagtagagctgggggctgctagaccaaagcatatagtttatcaangaagatggcaatacaagcccaatccaagttaattttggggatnncc

SEQ ID NO: 99274 - DNA, 440 bp, Triticum aestivum
  unsure (1)..(440): unsure at all n locations
  Clone ID: PAT_TA_99274
gctgaggcaacccgtgaggagaatgtgtacatggccaagctcgccgagcaggctgagcgttatgaggaaatggtcgaattcatggagaaggtggccaagaccgctgatgtaggtgagctcactgttgaggagcgcaacctgctctctgtggcttacaagaatgtgattggtgcccggagggcttcctggaggatcatctcctccattgagcagaaggaggagagccgtgggaacgangcctatgtcgcatcaatcaaggagtaccgtaccaggattgaaaccgagctcancaagatctgtgatggcatcctcaagcttctggactcccaccttgtcccctctgccactgcagcaaagtccaagggtgttctatctgaaaatgaagggtgactaccacaagtaccttgcnggagttcaaaggggggtgctgagaaggnaaa

SEQ ID NO: 99275 - DNA, 320 bp, Triticum aestivum
  unsure (1)..(320): unsure at all n locations
  Clone ID: PAT_TA_99275
aaagcactgatagagatttagctcatttaatcactttctgacaagtggggccgaattgtcaagagctgacttggcaaaacatttacatatacacccttacatcttaaaaataaaagcaatcaacccctcccccgcggacagctgctccttcctcgcgccgggcagcgggtgggcacaccggccggcgagccgcgcgacggcgcaggacatgtccctgcccacgccggtcatctccgcaaccacgagggccagcaagcggcactgtgctggaggcagagagaagaggagctgcatgagagagagagagaccngccncggcg

SEQ ID NO: 99276 - DNA, 495 bp, Triticum aestivum
  unsure (1)..(495): unsure at all n locations
  Clone ID: PAT_TA_99276
aagcaaggaagatggacgccggcaagctgaagaaggtggccgggaagaagttcggcgggccgaggaagaagtcggtgaccaggtccgtcaaggccgggctccagttccccgtcggccgcatcggtcgcttcctcaagaagggccgctacgcccagcgcgtcggctccggcgcccccgtctacctcgccgccgtcctcgagtacctcgcagccgaggtgctggagctggccgggaacgccgccaaggacaacaagaagagccgcatcgtgcccaggcacctgctgctggccatccgcancgaccaggagctcgggaggctgctgtccggcgtcaccatcgcccacggcggcgtcatccccaacatcaacccggtgctgctccccaagaaggncgnccgagaaaggctgagaaaggccggcancgcccgccaangtcgcccaagnaagggcaaccaaagtcccccaaagaaaagccancaaaggcgttanaatgttt

SEQ ID NO: 99277 - DNA, 449 bp, Triticum aestivum
  Clone ID: PAT_TA_99277
acggccagaaggccgtcaagaacagcgccttccccaggagctactaccggtgcacgcaccacacgtgcaacgtgaagaagcaggtgcagcggctggccaaggacacgagcatcgtggtgaccacgtacgagggcgtccacaaccacccctgcgagaagctcatggaggcactcaaccccatcctcaggcagcttcagttcctctcgcagctctaaccaaacaaccgtctgcatgtggaggaacgcgtacgagagtacgtacgtgacctacagcccagcatactcagtccgggaagagaagggaataacatgtcctacctcccaattactcactatacaacagctgatctctctccatatgtgttatatgtacttactcttgtttacatgcacgtagagatgaagacgcatgtgcaaatacatgatacatatatatatagtcgtccttgt

SEQ ID NO: 99278 - DNA, 506 bp, Triticum aestivum
  unsure (1)..(506): unsure at all n locations
  Clone ID: PAT_TA_99278
gccaacccttctgtcgccgtcgccgctggccttggcaattctttggcttttcattgggtcggcatcgatgggaaccatctctttccttctttttaagtgtggacatacagagatctccgaccttctcggctacgcggctctcttgtgcacgttcatgtgggaagccctcgtctatgtccgcgctgcagtggcgctgtggaggatgaatcccgggccaagcaacatggtggctgcagagtagcccttgcgccggatcatcgacttactaaggtgcgcaggatttcaagccgaaagctccaaggtgatggagagtgctacgcagtgcaggagcgctgctgtttgcctgtttcctacatcctttgatgctgttctgaataaaagagcgatgcccgtgtgatgttgtaatgatctactagtacaatactaagcctaataagtatgangcttgcttcagttgatgctaagttcancgccgccctgaatgcaagtgactgcaattgctatng

SEQ ID NO: 99279 - DNA, 499 bp, Triticum aestivum
  unsure (1)..(499): unsure at all n locations
  Clone ID: PAT_TA_99279
ccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcaagcaacaatgttgccaacaactagcacaagattcctcgccagctccagtgtgcagccatccatagcgtcgtgcattccatcgtcatgcagcaagaacaacaacaaggnatacagatnctccgggcactgtttcagctcgtccaagggcagggnatcatccaaactcaacaaacaagctcaatatgagggngntnaagatnaattgggnattgggaacccntccaaacaatgttgcaacgggtntngtccgacctggactggg

SEQ ID NO: 99280 - DNA, 464 bp, Triticum aestivum
  unsure (1)..(464): unsure at all n locations
  Clone ID: PAT_TA_99280
cgaccgcaggcatggttgggctacgccttgggggaggtatcataagcactgtcgcgtataagacagtagcagatggtcgtatcgccttcaacaaggatgggtgtggtaggaattcatggaggagaacgacctaaaggttggcagagcggtgctaatcaccatcaggaacagtgcactggacgaactgacacatgatggttgtcgtcaacccgatctaagatgaccatcagggtcaatgctaaagttgtcaccgccttttgttctgctgtgtgttaactatgtggcgccgcagtttgatgaactatgtttgttttcctcttaatttgttattgcggtgggatgcacccgtcaaaaaagtatgtaatatggagtctgaaactttttttaaaaaaaaaaaaaaaaaactcnaggggggggccgggtacccaattcncccctanagtgagtccgtnttncgcgccccc

SEQ ID NO: 99281 - DNA, 469 bp, Triticum aestivum
  Clone ID: PAT_TA_99281
ccggagctgatctcctggactcctcctacctgatcgatccccctttcttcctccttctacctgcttccgttcctcctccttctcttctagatccaccgcaaccaggcacgttacatctggtattagaggtccagcgatcttcctactgggagaccgcctatcccaagccccgctatcaaacgaagcaagcaagacaggcggcggagatggagtagcagatcgcagctcttgccaaggccgtcaacgacgggcgcatcgccaacgaggcaaggccaagatgcgatccaagacttctctggagctgtggcgccccgccgtcacccacatccagaggcaggtggacgacctgcgtgcgcaggtggggcgcatcgctctccaccccgtgctggcggcgcctccggatccgatcccggagggcgacgcggtggtgcggccgggcgtccagttcgaaccacgacgctcccgaaac

SEQ ID NO: 99282 - DNA, 476 bp, Triticum aestivum
  Clone ID: PAT_TA_99282
ttttttttttttttactctgtaaatgtcctttctcccttcttaaatggaaaagcgcgcaatgctcttgcgtgtgcttgaaaaaaaattaattgctactccacatgaagtcctaacttcttcggaccaatttgagatgaccagcacaactgctataaaaaaaggcggctggtacgcatcatccggttgatctttcggaaagatcaaccgcctgcggagccgtctgattcaagctcgcgtagtcgttcgatccaaacgatgtgggacgcttctctcttccccctttctcgcatctacgccaaggaaaaagcccagcgatgaaacactgcgccaactctctgcaagcagcgacgccggccatcggcctgcatcgtcggagacaccatgagactttgcaagcgccgccccaccgttgatgcagtgcaagcagcaccgctggctccggcgacactaagtgcctccaaccgcaagcaacggg

SEQ ID NO: 99283 - DNA, 464 bp, Triticum aestivum
  unsure (1)..(464): unsure at all n locations
  Clone ID: PAT_TA_99283
ttttttttttttggtgaaaatatattacgcttttggaataattgcccacttgccaaaacaagaaatacacacacaacctccgttgtgccgtctacatcattttcagagatgtcttacaacggatcggcaaagagcatgcacataatttggatttccttccattatttgaggaatataataaaaataaaaagacatgcatatcaagtagacagtctatagatggatcatctatgtgttgtgatgtgaacttcgagcttcattccgccctcacagtctccaggtttgctgctgatggcgtacatggggccttggctactgagctcgagcttgtcgtagccagaggtatatgtatcgtccccgacagcaccagccctgcagaagaactcctcgtctttattcactatcaccacgttatgcatcttcggattatacttgaacacaagcacgtcaccaggggnagaagg

SEQ ID NO: 99284 - DNA, 238 bp, Triticum aestivum
  unsure (1)..(238): unsure at all n locations
  Clone ID: PAT_TA_99284
gtcacaannagctcaatctctttctccttttcttttctctgccccctcccttatccccangcccangaaacncgtctccggaggaggaagggaanatttcacacttttttgccccaatcacgtttcntcaagaantccgacgagggatgtctctcaatnantctgagtcgcaagcggtcatacacgaggtgatcgcggaacganggagattcaanaantcttcgtgggaagttcccaa

SEQ ID NO: 99285 - DNA, 452 bp, Triticum aestivum
  Clone ID: PAT_TA_99285
ctctcttcctcacccacgcgttcgccaatggcgacgaccctggtgagacgtgtggagtcgtgggtgcgggaccagggggcgcggctgccaccctgggtgccacctatcgccgtgccgcggtggccctggcccccgccgtgggcgcccgcgtggccgggcgaccgccggcgccagagggagcgcatgttccgcgaggagtttgagcgccgccgcatccaagcttcgcgagctctgccgcgccgttcgcgtcgacaccatcgccgagctgcaggagctgctctgcgccatggtcctcgccgagtgcgtctacaaggttccctaacctccccccttccctagtcgccttgcgtttgtgtgatatggttccggtggttagatagattcggaacgctggtacgtacgaatgatgtggtgcaaagtggggaagatgaaactgtcacacctgatacatc

SEQ ID NO: 99286 - DNA, 467 bp, Triticum aestivum
  unsure (1)..(467): unsure at all n locations
  Clone ID: PAT_TA_99286
acacgaaccaccatacatcccacgcactaccgtctgtgctgtgatggaatttcaacccgcgactgccaacgctgcggcgaagcactgggtgctgccgcgcgccgctgtggtgaagcatcgagccggagttggaggagacgctgtcgtgctgcgtgaagagcgccgtctccggtgtctcgatggtggagctgcaatgcaatacaacccgcggatgtcgaggcggcggaagctgcaacgcagcatccatggtgctgctctcgccggtgacgaagcttcaacgcagcatccatggcgttgctcgctggcgacgaagcttcgacgcagcatcgatgaagcttcaactctgcatcgatggtgcttcaacgcagcatccatggtgctgctcaccggcgagtaagcttcaacgcagcatccatggcattgcctgccggcgacgaagcttcaacgtancatcnacggtgcttcaa

SEQ ID NO: 99287 - DNA, 569 bp, Triticum aestivum
  unsure (1)..(569): unsure at all n locations
  Clone ID: PAT_TA_99287
gcgagagggcctaagctgccccctccgccgacgccgttagtgagtcggaatgagttgattctggttgtagtttgttcctaattgctgtgctaggtctctctgcttttgtgtaagaaagaaatatgggttgttggtacaagcaaaaaaaaaaaaaaaagggggggcccgggtacccaaattcgccctataagtgaagtcgtattacgccgcgctcactgggccgtcgttttacaaacgtcgtggactgggggaaaaaacccttgggcgttacccaaacttaaatccgccctttgcaagcacatcccccccttttccgccaagctggccgtaaataancgaaaagaagggccccggcaaccggaatnggccccttccccaaacaagnttgcgccaagccctggaaatnggccgaaatgggggaaccncgcccctggtaagcgggcggcaattaaancnccngccggggtgttgggtgggtttacgccccaaagcgttgaaccggctacaantttgcccaaacggnccctnaancggcccggctcccttttcgccttttccttccccttcct

SEQ ID NO: 99288 - DNA, 605 bp, Triticum aestivum
  unsure (1)..(605): unsure at all n locations
  Clone ID: PAT_TA_99288
gtctccttccctccctccctatcgtctgttggcttcgggncgaaaagctcccctgttccctggccctgctccgcccctcctccgtccccgggnctccgctcccgctctcggtattttggatggcctcgcctaacgaacgcccggacgaaagtccacccgggcgcccaagggaggaaagcccgcgggccccgccaagtcgctcatccggggatntcccaagtccatccccggggcggggcggggaagaaggcccctgaaggcgtcaaagtccgcccggaaacggggncggcaacgggaaacaacggggcaagggaacgaacaagcgngggggcgggnccggacaaaagttccaagggtccgaatggctcaatgttccaatctccaaaccangtccncccgggaaggggcggcggcccaagccccaacgcccggttgcccccggcnaacaagcnaaatggcccgctttaanggttttaaagcctttggaattctttaagtccctggttaaataagntaacttgatttaagccccttgcaagcctggcaagcttgttcgaattatggttttgcaagggctcctttgtngttgggcggccccctaaant

SEQ ID NO: 99289 - DNA, 227 bp, Triticum aestivum
  unsure (1)..(227): unsure at all n locations
  Clone ID: PAT_TA_99289
gcccccctccgatctcgccgataaatctcctccgatcnaagcgangccaagggntctctcgtcctcctcccgcaagatgcacgatcttcgtgaanacccttaccggcaagaccatcacccttgaggtcgagtccctctnacaccatctanaacgtcaagggaaagatccatgacaaggagggcaatnccccgggaccaagcaagcggtctcatctttgntggcaagc

SEQ ID NO: 99290 - DNA, 507 bp, Triticum aestivum
  unsure (1)..(507): unsure at all n locations
  Clone ID: PAT_TA_99290
nggagaagagcgcgtccgccaagaagctgtcgcaaaggccgccgtccctgggcgaggtggagtccccgccgcggccgcccaagaccaggggccggctcaatcctcgccgggctgacaagtgctcctttccccccaaggccaagacccccccgtcaagcaccaccaccggtcaagaaagaaaggaaagaaaattacccgacccgcttaaattacttacaagccaaggccaagggcaggccaagtgacatatatgggggtttgtgttttttgtttgaaccccttgcgccttttgggtggggtggctggcggtttgcgaaccaatgggtttttttgcggcctggcaagccgggcaagcangccctggtaatccgggttggaaccgaaacnattgtattaagggtttaagaaagaacngggactgaaangggggaaaaatggtnggggccaagttgccctggcccgggggctaatttggggangttaactggntngccttccccaanggct

SEQ ID NO: 99291 - DNA, 650 bp, Triticum aestivum
  unsure (1)..(650): unsure at all n locations
  Clone ID: PAT_TA_99291
aaattggattcncgcccggcggngcctagaacantggntccccgggctggnggaaatcgggacnagggtgccgccgctggcccagcgcctccaaccnanctccccngnctcctccaaaagtccggncaaaggtggtcacntctccagccctcctccnatattccctcaccatccanaccaatcnacattccctgtcctttgcgtcntccaaagactgcaagcaatggngcctccgggccgctgcgggcatcggcngatgactgggtgcgccgagcccgaccaantttaaacggngggcantngcaacgccgggaatcaagcaagcaanggtcggggcnggccacttggantgggggaaagaanctaaagggatnatncaagaaagccattttgngaattgttatgccnaagnctttggaangctggcctgttntttaaaanggggnattttggcnagtaactaatccaaagggatnatcanacnaaaggcttttgngatgctatcgcanagcctttggggggccncccngntttcaaaatngttcaangcctttggatggggtttgtccnttttgaagcctnnttggtttctaacgttggtnaaacccctttaaagttctggttgggccngttaccgnggcctaanttan

SEQ ID NO: 99292 - DNA, 478 bp, Triticum aestivum
  unsure (1)..(478): unsure at all n locations
  Clone ID: PAT_TA_99292
caattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccatttccccagtcacagcaaccacaacaaccttttccccagccccaacaaccgcaacaatcattcccccagcaacaacaaccgttgattcagccatatctacaacaacagatgaacccttgcaagaattatctcttacagcaatgcaaccctggtgtcattggtgtcatccctcgtgtcaatgatcttgccacgaagtgattgccaggtgatgcagcaacaatgttgccaacaacctagcacagattcctcgncaagctccaagtgtgnnngccatccaatagcgtcgtgcattccatcggtcaatggcaggcaangaaca

SEQ ID NO: 99293 - DNA, 351 bp, Triticum aestivum
  Clone ID: PAT_TA_99293
ctgaagtgcagcacggatccctgcattggaagatccaagtcaaccgtgtcgcgtttaaagggttggattgttgaacagcattcaaccccgtcattttcacgaggcatggccgtcctcagggcgtgctgggacgtgtgctctgctcgcgtgctgttgctcatgatgcaccttgcgtcgtttgctcggcgcggtacctatatccgtatctactgtatatatagtgttcgaagctagcaccatttactgaattcatgcatgtactcttttgcacctggtatctttgttcaattggagctggtagggaatacatttggccctgatggttctgtgttaaaaaaaaaaaaaaaaaaa

SEQ ID NO: 99294 - DNA, 294 bp, Triticum aestivum
  unsure (1)..(294): unsure at all n locations
  Clone ID: PAT_TA_99294
gattcctctattcgattcgaccagcgccgccgccgaagcccgaggaggagaggaggaaatggggatggtgtncagtggggncgacnntcgantccctcgtngaccaaagtgatntccgtcatcactaangnagggcgnaacatcgtgcnggactcttcgnnggttcagatcangccaccancatcatcctcnacgagtcccacnagagggtcnactcnantaaggagggangtncatnagcttgccctcngactgtncatcatcaggggcnacacaataangntcncaccgtgt

SEQ ID NO: 99295 - DNA, 331 bp, Triticum aestivum
  Clone ID: PAT_TA_99295
ccggcgttgggacgagacgtcaccgtcgactacgaggcacctacggtgacttcgtaaaatctcaagatgatatgtcggctcagtctctcagaggtgctcataggggtagggtgtgcatgtgtgcgtttataagggtgagtttatgcgcgtatatatgagcgcttgcgtctgtactgtgttcaaaaaaaagttttaattctgtcatgcacttttgtccttgttttagctcctgttggttgcgtgtaagaaaaaagcaagtaaatttgcgtattgaaagatggcaaagttaaattttgtagaatttgtttatacatgtccaatggcaaatttt

SEQ ID NO: 99296 - DNA, 447 bp, Triticum aestivum
  unsure (1)..(447): unsure at all n locations
  Clone ID: PAT_TA_99296
attggtgttaacctttctataccaaggtactacctaggataaattcttctagaaaagcaaaatcctttgggagttctgcaattacaacatgtgctgccagcactatactaacccctttggccgcctccccatgcacacacgcaaagagattaaaaaggttttgcaaatacaacatgcactcccaacactatataaaccctgccctcctcctcctgctcctcctgcacatacggtatttgaatcctctcaaagacaaacgatcaggcaccacctttgccacctgaccgtgcttgcaatggaaattccaggggcatcatctcggtgctccatggccatgtcgtcaacctcactgctaaagcgatcctgtggcatagcacaagtcgcgaaaagggtgccgctacgacccanagagagccggcgtcgggattgtctcggctattatggaac

SEQ ID NO: 99297 - DNA, 455 bp, Triticum aestivum
  unsure (1)..(455): unsure at all n locations
  Clone ID: PAT_TA_99297
gctaggtcttcgcggaatggggaccgtggggaagctcagcgccgatctgatgcgccggctggttggatccagatatgcagcgacaaagcacccaggagttgtggccaacgcgaatatcaaggttgcgaaggaggcatgggagcaaagagagaatgttggcgtgaagatggttcacaactttaatcccactgcaaagctcgtgttgggagctatcattgttgttgcagcagttaaatcggtccttgcggagtcaacaaagccctaggaaaggaaggggcaccattctcagatttgtcatnanaattcaaaagaagggtgaaggagaancnncaagaagagcaccttatgcatgcangtaggctcttccttgctgctaaagcaagcaaaggagccccagtaagatgtttagttcctcctccactggggaaaggggcngganggggatttttnttttt

SEQ ID NO: 99298 - DNA, 307 bp, Triticum aestivum
  Clone ID: PAT_TA_99298
gcgacggcggcgaaactcctggatcccttcgagggggtcaagatcctgctgctccggagcccccggagagggggaaaccatcgccatcgtcatcacctttcctccttggcgtgtgaggaggcctctacatcatcaccatcaccaagaccaagcaccatctccatcaccatccctgtgatccatctcgttcccctcatagtttgagagctgctataccctagatcattgtcttgtgctcctattcatgttaagtgattgggtacttgtcattatttggtggtgaagttataatttcagattgtgttgt

SEQ ID NO: 99299 - DNA, 446 bp, Triticum aestivum
  Clone ID: PAT_TA_99299
accacaaaatctgcacggtgagcaccgcaacgagcaccctcctccacgtcaatgccgattgacaagttcatcatgggaggcaatgacaaagggatgtcgcctttgacgggaagggcaaagggagcgcctcggggaagaagggcaagctgacgctataaatcagactcgaggggatgcaggcaaacaaactatgtgcaaaatttggttttgacatgtattcactcatccagactgagtcgggatatgcaaagtgcccaaaatagatgcagataaccaaacaactccttaacacatagccagagaggaagtgagcattggagaacccagtataagaaagaactcggcgctgatcaaatgatccttgcgcaagtcacatccattacgcaaaagaagccaggatagttaccacttgcaatagttaagaatgtcaaaatatacaggaaaca

SEQ ID NO: 99300 - DNA, 448 bp, Triticum aestivum
  Clone ID: PAT_TA_99300
aaaaggaaataaacttccgcccctctctcccacgctacctctgttccgccgccgccgccacctcccatccaagatcctccggctctgtcgtgcatgccaccggaggaagggccccttccgagacccgcttctccgccaagtcaattcgtgtgggagcctctcccctcggtgcgcagcgccggagagagcgacaaggaggtccagcagtctatgctgccatcgtcctacctcgtcgtgtggcgtcaaagacaaggacgaggaggttgagcagtccgtgctgtcttcgccatcgcctgatctggttaaagttggagcatccatggcctgcgcaaatcatcaatcatcatgttcgatgtcacctctcggttaaactacaagaacgttcccacatggcagagacatttgcaggtacaagcggggcggggcatatctgcgcaagttggatggg

SEQ ID NO: 99301 - DNA, 454 bp, Triticum aestivum
  unsure (1)..(454): unsure at all n locations
  Clone ID: PAT_TA_99301
ccaccttcccgaagcttccgcctccacacaccggaatccaaacccccaccgacccaaccccactccctccctcaccgccctccagggttctgcggccgcgctccatggcgaaggggaggcgccgcgccgtcgccgccggcggcggccggccccgcgggggcgggtctgccggagcggcggccgcttcggggagcaaggactacatctccgccggcgtcaacctcatggggcgcccacctcgggatgcgncgcatgaacancgagcagtnggaggcgattaaacgcgtcatcnaagtcctcggacgtcntcgacccccgaccgcgccatgaggatgtttggacaatgtgaatgcgaacgaacaacgattcgtcggacaacnaaggagatggaggactatgggccgctgcaccaagcggcccggcaccggggaagattgacaactgcaaatanctt

SEQ ID NO: 99302 - DNA, 561 bp, Triticum aestivum
  unsure (1)..(561): unsure at all n locations
  Clone ID: PAT_TA_99302
tgtacgnccccccctcgaggancgggtgggtggncagcaaggcagcatcgggtgaaagctccgcctttagctaatggtcagggtaggcaacggagacgcacttaggcatcgctttcttcttgaaggcaccatcaaggatctagaggttggtgctctccgatggcggtggacgtcactcggtcacggtggcacgacgtcttcaatcctgacgaaagggggtagggatccccttcccgacgatagtggcctgacggaagttgaagtcacctcgttaccaatgtcgtcgatgctctatcccccttgcctctcttcgtctttgctcggtgccctgctgcctcgtcttcggcgtctggattccgaaagctctccttctccaactagttgggcatggacagcggcggtgctgctggctaggtttagcccgaatctaggtggtcgcccattgtccaccatgcgatgtgagggggnattcttccagccctaatcccgaagatgcggcatctttcgatncaaggcgagggggtagggtcccccctttggtgaatagagaaagnaanatgt

SEQ ID NO: 99303 - DNA, 575 bp, Triticum aestivum
  unsure (1)..(575): unsure at all n locations
  Clone ID: PAT_TA_99303
ttggtacggccccccccttttttngacggaaacagccncatacaatacagtccctcactgaattcacatgcataactattccaggttacatatctagcacagcacgcacaatgattgagtaacaatattacaccatgaccggctatacacggaggccagaacccttgaacctggcctcggtaatggcgtcaatcctccctgccgtctctcgcgacagatagttctcccagtccccgacctggccacgccggaagaaccaactattctcagccatgctgacaacgagctctgtcttgccatgcctggccacgtcgagcccagtcatgtgctcaaacgagcacaaccttacgattgcttctaccgcgccagcctcttcctcctccatgcaagaacgggcggccaacgaattgcgccaagcttccgcacgtgtgccgcagggtccccaatcatctcttcgtacctgaagaaagagaanctttctgagggtggcgcctggatgaagccccgcccagtnttccgngggacattgatncccagtncgggncccgaacnaaangtccccaacaatcaaaang

SEQ ID NO: 99304 - DNA, 573 bp, Triticum aestivum
  unsure (1)..(573): unsure at all n locations
  Clone ID: PAT_TA_99304
tggtacggcccccccctcgagtntttttttttttttttttttaaaatactaatatcactggaggaattcattgatacagcactaactcgcgggctgcaaaacggcaccgctaatgctgttgaagaggtcatgtcatgcaatgccatacattcaggccatcaggaggtccccggttctcgcctcaacacacatacaattacctaacgtcataataatatttttatacccaataccgggcgggcaggccaggttacttgccgtagatgcacaggcccacctcgtagctcaccaggagcattattgctgacaggaaaaagagacagaagccgccgcgcagcaccgcagtcactgtgttgcagccaccacagtgtatgcggttatcaggctggaaacctgtggagaagacaagctccatgtcttcatccttctggaacgaccacttgccttgtcgaagaancaacaagttaaagcttcctatggctggattacttcgggtagacacgctgatgggngttaagggtggaacaccanacaaaggattttgcctggggaactcctgctncnanaagcaag

SEQ ID NO: 99305 - DNA, 506 bp, Triticum aestivum
  unsure (1)..(506): unsure at all n locations
  Clone ID: PAT_TA_99305
cccccccgcctaangagaactgctgnctgcaaaagctggcctgcgccatcgggacgcccgacgtgcccacccggtacgtcgtgcgcgggcaccaggaccagcagctcgccacgacggccgtagcgccggtccctgttatcaacctcggcctcctttccaagcaggacggcggcgctgccgatgaggcggcgaagctccggtcagctatcgattcctggggcctcttcctgatcagtaaccacggcgtagacgcggccgtgatggacggcatgatggccgcatgcagggagtttttccggcaaccgcttgaagagaagcagaggcaaagcaacctgatcggagatgatcagtacgaggggtacgggaactacnaggggtatgggaacgaacaggtntcctcgccgggaccagaccctcgactgggactgaccggctctacctcaagggtggagcccgnaggacgagccgcgcattgccctctggccaancgcatccccaaagcntca

SEQ ID NO: 99306 - DNA, 531 bp, Triticum aestivum
  unsure (1)..(531): unsure at all n locations
  Clone ID: PAT_TA_99306
tacggccccccctctgagcgaaaatcaggaggcggnccaccgtgagcacgcacacgggcgtgtcgtccaggaccgtctccgcgacgcgggacttgcggaggccggtgtcgagcgacacgtcgtcgccgcgggccaccaccgacacgttgtacttcccgcccgcggtggacgccagcgtgcggaacggccgggccgacgccttcaccagcttcagcgacggcctcgggttgtaccccggcagcgcgtggtaccgcagcagcgcgacgaggtcggcgcggggcatcttgtccacgtccggcgcgcccttggccaggaacgcgtcgtccttgggcgcgaacagggtgaagcccggncttgtccgccatggccgcctggtagtccttgagcacgcccgtgctggcgaagaacgccgccaaacgctttgcangccggccttccccaagcaagcggggtgaaggttggcgaatggaccgnccctncaaanaagggcgtncnactncgatggggggccgaacaccttcangaaccggc

SEQ ID NO: 99307 - DNA, 475 bp, Triticum aestivum
  unsure (1)..(475): unsure at all n locations
  Clone ID: PAT_TA_99307
gtacggcccccccccnaaacganaggccacggcggccgcggggaaagaaccgtgtccgtgctctgtggtctggacgcggtcaccggcggcggcggccgagcacaagagaaggcagcggagctcgaagcatcggaaggaggcggccaggtacaagaagagatgcgaggaattcgagcgtcttgccaagtactggaccctctacgtcgtgctggctgccgtgttcgtgctcgcggcgctctgcctccgccattggagctccctcgccgcccaggtctgcgcggtcatggcggccgtgtggatgcttggcgtcgccagggtcaacacactccttcgacgggtcttctcacggggacgacttgttcagggcccgattatgacgaagccgtggggactaggaaagcgggcaacngaaaagcaagagattctgttttgggagcaaaaaagaagcgggctcttgtgtccttggacgcaaata

SEQ ID NO: 99308 - DNA, 605 bp, Triticum aestivum
  unsure (1)..(605): unsure at all n locations
  Clone ID: PAT_TA_99308
tacggcccccccctttttttntttttttttttttacttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttttttgacctcctccacctcgttgatcacctgtgtggcgtccggtgcacccgaaacaataagggcaagcttccaacaattgtncaagttaccggggccaatnaattagtaacccaaggangaatggccgttggtgcctcaacggaangattgaaccccaaccctttgctggaacctccgagggnaaggnancccacctttggggccgggntnaagatantncnaccctngc

SEQ ID NO: 99309 - DNA, 633 bp, Triticum aestivum
  unsure (1)..(633): unsure at all n locations
  Clone ID: PAT_TA_99309
gtacggcccccccctcgagntanttttttttttttctttttttagcacttaaattggctgtgagtttcattaagccaacatttcaaagctgccaacttttgtaatttcacgtacaccatgcagattacattacagataaccatgatcaattaccccagtcgctaatgcaaattcaccaaaagagctactagtggattccgctcgaagagatggagcgcactgcgtacaaagtaacctaggggtgttcaaatggcgagatgaccaagccgaggcatcgccattgccaaaactaacatgcacgcctgacttacttaggcctacttaattacttaattctctgcgtcgagctagctagttgaacacggacagcggcatcatgcaccctgcaagcgtgcgcctcggcgggnggggtggccgcgggccgccaatcaacaatcancgatgtcaatccccggggggggaactaacccaatccnngggctcccaacggggggtcncccgncgggcggccggcgccaagggaagtgcccctgggaacaaggtggcgccgttggaatggggaaanaggtantggcggtcctgnctccaagcatggccangcccgcaatggtccgggcctggccaacgggcggg

SEQ ID NO: 99310 - DNA, 559 bp, Triticum aestivum
  unsure (1)..(559): unsure at all n locations
  Clone ID: PAT_TA_99310
tttttttttttccttttttttttttttttttttttttttttttttttttttttttttttttttttggcaaaaaattgncgtaatttanatcanggnagtanaacncaggntgtanaanaaacacncttgggggngtgcacgggcttcaananaacttacttgcnaccccgcaaaaaaaaagataacttacttgccgggaanaaagttgggggcaaacncccaagcgttgttgttgacggggtcagtgatgtggccagcgaggttttcaagagggcccttgcctgttacganagcttggacaaagaaaccaaacattganaacatgggganacgcccgttcttgatcnccttcaccttgagctcancgaatgcctcagggtcatcggctaaaccgagagggtccaanctgctgccangggnanagtgggtccanaatttccccaagtgggccgccggaaatgnggtaccccctcgacgggaaccatttagcaacgactttncnatgcccnaatagctaggatncttttccccnttggaannagggcggggttncccaagg

SEQ ID NO: 99311 - DNA, 480 bp, Triticum aestivum
  unsure (1)..(480): unsure at all n locations
  Clone ID: PAT_TA_99311
cggccccccctcgagttanttttttttttttcttttttttttttttttttttttttttaaancaatcgcttttgatggatgctcatgatgtacatatttatatccctagaagggatgggtcgcacaggcgcgacgtttacaagcgatggattgaaagaacgcgtcctttacaacaggacgtgncccatcaggagagcaaactgcatgacggtttgttaaacagggatttctattaattaaactaactaattaataatcctaacagagataaaggtagttgtgaaaacggtccgtacaaagcatctcccatccttcccatcgtattaggaagggcgatgataggcgccggcgcnccggnccaaatttgggccggtcaacccgcngagccgtacgaattctgcncctggcaagccggtttggttcctttcccctggccaanccttttnattcccccaacggncaangnagattnggaaaaaa

SEQ ID NO: 99312 - DNA, 597 bp, Triticum aestivum
  unsure (1)..(597): unsure at all n locations
  Clone ID: PAT_TA_99312
gtacggncccccccccagctaaaagctcnttagggcnttctcttttttcgggggagaaatctcaagaggcggcaccatgctcgtgtaccaggacaagctttccggcgacgagcttctgtcggattcgttcccgtacagggagctggagaacggcgtgctctgggaagtcgatggccattgggtcgttcaaggagcagttgatgtggacattggagccaatccctctgctgagggtggtggngatgatgagggtgttgatgaccaggccgtgaaggtggttgacattgttgacaccttccgtcttcaggagcaacctgcttttgacaagaagcagtttatctctcacatgaagcgctacatcannaacctctctgccaangcttngaaggggaatgacctacatgctttcangaaagaatgttgaggcctgccacaaaaggtctcttcttaagcaagcccaaaggaccttcaagttctttggtnggncgaacaagcatggcatgatngattggcgggcgttgcngttcgccctaccnacaaaggnaggggagctgcnngctnccaacttttcctggtnctnttgcnacatngggcctg

SEQ ID NO: 99313 - DNA, 537 bp, Triticum aestivum
  unsure (1)..(537): unsure at all n locations
  Clone ID: PAT_TA_99313
cacaggcgttcaccggcagcgagaggaactcccgccgcgctcgtcctcgtccgaggaaccgccagggagcagcgtcccgggcgcgacgccgctcgcgagtcccagcacggcgcccacggctgctcggtggcgaggccgccggcgagttgggctacgggaggccaagggccacgagggggcgactggcgacgtgcgcctgtcctcggcgaaggnggaggtctcgtgggggtcggcgagggaagaggcgtggcatacgtattcgcatccacggccgcgcagccgagggaggncgacgtgctgcccctcaggagggcagccgccaagaggcgacgaggtcaacgggcagaggtgcggttgaggcagccgtgaacaccaccttctccacggnggtgatggggtgatgaagcgactgcggcgaacgtcgttcncgataggaggcattgctctattctcacctttagcctgttttgatccggtgttctcatcccctgcncatggncggaccaaccccggntgggggntggaggcnantccnca

SEQ ID NO: 99314 - DNA, 602 bp, Triticum aestivum
  unsure (1)..(602): unsure at all n locations
  Clone ID: PAT_TA_99314
tacggnccccccntcgagcnaattttttttttncctttttttttttttttnttttttttttttttttttttttggnaagggctcatcatttttcaggtaaacgacttgctgcaantttccaggtagtancaaacaagacaccaacanctgaacaaagacaaaagtccacgagtttccccttgctgcatcaaggacaanagcaacaggcccgcttctaaaaagctctatgtgcaaaaggtaaacaccgaccaaccatttctaatttttcctttccccncctccgctcgagtcttgatacttaccggcganacaataaaaagacactcgagcggntaacttagaagaaaagncatagcttaatttcnctttcacanatgncgatctctctatatataaggcagtgcnattggnacctccngtanctacaaactctagttcancantggggcgaggngcacggggaacnanacggggagtccttaagactgggcctccacccttaattgggcaggggaaacccaagttttacccaccaccnggagttggaaancaagntngttcnatntttcangccataaacanactcccananngggaaatgc

SEQ ID NO: 99315 - DNA, 578 bp, Triticum aestivum
  unsure (1)..(578): unsure at all n locations
  Clone ID: PAT_TA_99315
cggccccccntcgcactaaactccactcatccactcgcaagctaagctagcggcgtagctcacttcagtccagtcggcatggcggctccgaggggcgcggcactggtgctggcgatggtgctcgcggcgatgctggtggccccgccggcgacggtgcacgccatatcctgctccacggtgtacagcacactgatgccgtgcctgcagtacgtgcagcagggcgggtcgccggcccggggctgctgcaccggcatccagaacctgctggccgaggccaacaacagccccgaccgccgcaccatctgcggctgcctcaagaacgtcgccaacggcncctccggcgggccctacatcacccgcgccgccgcgctcccctccaagtgcaacngtcgccctcccctacaagatcagccccagngtcgactgcaactccatncactgaaacgaaangaanccccctggcccntgtgtttgtcgacctacgtcnggccgtgtnangantcccantnttngggaaaaanaattgttgctanctaagtaatgaaagnntaacttgggcctngcggccaaattcgtgt

SEQ ID NO: 99316 - DNA, 628 bp, Triticum aestivum
  unsure (1)..(628): unsure at all n locations
  Clone ID: PAT_TA_99316
gtacggcccccccctcgagntanttttttttttttntttttttttttttttttttttttttttttttnccacacagtaataacatcncttcgcaaaccaggcaaaccgcacagagttggaagcttcatanctctgccaaactgatcgttcattacacccaangcaagcgcacaccatgcatacatatagatcaacgagtgttgagtcctgagcttgagctacttgccgatgatgttcnggnaggngtacagcttggcgcacgtaaggaagtacccgaagttgngggcgacgagcagggngagcanccagtagaggttctccagccgggacgcgttnatgttgtccggcaaccaaggtggtggcccgctggacaantttaccgagggggggggctcanggtaaaccccnacgcccncgntaagggncaaccagncccggtncccngngttcttggngcggagggggggaaanncccggggantaaaancggccccccngncccngggaaaaggnnaaaagcccnccccccccccccgggganccgggggatggggnancaaccaaacccncaatggggggnacanggngggggncncccccacccggggggccccccccctgggggnng

SEQ ID NO: 99317 - DNA, 397 bp, Triticum aestivum
  unsure (1)..(397): unsure at all n locations
  Clone ID: PAT_TA_99317
ccccccntcgagttaattttttttttgtccttttttttttttttnttttttttttttttttttttcaganattaactcattattattattacaacatatcacaatcagacaatgtcatcnattcgcttaggcaacaggcaaaaacagtctgattgatctaancganacatgggtgtcagagctccaattttcgttagacatgggtgtcagagctccaattttcgttggncatggngcccaatctttttttctgnacagttaaaacaagaccagcatccaacantgccaagaaatcatagaactgccgtttttgtcgtgtcagactgggaatcaacgccgcncctttccgcgggggnggntgacccggggcctaataagaagcgggggnggcattgtc

SEQ ID NO: 99318 - DNA, 271 bp, Triticum aestivum
  unsure (1)..(271): unsure at all n locations
  Clone ID: PAT_TA_99318
gtacggccccccccttttnttatttttttttttttctttttttttttttttttttttttttttttttttttttttttttttttttttttttttttttttttnggcacaagttcagggcncacttattcattcaagttcanccaaatcngntgcagcanagnanaaagttcanncacagccagatatancgctagaccanagnacggnagcaacaaagaacaagaccagncgngggcacgcagacaatcanaacggggtanacanaaagaca

SEQ ID NO: 99319 - DNA, 614 bp, Triticum aestivum
  unsure (1)..(614): unsure at all n locations
  Clone ID: PAT_TA_99319
tacggcccccccttttnttattttttttttttctttttttttttttttttttttttttttttttttttttttttttttnaaagaanaagacattgcttagtagtancancacaagttcatatttanacaaccattgtttccgagaagattcanaacgggggcantttttcgcccganganaaacgcanaattttgcctagngccgttttcagcagcattagtcancaaanaaaanggtaaccanancccctggnttccngcaatcctacttccncananacaggngccaccanccatcggnagnttcgntcaactccagccgntttcttcagttagnaaangctcccagtcggangatccatactttgaattgctacgcaaaatgccnncntgtccggngatgtttngagcggggcaagccacnccatcccanaggggtcctccaattcaaccccttngacaancctccatangggcaagaggcccntgggaagatnccgnggnaattttccttccaaagcccnggggnggggcaatggcgcangntggccannttnctttgggaaacaagangcggcanccctttgggggccgganannaacaacattaggtg

SEQ ID NO: 99320 - DNA, 600 bp, Triticum aestivum
  unsure (1)..(600): unsure at all n locations
  Clone ID: PAT_TA_99320
tacggccccccctcgagtttatttttttttttttntttattccgagaaatagggtggaacccccggcttcatttaattaaaatggaaccacatcgtagccagttacatatctgctcaccgacatctgcctatggcagttcagaaaagcaaaaacaaagtagaaaactgaagttccaaacattctagcacattacaaaatctaaacagaaactacatgtttcaagctttagggaaggtgtccatagctccagatcactccacaagggcatcatccacgaataacatgaatcgagggatgcttttgtatgccaataggttgagcaccgtgcagatcccatgatcatatgaacaagacatcttggcttcctgaaagaagacagtgggatgcagttgaacttgcaatttttttttttttttgcaagatatgaacttgcatgttcagccttcctgaaaagaatactagctcgtcacaacaancattttttttcccagatatgaacttgcaacaaaacatgcangatcatacctgaaaanaaaaggnacatcgcctattttaatangcacaccaagacaagaaagggcaacanactgtttgggttg

SEQ ID NO: 99321 - DNA, 440 bp, Triticum aestivum
  unsure (1)..(440): unsure at all n locations
  Clone ID: PAT_TA_99321
acggccccccctcgagttnttttttttttttttttgcatattaaccaaggtgcataacaggttcaaagatacaagggtcttacaacacaacaggttgtaaaacagacaccacaaagcaaagattcaaacagacaaataacagataaagccactcgggcagatcataggatagcagcagtagtacgccttgggaaagcaccaggaggcaggctctagtactcgtcgccctcatcaccgtcctcaccctcgtcgaactcagcaccaacttcttcatagtccttctccagggcagcaagatcctcacgggcctcaagagaactctccctcctccatgccctcacccacgtaccaagtggacgaaggcacgcttggcgtaaatgaggtcaaacttgtgggcaatgcgggagaaagacctcaacaacactgggggngttggggat

SEQ ID NO: 99322 - DNA, 403 bp, Triticum aestivum
  unsure (1)..(403): unsure at all n locations
  Clone ID: PAT_TA_99322
tacggcccccccctttttgcaatgnccactttgagcctctcttcgagatttctgtggctgcttcttctcttggnaagcatggcgcctttcggcaatggnggacgaggagaggtgatcnaggaggagggagacgtgntaaaccggaacanttattgagcatgatcacctcatgatagcgtcgtctgacgacaggtttcattcagcgacccgcctctacatatgtatcagatgcagatcgttgcgtcngngcncatgctttgcagcgtaaccattancatttctttatctgattctgtcttggtttaccnaccaacacattctaatcaaattgtttccttgcgagaactgattataattaanatggntgcgtgcatcgcacttgatggctaacanaggcagctgc

SEQ ID NO: 99323 - DNA, 515 bp, Triticum aestivum
  unsure (1)..(515): unsure at all n locations
  Clone ID: PAT_TA_99323
ggtacggcccccccctcgagttanttttttttttttcttttttttttttttttttttttttttttttttttttttttttttttttttttttttttggaaccanccacgncnanaactttattangtgnccctttcatttaaacaaaanacagagcatcatcacgaggccttggnnagtagggngggggggngccncccnanaacgtcgaggccgnagagcnccttgacgtcggccaggggggcnggnacgtcnatcnggaacgtcagngggnacccggccgaaaacncccnccnggccgcccngatggccccccgnatcgggnagtgcaccgaccccgcnancaaaaggggnggcnccccanaggccttggnggaaaaaanccgcctcttctcgcggggggtgtttgannanactccaacgttgangctgccccngggnngggggtccaccgtcgggattttggtantcccacggtgccggtccnttnnataaacancccggtcngaatttgccc

SEQ ID NO: 99324 - DNA, 589 bp, Triticum aestivum
  unsure (1)..(589): unsure at all n locations
  Clone ID: PAT_TA_99324
ataccttctctcctccaacaccatggcccccactgtgatggcttccacggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgaaggcatcaagaagttcgagaccctgtcttacttgccacccctctccacggaggccctcctgaagcaggtcgactacttgatccgctccaagtgggtgccctgcctcgaagttcagcaaggttggtttcgtcttccgtgagcacaacaagctcccccgggtactatgacggtcgatactggacaatgtggaaagctgcctatgttcggggtggcaccgacgcaacacaggtgctnaacgaanttggagggaggtaaagaaggagtnacctggacgcctatgtcggngtcatcgggtttcganaaactggcgccaaggtngnnttgcgttangcnttaatccgctttaaaggccaaccggggttgccgaaggaagtntgggaaagggcctaaacttacnaagttgaaa

SEQ ID NO: 99325 - DNA, 466 bp, Triticum aestivum
  unsure (1)..(466): unsure at all n locations
  Clone ID: PAT_TA_99325
tagggggggggaatttggtacggcccccccctttttttttttttgantccaagttttggtttaatattgatcttataacatgttttgttacaaagatgcaaactgcactaccgatttcacaattttccaccggcacttttggaangtccgttgctaatacnggtggcacttttggnacggcaagcacaacggccttctatagaaaactaaagttgcatgcgacatagggtaaattttccaaatanaggtggccaacataatttatttagtctgaaacttcaggtgcngcaaagaattgtgcttcanttgttcaagaagacaanttggattgcaaagacctcncctcttctcctctattatccacgggcctcggagcancaacntctnggggaagggaangaagccaatcacatagtataaccnttccatggcangccggccggccaagangngttggggtngtnta

SEQ ID NO: 99326 - DNA, 494 bp, Triticum aestivum
  unsure (1)..(494): unsure at all n locations
  Clone ID: PAT_TA_99326
ntttggtaccggccccccccttcantaattatagggagggacttatgtcaccacaaacagaaactaaagcatgtgttggatttcaagctggtgttaaagattataaattgacttactacaccccagagtatgaaactaaggatactgatatcttggcatcattccgantaactcctcagcctggggttccgcccgaagaagcaggggctgcagtagctgccgaatcttctacnggtacatggacaactgtttggactgatggacttaccattcttgatcgttacaaaggacgatgcgatcaganngaccctgttncggggggaacanaaccaatggatctgttatgtncccttatccattagacntagnttgaagagggttccggtnactaacatgtttanntccagtgtaggtaacgtatttggtttcaaaagnccctacgtngctcgacgtttgggcggatctaaccacactcccccctacttaattcaaag

SEQ ID NO: 99327 - DNA, 348 bp, Triticum aestivum
  unsure (1)..(348): unsure at all n locations
  Clone ID: PAT_TA_99327
ccctccancatgttattgtgacaattcttacttcaanagttatanggagggacttatgtcaccacaaacagaaactaaagcaggtgttggatttcaagctggtgttaaagattataaattgacttactacaccccagagtattaaactaaggatactgatatcttggcagcattccgagtnagtcctcagccnggggttccgcccgaanaagcaggggctgcaatagctgccgaatcttctactggtacatggacaactgtttggacngatggacttaccagtcttgatcgttacaanggacgatgctagcacatctagcctgttgcntggggaangacaagcantgg

SEQ ID NO: 99328 - DNA, 567 bp, Triticum aestivum
  unsure (1)..(567): unsure at all n locations
  Clone ID: PAT_TA_99328
ttggtacggccccccccccgantntttttttttttttttttttttttttttttttttttttttttngggcaaacatgtttcncattattaattacccgaatacatagtcgacagattgtataaanatatnatgtgcatgtgcanatacatagccaccgattgcattcanataggagcatgctttctcgagccatgttggtacatgaacgtggncatacacatattcntaggaacaaacaagaaagataaatggggaaggaaaacccanagcaangtcaganttgacaaaaccgcaatggcactttatatgtggcccgtggtgagtganntgtttaggccttgccgganccctcgcagcccggtggcttgaaggggatnaaagtgacgcactgnacctgggcgcangttntcaaatccgatgatgncggcggtnccgcggtcagggtaacccttctttgaccctcctccacctcgttgaataaccttgnntttgncggtcgggnggcacccagaanaataggccancttcncacaattngttccnagntnaggggggcanncgtagtg

SEQ ID NO: 99329 - DNA, 490 bp, Triticum aestivum
  unsure (1)..(490): unsure at all n locations
  Clone ID: PAT_TA_99329
tgctacggccccccccttcaaaattatagggagggacttatgtcaccacaaacagaaactaaagcaggtgttggntttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgacgcctgttgctggggaagacaaccaatggntctgttatgtaccttatccattagacctatttgnaggagggttcccgttactaaccangtttaccttccatttgnanggtaacctattttgggttcaaacgccctacnntgctccgacggtttngggaggattctaccganttcccccctnatgtatt

SEQ ID NO: 99330 - DNA, 453 bp, Triticum aestivum
  unsure (1)..(453): unsure at all n locations
  Clone ID: PAT_TA_99330
gattnggtacgggncccccctcgangcggcgcnacccatcaaccaccgggcggtgacccgcaacctacagcagatcaggtgcgggatcgccaccgcctccggccgacaaggattgagctccatggatccaggcgcaccggccagatccgccgtcgaggggacgacctccaccgtcccgctaccctgcatcctcgacgcgccnaaccccggccacctcgacgactccgcctcctcangggcgacctgcaccaccgtcctactaccccatgaattgacgccgccgccgcctctcggccgatttctcctacccagtggtgcggcatcgcttccatcgtctccaacatcaggttgggtctctactcctttgctctgaaaaacgtgtcatgctggccaaggtaatgtantccgcgcgttcctccgtgcattattanctctncaaatacgcaccntttg

SEQ ID NO: 99331 - DNA, 596 bp, Triticum aestivum
  unsure (1)..(596): unsure at all n locations
  Clone ID: PAT_TA_99331
ggggggggggatttggtacggcccccccttcaataattatagggagggacttatgtcaccacaaacagaaactaaagcaggtgttggatttcaagctggtgttaaagattataaattgacttacnacaccccagagtatgaaactaaggatactgatatcttggcagcattccgagtaagtcctcancctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtacgcttatccatnagacctatttgaaagagggttccgttactaancatgtttacntccaantggtaggtaacgctnattttggtttcaaaanccctancntgctcctagntntggggagggnatctacnaacnttcccccctacggtatntccanaaaacttttcnaaacgggnccngcccttnanggggtaancccaagcttggaaaagnatantaangtttgaaacaangtacccggcnn

SEQ ID NO: 99332 - DNA, 523 bp, Triticum aestivum
  unsure (1)..(523): unsure at all n locations
  Clone ID: PAT_TA_99332
ggtacggccccccctttttttgtttgaaatgtcntcaaggttttanaaaagtgaacggatggggtagtatattacgtagtattatacgagaaagaaaattaaggaaaagactagtanatagaaanaaatgaaaatactaatacgatgcatgcatgcagttatatatagaggtagctagagttgtttggcgatggccttgancgcatctcggacgtaggggtagcggtaggagaacccgagctgggtggccctggccgggancaccttctggccgtccagcaccaccgtcgcnccttctcccaccanagccttgnatngccaggcccgggcaccngcagccagngacgcggcgccccatctaccctgncccaagccggctcgcacaggctccggntatccggnaccgggnttggggcgnccgntgccnttagnngacgcncgntttncggccgggtntccgccncgggactcctnntaactgggattccanccagntccngtctnanganttgcagttccacct

SEQ ID NO: 99333 - DNA, 353 bp, Triticum aestivum
  unsure (1)..(353): unsure at all n locations
  Clone ID: PAT_TA_99333
ggggggggggatttggtacggcccccccccgactttttttttttttttttttttttttttttttttttnccatgaatcaagctcaaacatataaaagcgttgcattcacactttcanatataccacttatatatcattagtagttcnggttaaataagagcaanggggaggggganagaatttaantanacgggagaaaatgaagagcatatatatcgtgnatgcacncacnaatctcgggaatggcgcgggagcgacggtggcctattacttgtaccccgcgacgtgcaagctctcggacgcggnggnntcccctccggnggcggcgccgccntacttgcggancgtggcct

SEQ ID NO: 99334 - DNA, 556 bp, Triticum aestivum
  unsure (1)..(556): unsure at all n locations
  Clone ID: PAT_TA_99334
acagccactatagggcgaantgggtaccgggcccccccttttttttttaccgagcaaaacactcttccggtagtaaaagagacacccaacccaactaacccagcgccaccattaccgacagctcacccgaaagcagaaacgcatgaacgaaacagacgggcaaagaccgagaagaaaggccaagctttccacaaataggtatatacagctagccggaccagtgccgtcggctccggccccttgcggncgtcagcacgtctcgatctttctcagcgtcacacaagtccactacggtcgatcgcatcacgacccgaacagcagcgacggcggctcgttgaggtcgaacgggaggccggcaggcccgggcgccatgccgagctcgagcgccgtcgacggcgggacggggaccgccggaggacgcttcctgcggaagacggggcgccggcgcggccgccggaggcgaaaagtagacgaagtgccaacngcggaagggaagntgangtcgacgccgccgaaaggggaacangctggtggctggaaaaggcggggnggnggn

SEQ ID NO: 99335 - DNA, 545 bp, Triticum aestivum
  unsure (1)..(545): unsure at all n locations
  Clone ID: PAT_TA_99335
atacgagccactatagggcgaaatgggtaccgggccccccctcgagtttttttttttttttttttttttttttttttttttttttttattctaaatgctcttatattagtttggagtactatgtatttatttttccgacaaatattttcggacggtatgtatttatttcttcgactattttgggacggatggagtatgtatttgngtatgcatggacggatggagtatgtatttgngcatgcacgtggcagcgttcttaatctanattcccagtcagagcttggatggcgtccctctgggatggngcaccangatgaggccgtaggcgtccantgtgaggaagtcgtccanctccggggcgacgcantgccggatgaagaccctgccancctccgcgtagcgcccccggcggaacctcnccgcgccgatctctgnctggaccctcgccanctcctcctccaagangcgcgggancanctccggggtgggtcggaccgccacncccgccggggnccaacaccgcgccaaggggggngccantggca

SEQ ID NO: 99336 - DNA, 568 bp, Triticum aestivum
  unsure (1)..(568): unsure at all n locations
  Clone ID: PAT_TA_99336
tacagccactagtagggcgaantgggtaccgggccccccctcgagtttttttttttttttttttgcggaaaggaatgcgaatatacctttatagaattacatgttgaaatagattgattagtaacatggaaagaatatgaaaaaatgtatttgctaactgactggcagattgccactcgcgcaaaatgattctcatttgcgctagtctctaatacaaagaaaataactctgaagcatccagataaaaagtggttcgaatacttgtaaaatttggcccaatgttacaatttgtcttgatccccaacaatgtatgaaaagtcatcctcatcatggtgaaaaaaaatcattacatatataggaggcgtgtgatgttgtagcatcaagatgggcgcagactgcggtgtgagtagtggggataaagcatgtaactgcaaaaataagaagcaggccacacataaagcatgtcaaagaggngatattcatcaatcctcacaagttggaatgtaaagaagcggctccgggcggcctcacnttgataaagntngatgtngacnaacccccggaaggg

SEQ ID NO: 99337 - DNA, 549 bp, Triticum aestivum
  unsure (1)..(549): unsure at all n locations
  Clone ID: PAT_TA_99337
tatacganncactatagggcgaattgggtaccgggccccccctcgagttttttttttttttttttttttaccaaataggtatactcaatatctttatatattaacaaaacatgcccagcaatcgcttggatgcgatgcggtacttaggtacaaaggataaaaatatcagatattaaattggcatgcttaaaaggtgtaaaggcagctgccgtcgtcactcctcgccgttgggtcgaagttcttggcagtctggtcggtgcatcctgccggcacaggcaaagtaccttgctgtgcccctttacctcctcctatgcagcaagagatggtgggtgtgtatggagaatgttctaaccgtagaaggaaccagtcttcatcgcatcctggttagcatcacccaaagctgcctgggctcaagtaggggtcaagcaaagctgcacacgcttgacattgtcctgctcctggacgaacaagtgnccgtantcnaacancttctcgactggcatctttggntgnccaaaggncactgggccgtccccgngaggtcanaag

SEQ ID NO: 99338 - DNA, 554 bp, Triticum aestivum
  unsure (1)..(554): unsure at all n locations
  Clone ID: PAT_TA_99338
tacgagccactatagggcgaattgggtaccgggccccccctgaccccgctcgtgttgaaattacaatacgcgaaataccacgacacgcttcgagtgccgtggaagaatcgcctgctaagacactaagccgaagcctattcttgtccgtctatacgtgcgggtggtatcaccgcgttctggcatggattctgacttagaggcgttcagccattatccagcagatggtagcttcgcggcactgcccggtcggacagccgcaaaaaccaattatctgaatgagcggttcctctcgtactaagctcaattaccattgcggtgaggtcatcagtagggtaaaactaacctgtctcacgacggtctaaacccagctcacgttccctattagtgggtgaacaatccaacgcttaccgaattctgcttcggtatgataggaagagccgacatcgaaggatcaaaaagcgacgtcgctatgaacgcttggccggccacaagccaagttatccctggggtaaacttttctgggaanctctangcctcaaaatgtcgnggggacn

SEQ ID NO: 99339 - DNA, 649 bp, Triticum aestivum
  unsure (1)..(649): unsure at all n locations
  Clone ID: PAT_TA_99339
tatacganncactatagggcgaattgggtaccggggccccccccgcgcatccaccgttgctagcaaggtcgaccaagcagcaccgagatggctgctgccttctcctcccccggcttctacgccgaccaacttcctcgggaagaagctcaagaagcaggtaacctcggccgtgaactaccatggcaagagctccaaggccaacaggttcacagtcatggcagcggaaaacatcgacgagaagaggaacaccgacaagtggaagggtcttgcctacgatatctccgacgaccagcaggacatcaccagagggaagggcatcgtggactccctcttccaggcgcccacgggcgacggcacccacgaggccgtcctcagctcctacgaagtacgtcaagccagggactcaagaaagtacgacttcgacaacaccatgggaggcttctacatcgctcctgctttcatggacaagcttgttgtccatctctccaagaacttcatgaccctgcccaacatcaagatnccactcatcttgggtatctggggaggnaagggtcaagggaaatccntccaatgtgaggcttgtcttcgncaaagatggggatcaaaccaatcaagattaagtgccggagaactggagaagtggnaacgc

SEQ ID NO: 99340 - DNA, 621 bp, Triticum aestivum
  unsure (1)..(621): unsure at all n locations
  Clone ID: PAT_TA_99340
acgagccactatagggcgaattgggtaccgggcccccccctcggtcgatctcctcccccaagatctcctcgccgccgcccacctccactctctcccttaaatccgccgccggcgacccccgacctctcctttgctccaaaggctgcagatcgagccgacaagctccggttggttgcggccatctccgtgggatgccctcgtcgtccatccatggagacccttcctcccctccgaccaaattcgtcctcggctcgagctactcagccggcgcccagatctgtggagccatcctcctccacaatcatgcagtggcagcagcagcggtggaaccatggacccgaaaccctaacccatggagcgagctcgccatggatctgcaggactaggactaggacaacgcatgccaccaacaagcagcaccaatgtccggtcttctccatggggttctgctggcaatgttgacggtcgtcgagagggtcctggaccggatggtgtcctggctgctgatgtatggagaagngaangngatgctcgtcctctatctccgggaacccangananggggtgggaaggaacgtgtaanannggttcctccgtccgcnggttggggangggaaaang

SEQ ID NO: 99341 - DNA, 640 bp, Triticum aestivum
  unsure (1)..(640): unsure at all n locations
  Clone ID: PAT_TA_99341
atacgagccactatagggcgaattgggtaccgggccccccctcgagttttttttttttttttttttttttttttttttttttttttttttttttttttcgagaagaacggngcattcaattcgttgagatatgagtgtgaagctacttcgtctctcctctacttttataattttatggtttcatagtaatttgagcatccggtaaagactgtccatagtatcctcctcttcataacaccctatttagcaatgttaagaactgacctcagcaactaaaaaagcttgtgctcaagagtcatgtcagactcaggctcaagaccaacgcaagcccggaagatgttggtcagggcagcgcgctgcttggcaagagcgttgacaacaggagtgccagggggtgtcaggggggccttgagcatgtagctgaggacactcaggacactgtggaagctcttgtattcggtgggtagcaagtgccgtcggaagacacggccttccactgaatacgagacatcatnctcggcaatgatgaccaagtcaatgatcaagggagaagcgagganaaagtcctcacaaatgttgaagaacgaaatgggccgggtggccaaccaagaaaaancccggnggagtactcaacaagggg

SEQ ID NO: 99342 - DNA, 533 bp, Triticum aestivum
  unsure (1)..(533): unsure at all n locations
  Clone ID: PAT_TA_99342
atacgagccactntagggcgaantgggtaccgggccccccctttctataaccgaagatccatctattcattaccaagtcctatgccagtggtataaaatcgctattcatgaaaacaaatcatacaaaatcaatccctttcatgccttattcatcattgctccattgccacgcttcctggatcgccttccagtacttctcaggatgctcacgcatatgtccaacatggtttgtaccatcaaaaagctcctgtctcgtctcatatcctctctgctgagactcagcaatgtaaccctcaatatccaaatgagaaataatttcatcttccttgctgtagaggtacagtctcttgggatccaaaggtctcataggtagtatcgtcgacagtgcgaagggcaaaagnaccagaagggtcactggccaatcaagtttttggaaatnacatccaagggtcaaggacaaaaaccccaagatacccttttggcaanaacaaaaagggcaaggggnaagaacntttgcnngtnccggtaggcaa

SEQ ID NO: 99343 - DNA, 632 bp, Triticum aestivum
  unsure (1)..(632): unsure at all n locations
  Clone ID: PAT_TA_99343
acgagccactatagggcgaattgggtaccgggcccccccttcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatttacgaattccccctactnatcaaaaactttccaagggccgcctcaagggatccaaagttggaagagataagttggacaaagtacggccgccnttaatgggaatgtacaataaaccaaaattgggantancccaaaaaattttgnanagcgngtntgg

SEQ ID NO: 99344 - DNA, 359 bp, Triticum aestivum
  unsure (1)..(359): unsure at all n locations
  Clone ID: PAT_TA_99344
tacagccactagtagggcgaaatgggtaccgggccccccctcgagttttttttttttttttttttttttttttttttttttttttttttttttttttttttttttttttttttttaaacnaaaaangcaaananaaanaggangtcaagaccaanagnaaaaacttggacnaaaaaaaccccanncggattggngganaangtatttaaggaaaattgcccagtaacgattcagggaaaanacccgaacncaaactcaacccctanganagnaaangttttgngaacgctgccgccaacctacgaaaacctcgggngttcgatgccnccacnaaaaacgaaggnngggaaaanccaccc

SEQ ID NO: 99345 - DNA, 399 bp, Triticum aestivum
  unsure (1)..(399): unsure at all n locations
  Clone ID: PAT_TA_99345
tatacgagccactatagggcgaantgggtaccgggccccccctcgagtttttttttttttttttttttttttttttttttttttttttttttttttttttngngaacgggaagccaacatttttcattggccanaggctgttcgagttttttttttttttttttttttggatttagaanattaatacttaatattacttagacgngacgngacananaanccacngangttccacgaatgtcaactcgcanagaanaaccctgaccacncgtaccaaaacaataaccaccgcaacccaagtctcagataatataggacacacataataactaagaagcagggttcaccgcctccgnaanagaanatcgacccatttaggcgaccnccccnattttgggg

SEQ ID NO: 99346 - DNA, 557 bp, Triticum aestivum
  unsure (1)..(557): unsure at all n locations
  Clone ID: PAT_TA_99346
tacgagccactatagggcgaantgggtaccgggcccccctccgttcctccgccgctccggtggcgcgatggncgcgcgggccctcctcctccgggcaaccgcccgctgctgctcccctctccactccccctccgccgccccgcgcctccacccgcgtctccgcagccacgccgccgctccccagctccgcttccccgcgctctccttctctgcctccgccgcgtccaccagctcgcacggccccggcggcggtgacgccggcgagggggaggatgacaagggagcctacgataactacctggggatgagcgacgacgagctcatggcgcagtgcgacatgggcaacttcaagtccctccggggccggcgggcaagaacgcaacaaagcgcgagtccggctgtccgggtccggcaacaacccaacgggaatgtccctcaaggtggtnggaggataagtnaaaacaataagaaatcgnttgtntggtttaanttggggttccgggaaantgattggttcttaagtttaaggaaggcggatnaaacttggaaantanant

SEQ ID NO: 99347 - DNA, 639 bp, Triticum aestivum
  unsure (1)..(639): unsure at all n locations
  Clone ID: PAT_TA_99347
agagncactatagggcgaattgggtaccgggccccccctgccatgcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttcccggagctgctcgcccgcaacggcgtcaagttcggcgaggccgtctggttcaagggcggctcccaaatcttcagcgagggcggcctcgactactcggcaaccccagcctggtgcacgcgcaaagcatcctccgccatctgggcttgcaagtggtgctcangggcgccttggagggctacgcctcnccggngggcccctgggcganattt

SEQ ID NO: 99348 - DNA, 484 bp, Triticum aestivum
  unsure (1)..(484): unsure at all n locations
  Clone ID: PAT_TA_99348
atacgagccactatagggcgaantgggtaccgggccccccctcgagttttttttttttttttttttttttttttttttttttttttttttttttttagccgacagattgtataaatatattatgtgcatgtgcatatacatagccaccgattgcattcacatacgagcatgctttctcgagccatgttggtacatgaacgnggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctccgcancccggtgggtttgnaggcgatgaagctgacgcactgcacctggcgcatgttggccgaatcccgatgatgcgggacgtacgcgtcaagggnacccctttcttgaacctcctcccaacctccggntggattnacctg

SEQ ID NO: 99349 - DNA, 264 bp, Triticum aestivum
  unsure (1)..(264): unsure at all n locations
  Clone ID: PAT_TA_99349
aatacanncactatagggcgaattgggtaccgggccccccctcgagttttttttttttttttttttttttttttttttttttttttttttttttttttttttttttttttttaacttaagngcttgntgacatattatcaanagggaagttacattgccggcttccaaatatgaacaaacataaaaggcctgaaagcaanacggccattatgcggatccanctagcctancttggngagganatcnccganaanagtcttggcc

SEQ ID NO: 99350 - DNA, 561 bp, Triticum aestivum
  unsure (1)..(561): unsure at all n locations
  Clone ID: PAT_TA_99350
tacgagccactatagggcgaattgggtaccgggcccccccttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcgagcctgttgctggggaagacaaccaatggatctgttatgtagcttatccattagacctatttgaagaggggtccgttactaacaagtttacttccattgnagggaacgtntttgggttcaaagccctacgtgctccaagtttggggggtntaacaantccccccactaatcaaaaacnttccaaaggcccncccaagggatccaaantggaaaagaaaaantngacaaat

SEQ ID NO: 99351 - DNA, 548 bp, Triticum aestivum
  unsure (1)..(548): unsure at all n locations
  Clone ID: PAT_TA_99351
atacgagccactagagggcgaaatgggtaccgggccccccctcgagtttttttttttttttttttttttttttttttttttttttttttttttttttttttttttttttttttttttttttngcaanaagaanggaagggntnaattgaaccaaagaaagaccttgcnaaanagcccggaaggnangtttcccttccngnnagggagccaaccanaagggngggaganagnaccaattctngggaagcaaccgcaagcncaacttcagaaanagttcttcccggnagggnaaanancaggggggggggnaagaaggaaaacaattcaaggncctccanggnnaaaccgngnttangcccccaannagacagccccatgtccaaccnngtggggaaaacaagtggacaggagaagccaacccgcctaggnaanaagtgggaagaanaaaaggnggcaagnaacttgggnaataggaattttgcnagncccattttnnccaaaaaggnaaattggatggggagannanggggggggaaaanaaaaggggg

SEQ ID NO: 99352 - DNA, 532 bp, Triticum aestivum
  unsure (1)..(532): unsure at all n locations
  Clone ID: PAT_TA_99352
atagagccactatagggcgaantgggtaccgggccccccctcgagttttttttttttttttttttttgnggccagacttcttttcttcttttgaggggacgcagccagatgtctgtcttacacacttcacactggttttcaactctcaggcccaaactacaaagggcttagtaatattataagcccacttgccgcaattatatcaatcttcccaagaatgtcccctccgctacatcaattttaccaacaatcagcagtaaataacgtaacaaaatgtgagcagagcaactggaagggaaacgctgctccaaaaaagacagacatcctaaccccagatccaagcaaaagcctagtgtacctccctggcagtgcgttgatcaaggncgcatagaaccacatggatctgaagcttctggtaagctggtatgggaatcaactcgntaactacacttcancacaaatgggttaaaagcanttaggnactcctgngggnccggatcccggagcntgaggncaacttctccaacancta

SEQ ID NO: 99353 - DNA, 537 bp, Triticum aestivum
  unsure (1)..(537): unsure at all n locations
  Clone ID: PAT_TA_99353
taatacganccactatagggcgaantgggtaccgggccccccctcgagttttttttttttttttttttttttttttttttttttttttttttttttttttttttnggttttttttttttggttttttttttttttcngganaaattttgnaatttgaaanaaaacgtaanaaactcaagacttanatgaanaattcgccactcagtttanaatacanaccganaaaccgcctcaaaaaccaccaaatcaagggatgagcanatcgggccgagaaacaaactagcctanccaacaagnggntacgagacccanattattcaaagtaaacacggggtatgggggggganatcccccttggaattaaaatggggggngctggtaaacnaanaaggnttaatggcgccttggggaagctcggaaagggntntgncttgggggncccaaacaagttggggagggnaagcttgncccccggggganttgngggncttgganaacncaatcnggggtcanccaaaagatggtgggggccaaggg

SEQ ID NO: 99354 - DNA, 547 bp, Triticum aestivum
  unsure (1)..(547): unsure at all n locations
  Clone ID: PAT_TA_99354
tnatacgagccactatagggcgaantgggtaccgggccccccttcgtactcgcctctctccgcgcaaccgagccttccgcccacctcctccccatttcgccagcggcgcagcccaccaaccaccccccacccgccgccatgagggagtgcatctcgatccacatcggccaggccggcatccaggtcgggaacgcgtgctgggagctctactgcctcgagcacggcattcagcctgatggccagatgcctggtgacaagaccgttgggggaggtgatgatgctttcaacaccttcttcagcgagactggggctgggaagcacgtcccccgtgctgtcttcgtagatctcgagcccactgtgattgatgaaggngaggactgggcgcttaccggcaagctcttccaacctgaggaagcttatcagtggcaagggagggatgcagncaanaacttcgcccgtgggncaatacancaattgggaaagggagnatgggtggatctggtggcttggccgttntcaaggaaagntttcanncaactggnactgg

SEQ ID NO: 99355 - DNA, 553 bp, Triticum aestivum
  unsure (1)..(553): unsure at all n locations
  Clone ID: PAT_TA_99355
aatacgagccactatagggcgaattgggtaccgggccccccctcgagtttttttttttttttttttttttttttttttttttttttttttttttttttgcagcaaggaaatgntgtggtttcanattcttttgttcctggggggccaccaaagtactgcacgttgggctgcgatagaaaaaaggnaaccgatcgatgcaccgttggatatatcgtttcgtaacgtaacgcancaatcgttaagttggaaaaataagcgcgcacacacgggcgatcacttaccactaagctgccagccatggaggagtggttcttaagcttgtgtttcgcagcaacatccacgctactagcccttctgtttgtcaaagctctccgggngggnaataancaaggccggcccgccaaaaaaagcaagtggctcctggggccaanggncctccccccggnaancgggaaggccccaacaacgnnaaanaagaaancccccccaacnnggggaatnattaaagntttcncccaagggaacngggcccgttgnntgncccccaangggn

SEQ ID NO: 99356 - DNA, 545 bp, Triticum aestivum
  unsure (1)..(545): unsure at all n locations
  Clone ID: PAT_TA_99356
gtatacgagccactngtagggcgaantgggtaccgggccccccctcgagatcatcaatcangaaaagaatctgctgaaatggattctgagccatctctactctatcaacactatccaaatatggtctatgaccaacagtttgatgatgaacagttttctccaatctcctttcctccagatggtgaacaacagttcaacatgtcatataataaggcagtcaggggaaggctagatgatctagttgaaatgactacttgcatggtggagccttcaataagttacgtggttgactcttgcaatttgtcaaatgattcagcaacgaatcatgttccagtaatggacaatggtgcacttgctaatgggtgaagataaggagatgagccaccaccactccctgcaaggcggtgattctgtagctgatgagaaagcaagcatatttctccctgccttcccaatttatgaaaatcatttagaaggattaaaaggnttacaaggaggtctagnnatcaattcaagcaatcgaggtganggagaggaattggggg

SEQ ID NO: 99357 - DNA, 490 bp, Triticum aestivum
  unsure (1)..(490): unsure at all n locations
  Clone ID: PAT_TA_99357
atacgagccactagagggcgaantgggtaccgggccccccctcaagagttatagggagggacttatttttttncatncagaaactaaagcatgtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttgggactgatggacttaccaagtcttgatcgttacanaggacgatgctatcacatcgagcctgttgctggggaagacaaaccaatgggatctgttatgtagcttatccaattanaccctaatttgaagaggggttccgtttacnaannaggttnacntccaatgntaggncacgtantttgggttcnaangcctaacggtggctccaccgttttggggg

SEQ ID NO: 99358 - DNA, 560 bp, Triticum aestivum
  unsure (1)..(560): unsure at all n locations
  Clone ID: PAT_TA_99358
ccactatagggcgaantgggtaccgggccccccctcgagttttttttttttttttttgcaatctaacgctacaacatagcatctggtgcgacccaagcaaagttagatctacattacagttcactcacatgttgcacttatagctgagtaaggccgcaccatcagaaatcctgaagaactgggaaaccatcatcaagcctctgggtggcataggctccttcaccccccatgtggatcatccaatccaagaagaatactctgctgagctacaggttgcacatgcacaagcaagtgttacaacttcatgagtggaggctcggcgaaaaaaatatgagcactgtcttcggtacaatgaaggngggctgctggaagcttgttatgccacctactgcaagnncagctggattcagggttattaaggatggggcnatcnagaatgtagcttgtncnaanccgtggttnaccgntttttaacttncaggccttcctanaactggattaaatcgggggnacccaaggnggaaagggttaaaggcccccgggaagggtttaancctttc

SEQ ID NO: 99359 - DNA, 398 bp, Triticum aestivum
  unsure (1)..(398): unsure at all n locations
  Clone ID: PAT_TA_99359
taatacganccactatagggcgaattgggtaccgggcccccccttttttttttttttttttttttttttttttttttttttttttttttttttttttttttttttttggaaggattcaaccacgcaggagataaaataaaattgttcanaanatggacanagaacgcaggcaanaaaaagnggaagaanattggnggaaacggctccaattattaanananaggggggatggcttggcttcagtcaagaagttcttattcagtcttgnccganaaaaanatcgcttcgaanatcgatggccncacggntaggngaggtagttgatgaattcnacgggggtcgcgatggcnccnccggnganggcgtcctgggngatnttgccccctttggtgntggga

SEQ ID NO: 99360 - DNA, 440 bp, Triticum aestivum
  unsure (1)..(440): unsure at all n locations
  Clone ID: PAT_TA_99360
gttatacgagccactagagggcgaantgggtaccgggccccccccttaantcaagagttatagggagggactntccatcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaaagagggttccgttnctaacatggtttacttncaatggta

SEQ ID NO: 99361 - DNA, 529 bp, Triticum aestivum
  unsure (1)..(529): unsure at all n locations
  Clone ID: PAT_TA_99361
aatacgantcactatagggcgaattgggtaccgggccccccctcgagttttttttttttttttttttttttttttttttttttttttttggacaaatcatcactagcattatttggttctttcanacaagaagtggaaacagcctctccaggtctcttgtcaaatctgcttagctaaaaatctgactaaatgcagcctacagacaacaggttccatcatttgttttacaaataacaagaactcgctcggngcaaatgcatttagactgaatccagtccanagactcncctaaaaaaattgctgccaaagggtgncaactctccagcttcaagcaaaattttgngtttgcaagaatttatgtgattggggntcancaaccttgatcaaccatttctgcatcccaaagggcaccccanaaaaaaagcngaatggggnggnacctaaaaaaagaacaaatcaaactatttttccgncgcaattaaaaaaacaaggcaattgttcgngggccttaagttcccggntanaatgg

SEQ ID NO: 99362 - DNA, 542 bp, Triticum aestivum
  unsure (1)..(542): unsure at all n locations
  Clone ID: PAT_TA_99362
tatacgagccactagtagggcgaantgggtaccgggccccccctcgagtttttttttttttttttttttagtcgacagattgtataaatatattatgtgcatgtgcatatacatagccaccgattgcattcacatacgagcatgctttctcgagccatgttggtacatgaacgtggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgtacgcgtcagggtactccttcttgacctcctccacctcggtgatcacctgtgttgcgtcggtgcaaccggaacaataaggcaagcttccacaatgnccaagtaccggggcaatcggtagtacccaaggggatgcnttggggctcnangg

SEQ ID NO: 99363 - DNA, 508 bp, Triticum aestivum
  unsure (1)..(508): unsure at all n locations
  Clone ID: PAT_TA_99363
atacgagccactatagggcgaantgggtaccgggccccccctcgagttttttttttttttttttttttttttttttttttttttttttttttttttttttaaattcaaaactgcttccatctctttattcaacancanatgattatgtatcancgccaggaagttaacgcatgcatggttgcaatgcgctcttccatggatgaatgtacatgcatgtacgtgtcaacgtacgtgcccgttacacttggatgccgcattacgtacgtacgtacgtacgagcagcttatttaggntgaagatgtaggtatagtanaaagcanaagttagaactggatgttgtaggccggngacttgtccgggttgaaagagcccgaagccccccnccgtgggggtncccggncttccgggtcccngtgaanaanggggaaanatngtacgnccccaangggcccccggttcttgggggggggccccnncgancggggggtnanaaagccccggggnggac

SEQ ID NO: 99364 - DNA, 280 bp, Triticum aestivum
  unsure (1)..(280): unsure at all n locations
  Clone ID: PAT_TA_99364
atagactcactatagggcgaattgggtaccgggccccccccggcaccatggagaggcgtatccctgcccggccacccaagccaagcccctcccgaatctctctctcctcccctcccataccattgccccccgntccctcgccctcnnctattatangcacatatcnactgngcggccatggtccccgcaatnaggcnggagnaggaggcgagntgtaaggccatcgatgancaccgntccgatttcgacgcnncgaanccgccgccnttcctcattttta

SEQ ID NO: 99365 - DNA, 453 bp, Triticum aestivum
  unsure (1)..(453): unsure at all n locations
  Clone ID: PAT_TA_99365
aattgggtaccgggccccccctttttttgaactcaactcaacttgaaattactcgggcgggcgaattcacagttttacagaagcaaattgacagggtcggtcgcgtcacagagatcatccacggttttacagctccacgaactcaccacaaactgatcgacccaggaagcaaacttaaacgactcatgcatgatgatggcaaggaaggagacgacgcgatcatagatnacacggacggacgggcaggcaggcggcgggcttgcacgcacgcaagcaggctggctgcgctgagctcgctgctcagtagtcggtggtgggganctncctcgttgggttncggggaagatgaaggaacaagctcgtnanantgacgncctggcgaaggcccgcccgccgaatgaagggggcctaccncangtacacccntnngggtatnccccanncccaanctga

SEQ ID NO: 99366 - DNA, 484 bp, Triticum aestivum
  unsure (1)..(484): unsure at all n locations
  Clone ID: PAT_TA_99366
tnatacgagccactatanggcgaattgggtaccgggccccccctcgagtttttttttttttttttttttttgatgcacggaaacagttngaattangatgagaaaatcatgctcatggacacatctcanatgagtgatgcacagaagcaattctacaagaataaacaagatgagatcattgctcgctgccagaacacatcnggttgaccttcatttgttgttctgtctactatttcttatcacttgaactatttgtcacttgaattatttgtcacttcaactanntgtgacttgaactatttgtcactttaacnatttcttatgcatacgtgnaaaactaagatnaaaggaaatacgactacaaagttacttgtactanatcattcgtgtccaaacgtctgccaggaggtgnccanctanattatctgngaagctngaaaatgttcatctttggtttccaatttgcggntgcacctgaaataaa

SEQ ID NO: 99367 - DNA, 517 bp, Triticum aestivum
  unsure (1)..(517): unsure at all n locations
  Clone ID: PAT_TA_99367
actcactatatggcgaattgggtaccgggccccccctgggattatccgcaaaaaattatggtagagcgtgttatgagtgtctacgtggtggacttgattttaccaaagatgatgaaaacgtaaactcacaaccatttatgcgctggagagaccgttttgtcttttgtgccgaagctatttataaatcacaggccgaaaccggtgaaatcaaggggcattacttgaatgcnactgcgggtacatgtgaagaaatgattaagagagctgtatttgcaagagaattaggggttcctattgtaatgcatgactacttaactgggggattcaccgcanatactacttnggctcattattgccncgacaatggcctacttcttcacattcacggtgcaatgcatgcagttattgataagacagaaaaatcatggtatgcatttcccgtgtattangctaaaancatttcggtntgtccgggggggganaattatatccactcccgggtacngttngtagggtt

SEQ ID NO: 99368 - DNA, 520 bp, Triticum aestivum
  unsure (1)..(520): unsure at all n locations
  Clone ID: PAT_TA_99368
gaattgggtaccgggccccccctcgagtttttttttttttttttttaccattaaaacgtanatngttgacatattgtataanattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgatgagctgtttaggccttgccggactccncgcagcccggtggcttgaaggcgatgaagctgacgcactgcaccctgacgcangttgtcgaatccgatgatgcggacatacgcgtcagggtacncttttttgaccccctccaccncgttgatnaaccgtgttggcgtccggtnccccccaancataggcnagcntccacaatngtccaagtancnggnccatcacagtnncccaagggagantg

SEQ ID NO: 99369 - DNA, 439 bp, Triticum aestivum
  unsure (1)..(439): unsure at all n locations
  Clone ID: PAT_TA_99369
atacagccactatagggcgaattgggtaccgggccccccctcgagttttttttttttttttttttttttttttttttttttttttttttttttttttttngganagggaancggggatgaatttccggactanacgcnanaggaggagaggcatgaaccgaggacnaattgcctcaccanacgcnanaggaggagaggtaacccagtcanncctaaaaaatactangttttaanttggcaacancgattgtcnctcatcatttccaagccgangggtagcatcatcagcagcancagcagtcatattttanaaatgaaggntcaaatgaccaatgttttatcggtccancaacnccaataattcaccnnggnttgtccntcttccgattttanctcncccnaaaattggcnttgccnaaacannccaccccatgggcat

SEQ ID NO: 99370 - DNA, 545 bp, Triticum aestivum
  unsure (1)..(545): unsure at all n locations
  Clone ID: PAT_TA_99370
atacganccactatanggcgaattgggtaccgggccccccctcgagtttttttttttttttttttaatagaacgaattcagggctcacttattcatagttcaccaaacatgttgcacaacagcagaagtttcagacccaaccagtaaacactgcatcacagtactataagaaacaaagacacctacaacagacccagacaagacactagacaacacaccgacaactccaactgaagcaccaagacttgcgaacccagaaacagaagcaccatgtccaggagcttactggccaccacggagccggagcaccaagtgaagggtggactccttctggatgttgtagtccgctagggtgcggccatcctccaagctgcttaccancgaagatcangcgctgctggtccgggggaatancctcccttgtcttgggntcttcgccttcacaattgncaagtggngtcaagaaagactcaacctccaaggtgatagtnttggcccgggtgagggtcctgaacaaacattcnncaaggccaaccactgggntg

SEQ ID NO: 99371 - DNA, 237 bp, Triticum aestivum
  unsure (1)..(237): unsure at all n locations
  Clone ID: PAT_TA_99371
gaattgggtaccgggcccccccttttttttcagcacgcattcacgatgcacngatagaacgttaactttaacatccaccanagttacaaatccnggtttcataattcacttatggccccatgcttcagaattcattcataatccagaaaatagttgattcaggatagtgttccagatcatagttttgatgcttctggtgtttactgcattccnctgtcancagacccagttggantt

SEQ ID NO: 99372 - DNA, 511 bp, Triticum aestivum
  unsure (1)..(511): unsure at all n locations
  Clone ID: PAT_TA_99372
atacganccactatagggcgaattgggtaccgggccccccctttttttttgatccaacttaatacccacaagtgccttgattgcttgagagcatgcttatatcagccataaccgattancatagccctggcnntgtcccatacagtagccgaagcagaggggcaggaggaagatgcagctcaccgagggaggttgtagccaaggcagtactcaatgggtgccagagttgcggttgaacgacgtccaacnngcgaggnaccgcttcctatactcctgaaccggcataaaaagaancaggagctcatcatttcccattgctcctgaaanaattgtaaagcaaacaaaaattaatgctttgtgactgaccagcaagaattagaaaacaaattcttataacccgaangtgctctgaacccaaatcttttcttcataaacatggagaaactctcatcaacacagtaacgcttgcgacatattnaaataaatattattaagnaaaggaacaccanga

SEQ ID NO: 99373 - DNA, 260 bp, Triticum aestivum
  unsure (1)..(260): unsure at all n locations
  Clone ID: PAT_TA_99373
aatacactcactatagggcgaattgggtaccgggccccccctcgagtttttttttttttttttttttttttttttttttttttttttttttttttttttttttttttttnggnncaataaacatcancanattcanaccggagcgctggnaggaattttatacacccanaagtacacccccccaccgcangacgaaatanatgtcaatanaaaaaagatgtaanattatgcnacncnaggttcaaanatcattacagtgg

SEQ ID NO: 99374 - DNA, 300 bp, Triticum aestivum
  unsure (1)..(300): unsure at all n locations
  Clone ID: PAT_TA_99374
gaattgggtaccgggcccccccctcccgcgtaccaagccaccgaccaacatggcatgcgtcnctccaagccgcggccacgctgatgccggcnaatntcgngggccgggcctcctctgcgcggccgtcgtcgcacgtcgcccgggcgttcggcgttgacgctggcgccaggatcacctgctccctgcagtccgacatcagggaggtcgcaagcatttttnccgacnccgccaatatggtcannttcgcttctctaccncngccctcctcgtctccggcncganncgcggntggggcgccca

SEQ ID NO: 99375 - DNA, 296 bp, Triticum aestivum
  unsure (1)..(296): unsure at all n locations
  Clone ID: PAT_TA_99375
tacgactcactatagggcgaattgggtaccgggccccccctcgaggaacgggcggagctgctggaaggtctggtggtcagcaacaaagacgccaccgtccccgttttgccgcaagaaaatacttttgctctggggacacaacgacaacatcntcaacatacagctcgccaagacgatgaangagcagctcgggggagaagacaatgcctgcaagnancatagacaaagggccgggacatctcgtnncaccttggaaaagnccctgcnttttaanaaccaaaccaccncangggatt

SEQ ID NO: 99376 - DNA, 245 bp, Triticum aestivum
  unsure (1)..(245): unsure at all n locations
  Clone ID: PAT_TA_99376
gaattgggtaccgggccccccctcgagtttttttttttttttttttcaaacataccacaggttcatacaacacaacaggttgtaaaccaannaccacanancaaacattcantcagacagacaacagatagtcccgcttgggcagatcacaggatagtagtanacgaaggcaagcttaacgtacatcaggtcgcaaactcagctgctcnagtattcntcacccncancaccgtcctctcnctcgt

SEQ ID NO: 99377 - DNA, 528 bp, Triticum aestivum
  unsure (1)..(528): unsure at all n locations
  Clone ID: PAT_TA_99377
aataganccactatagggcgaattgggtaccgggcccccccctctctctctctctctctattcaagagttanagggagggacttatgtcaccacaaacagaaactaaagcangtnttgggnntcaagctggtgttaaagattataaattgacttactacaccccacgagtatgaaactaaggatactgatatcttggcagcattccgagtaagtcctcagcctggggttccgcncgttttaagcangggctgcagtagctgcngaatcttcgnngggtacanggacaactgtttggactgatggacttaccantcttgatcgttacaaaggacgatgctatcacatcgagcctgttgctggggaagacaaccaatggatctgttatggtagcttatccattanacctatttgaagagggttccgttactaacatgtttacttccattngtaggtaacgtatttggtttcaaagccctacgtncctccangtttgggaggatctactaattcccccgaacttnatcaag

SEQ ID NO: 99378 - DNA, 461 bp, Triticum aestivum
  unsure (1)..(461): unsure at all n locations
  Clone ID: PAT_TA_99378
gcgtaatacgacccactatagggcgaattgggtaccgggccccccctcgagtttttttttttttttttttttttttttttttgattcaatgctcagtttgactgaccaaagttgtgcacactgctatagtacatgttgttgtcaatggacgcacaaccttgaaaaactaacattaaattgactgataccagcagcagcagtagtagtactaattaagcaggtaaanatggacatggtnggtgaagccccaaaaaggancttgnaaccggntatgtgttaaaaaaaccttgagctgtccccgatggaangcacaacaaatacaaaangcacgcacggcccaaaaaatttggctactactaanacaacaatcaaacaacgggaaaaccccttnancaaatccntgcaactgcaaaaattcccaatcaatcatcaatcaagaagnttaaacanaatgcaaatgc

SEQ ID NO: 99379 - DNA, 240 bp, Triticum aestivum
  unsure (1)..(240): unsure at all n locations
  Clone ID: PAT_TA_99379
aacccactaatagggcgaattgggtaccgggcccccccttcggtccgtataaccgcgccccccgcatctcctctcgccccgcccccgcccccgcaccgcgtctcgctnatantnactcntccgtatcgcntctnttcctcccctctcngccctaccctcccctctcccgccgcgagcngcatcccaccngactgccngcccggggggtcctgcancggccgccaatcncgtcttntggaa

SEQ ID NO: 99380 - DNA, 377 bp, Triticum aestivum
  unsure (1)..(377): unsure at all n locations
  Clone ID: PAT_TA_99380
cgacccactatagggcgaattgggtaccgggccccccctcgagttttttttttttttttttttttttttttttttttttttttttttttttttttttttttttttgttgggcaacaagngaaaaanntgatgataatggagtagtancaaagtngggaaacaaanccgtgcttcacgttncattcatttanaacncattanaacccatttattcggananggcctantcccttaatcccaancttcttaagggccctccnccttcaatcaaacttgcaccttttantcgganacggnttaccccctttattccaagcttcnaaaactgnccncccccttcgttccanctnaaacctnacnccngcanagctatccgc

SEQ ID NO: 99381 - DNA, 533 bp, Triticum aestivum
  unsure (1)..(533): unsure at all n locations
  Clone ID: PAT_TA_99381
cgtaatacgacccactatagggcgaattgggtaccgggcccccccttaattcaagagttatagggagggacttangtcaccacaaacagaaactaaagcaggtgttggatttcangctggtgtnaaagattataanttgacttactacaccccagagtatgaaactaaggatactgatatcttggcagcattccgagtaagtcctcagcctggggttccgcccgaagaagcaggggntgtagtanctgccgaatcttctantggtacatggacatctgtttggactgatggacttaccagtcttgatcgttacaaaggacgatnctatcacagcgagcctgttgctggggaagacaaccaatggatctgttatgtagcttatccattagacctatttgaangagggttccgttactaacatgtttacttccagtgtacgtaacgtatttggtttcaaagnccctacgntgcctctacgtttgggagggatctaacgaaattccccccctacttaatccaaaaaaccttttccg

SEQ ID NO: 99382 - DNA, 246 bp, Triticum aestivum
  unsure (1)..(246): unsure at all n locations
  Clone ID: PAT_TA_99382
gaattgggtaccgggccccccctcgagtttttttttttttttttttagagcaattgaatcatttccattcatattgtttgccgttgagcaaacactctactangattgagttcntttcttgccaccaggcaaaatttcaaagaagcgatgggcgctccgccgggccaccagctaagaaaacatcgccatgacgtaaactgtgacatttttctctnctnacntgtgcaagggctnaatnacatggta

SEQ ID NO: 99383 - DNA, 520 bp, Triticum aestivum
  unsure (1)..(520): unsure at all n locations
  Clone ID: PAT_TA_99383
gatattgggtaccgggcccccccttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacancgagcctgttnctggggaangacaaccaatggatctgttatgtanntnatccattanacctatttgaagagggttccggttactaacatgttnacttccattgttggtnacgtattttggttttcaaaagccctaacgtgccnctacgtntgggnggattctaccaattccccntaccctaattcanaaaacttttccaagggccgccg

SEQ ID NO: 99384 - DNA, 443 bp, Triticum aestivum
  unsure (1)..(443): unsure at all n locations
  Clone ID: PAT_TA_99384
atacacccactatagggcgaattgggtaccgggccccccctcgagtttttttttttttttttttttttttttttttttttttttttttttttttttttttttttnacaaccaggaaagggatttcattgcaattcttccacggatcaaccacgnggnanattcatcgctganttaactgcanttgtgcananaattccttcccananagagtacnaccaaatactaacagatnccacaggctctgcccccaaaaaanaanaaaggctaacacagggnaggtacctaacttgttaaaggncccgaaaaggananttttacatggntaantaaaggtcncttggngttcccctaaccttcnttgccangnttgacctttacaaccatcaaannntttccgcaaccaaaantcggcnncccctttccncgggtggtgccntttcta

SEQ ID NO: 99385 - DNA, 490 bp, Triticum aestivum
  unsure (1)..(490): unsure at all n locations
  Clone ID: PAT_TA_99385
taccgggccccccctttttttttttaagtgtcggtcttattcttatggagagaaaatggtgcctcgcaaaacttatacaattttgatggagggtaattttaccaaaattaaagtttcagaagttcagtaaaccctgaatacactggccaacctgtaaatctttcatttttaatagcagcagtaatggacaccagaagcttttcttcagacagcaagggcttgagctcaaccagaaccttcttcacaatctgaggcttgatagagatgacgatcacatcactgtcctcgacaacctgggcgttggaggcgaggatggtggcgccaagggaggcgaaggcggcgcagcgctcagggtggcggtggaccgtggtgcgggatggcggaggccgagaggacacccgacgccgccacgccacatgcgatgctctcagctaggttccccataccgacgaangcctaggcggcggaacacatcaacgcccnttcacga

SEQ ID NO: 99386 - DNA, 596 bp, Triticum aestivum
  unsure (1)..(596): unsure at all n locations
  Clone ID: PAT_TA_99386
tacgactcactatagggcgaattgggtaccgggccccccctcgagttttttttttttttttttttgaatgaactgaataataaactgcatggccaacaatatattatcttacagtttatgctgccagcgaatgatccaatcactcccttggataacagccttttcctcaaataggagtaatgccatggagtactaatcaaactgacatggtaaaaatatcatcaaaaatgcaaacacaactcatcacaatatcacggtgtaataagtcataggtaaaccgagcaatggattgaaaatagcagtctgcataactaggttccacatatgataatttgacctctcaacgtaccagactagccgccacgggacaccatgtccagtaactcctccatgaccaaaggacagcttgccaccaaatgcttgaaacaatcggttgccataacaagcttgtagaacattccgtggagccataaactcaatgcaggcttctttgnngatcctgcagtggtgttgctctgccaanaaccaatgttggttgcaacagtcnccangtcaaatgncnctcaagncantttactttcanacattcnnaantg

SEQ ID NO: 99387 - DNA, 268 bp, Triticum aestivum
  unsure (1)..(268): unsure at all n locations
  Clone ID: PAT_TA_99387
ttacaccnctatagggcgaattgggtaccgggccccccctcgagttttttttttttttttttttttttttttttttttttttntttttttttttttttttttttttttttttttttggaaagttaaccaacattcttgttnganaaaccaatcaaatactgttacatgtccncatcggacgganaatcgtanaggtnaaaaaanaanccgcantagcncttgttttgtttcananaacccatntctgttccatgcatcccaagcccca

SEQ ID NO: 99388 - DNA, 594 bp, Triticum aestivum
  unsure (1)..(594): unsure at all n locations
  Clone ID: PAT_TA_99388
acactcactatagggcgaattgggtaccgggccccccctcgagttttttttttttttttttttttttcattaaagtaaaagaactcatattgtatatctcttttgttctcaccataaactgaaagaaaaaaaaggtagaaatacacatttttggacggttggtgctccctcagttcaattttgcaccaaattgcaacgcgccaggatatgctcacgagcgcttcttgtgctagcagcagggcggcgaagcttcctggtaggtttttgcagcctacatgcgttgaggagcactcatctgtttattagcatcaagaaacatgtgatagccatgagaggggtaaccaactaatctaccaacaattccatgtcacttccaaatgctacgatnagcaaccacacaagttcgccagcaagcaattaaactgaattcacctggggccatggaaatggagatgttggcgaggatgtggaactttgtcggtgcaatccctanacctccaagaagaaattgtanaccttggcgatnnccgaagacatgtcaggcgcccgcaagggccattggggcatgttnccacaagcnccangtggtcaatg

SEQ ID NO: 99389 - DNA, 421 bp, Triticum aestivum
  unsure (1)..(421): unsure at all n locations
  Clone ID: PAT_TA_99389
ctaggatggcgaantgggtaccgggccccccctcgaagttttttttttttttttttttttntttttttttttggnaagaagcgttttgtttgcatatacaattctcatgaattttaagcacacgtcaattttctctaccgttgcaacccatgagcatgtttgcnattactaatcaatgtgtgcgctgttgtttggcattcaaagatcaatgtacatccacatcaatcatgtctccctanaccgctcacataacgcanccacagcgaaaatcagaggaaaatanttaataccaacactggcatctgcaggcanctggccaaatgcagtaataggccagtatggttgctattggtacaagancaaggggtanaaaganccngggttccaaggtgtncggtangggnccnggaggnaccaattg

SEQ ID NO: 99390 - DNA, 527 bp, Triticum aestivum
  unsure (1)..(527): unsure at all n locations
  Clone ID: PAT_TA_99390
tatacagccactatagggcgaattgggtaccgggccccccctttttacatagccaccgattgcattcacatacgaggcatgctttctcgagccatgttggtacatgaacgtggacatacacatattcttaggaacaaacaagaaagataaatggagaaggaaaacccaaagcaatgtcagagttgacaaaaccgcantggcactttatatgtggcccgtggtgagtgagctgtttaggccttgccggactcctcgcagcccggtggcttgaaggcgatgaanctgacgcactgcacctggcgcatgttgtcgaatccgatgatgcggacgtacgcgtcagggtactccttcttgacctcctccacctcgttgatcacctgtgttgcgtcggtgcacccgaacataggcagcttccannttgtccantacgcgggcatccgtaggtagnccagngggatgcngtggtgctcacgggaagatnangcccaanccttaactgaaacttcgnggcaanggcancccaactt

SEQ ID NO: 99391 - DNA, 581 bp, Triticum aestivum
  unsure (1)..(581): unsure at all n locations
  Clone ID: PAT_TA_99391
tagactcactatagggcgaattgggtaccgggccccccctcgaagtttttttttttttttttttttncccagaaaacactcacacgcacgggctgagaaaccagccgtcccggctgctgctgccgaggcactggcctatggccgtctccgactctgctaaaatcccagtcatgtccctctcctgtgtcatgcctgaggaagggcacaggccgtttttaccaacccgttgcgttttctactgtacacacagatggtcatgctacctgcttgctgcggctgttaacagaccggctgccacttcctgctgctcgagccagtcctggatggccgagcggagggcgatgttggggatgagctcgtcgtgttcaagcggcaggttggtcatcggagacgtgtcgctgcccgtgctgaaccaagctccggatgaaatcgccttcgtaggtgaaagcccgtccgcccgcaatgtgagggtcgttcaacacatcctgggaaataggacagattaagtacnaaggtatgtggttttcatcancactgatcccgaagacgaagggcaaactnagttcgttgcccncaagggg

SEQ ID NO: 99392 - DNA, 336 bp, Triticum aestivum
  unsure (1)..(336): unsure at all n locations
  Clone ID: PAT_TA_99392
tagacncactatagggcgaattgggtaccgggccccccctcgagttttttttttttttttttttttttttttttttttttttttttttttttttttttttttttnccaanaaaanaagcaaaaaactttgttccannattcatttcaaacnaaanaggaaatancnaattaaacaagtcggggtttcancaggcttccggaatcngcaggccacaanaaaaacngacnaccgtcggcnggcccttagccgccaaanccgtanagggtgnggcccnggccctngagcgcgtanacaaggtcaanggccggtgacggncttgcggcgggcgtgctcgg

SEQ ID NO: 99393 - DNA, 420 bp, Triticum aestivum
  unsure (1)..(420): unsure at all n locations
  Clone ID: PAT_TA_99393
tacacccactatagggcgaantgggtaccgggccccccctcgagttttttttttttttttttttttttttttttttttttttttttttttttttttttttttttttttaaananagcanacttttttattgatggctatntacccananatnaaggaaacaaattaagacntnacaccaaatcgaaacatggncgaaacanttcatcaanattcaacaggtanaagagcgcatggttcatccanaccaaatcgccgganaaaaacancacatgatgaaccccaaaaacagcggngaanggtctacaggaaccacatgacgacggcccaaacngggtanattaaaaggaggaggatncctatggntttggaccangccatngggcttctngaaggcctccttngaggncccccnacgcctt

SEQ ID NO: 99394 - DNA, 441 bp, Triticum aestivum
  unsure (1)..(441): unsure at all n locations
  Clone ID: PAT_TA_99394
agggcgaantgggtaccgggcccccccncgagtttttttttttttttttttttttttttttttttttttttttttttttttttttttttnaccaaaagtgaggntcnccttaanaactganaccacccttcgngccgtggttctacctattaacttccantacagcattacattcattttacaacaaatgttgtccaagcaaaaaaaagaatggaaggccgccctcacngggcgaaaaaacacanacatgattctacagctgcacangtttttgccttttttagcaacaacaagaatcatangcntatatcnagaagccaaaattcangtctantgnaanacgtacccaccanaccgnntaacagattatctngaaggtatgtntnancatacaatgcctgcttncgatntccnnggggcggccaacgtnggtcttttgga

SEQ ID NO: 99395 - DNA, 296 bp, Triticum aestivum
  unsure (1)..(296): unsure at all n locations
  Clone ID: PAT_TA_99395
tacganccactanagggcgaantgggtaccgggccccccctcgagtttttttttttttttttttttttttttttttttttttttttttttttttttttttttttttttttttaaaaaaaaaaattaacnccngngacaanaaaaaattccaggcttgttaggccctnanctataaaccccaacccgatgggttgtttcnaaatttgttnaaanaaaaatgtacctaanacaaaaacgtgncnaaatanatccanatctaaaacaaaaaattcgggacgnggggggtaaatttgngg

SEQ ID NO: 99396 - DNA, 571 bp, Triticum aestivum
  unsure (1)..(571): unsure at all n locations
  Clone ID: PAT_TA_99396
atacganccactagagggcgaattgggtaccgggcccccccttttttaaaaaaataacatcgtgtcgagcaagacacggtatgtcacttggattcaaattgaacagaccacttgccaacgccaacgccaacgccaacgcaacgccaggtaattcacaaagctaatctgcatgcgaattacagcattttcccagtgaaacaaagcagattgccttcccgtggacaaacatgccgcatcaaccccgaagcactaaacacaaggatggtcggggcagccagacaacttgagccacccattgccgatcggccagctctgtctgtcaatgatcactcactggctgacggctccatcctctgcgttatcaaacgcaccgcggcgttggcggcggagaaggnccccgtggaagctctcctggtnacgacagctcctgcaggatccccgaacatcntcatcanggatntcttccacgtcagattgcttngncgtnagggactccgtgggnacgaacttncnggggtgttgctgaangncaacgttgggccgggctctgggnagtactcatnntcaaccn

SEQ ID NO: 99397 - DNA, 404 bp, Triticum aestivum
  unsure (1)..(404): unsure at all n locations
  Clone ID: PAT_TA_99397
acactcactatagggcgaattgggtaccgggccccccctcgagtttttttttttttttttttttttactacntttctgcaaccaaattggcagcattgcccactgataagcgcggcgcggcacggcccggccaaaatgaatggataccgcaagtcaattcacgttaaacaaaaccaaaccatacccatacccatactagctagctagctagctacacatgatgctaactactactactgttgatatatagatactcctangtgcagacacacacacacacacacacacacacacacacacacacacnggagagagangatagtagcatncgancacggatgaaatcattgactcccctccaanccaagaccatcancgcagcaangtagtangattcaatattc

SEQ ID NO: 99398 - DNA, 400 bp, Triticum aestivum
  unsure (1)..(400): unsure at all n locations
  Clone ID: PAT_TA_99398
tacganccactanagggcgaattgggtaccgggccccccctcgagttttttttttttttttttttttttttttaaccaacactagcanaattacttatgaagaactacctcatagtaggcacttggnaacaaagttgtataattaacatccaagttcaaagcataaangaagtgcgagttatcaggtacancaccaccancattgtcactatatctcggttatgaancnaggtggttgacttcagcacccagcnactgagcttcagcccaaacttcattcacnggcagcagacttgcttccccaaaagtcccagtnggtacgtttgcctttttgnntcgaanagtattcatcaactagtngccaattccngccccgtgggattctttctggggattgaaa

SEQ ID NO: 99399 - DNA, 579 bp, Triticum aestivum
  unsure (1)..(579): unsure at all n locations
  Clone ID: PAT_TA_99399
acgactcactatagggcgaattgggtaccgggcccccccttcaagagttatagggagggacttatgtcaccacaaacagaaactaaagcaggtgttggatttcaagctggtgttaaagattataaattgacttactacaccccatgagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagaccntatttgaaagagggttcccnttactaacatgtttacttccattggtntgtaacgtanttgggtttcaaagnccctacgtnctcctacgtttggaggatctacnnaantccccctaacttattcaaaaactttccnaaggcccgcctcanngggtatccaaagtttaaaaganaatnanttgncacaangtaccgg

SEQ ID NO: 99400 - DNA, 561 bp, Triticum aestivum
  unsure (1)..(561): unsure at all n locations
  Clone ID: PAT_TA_99400
actcactanagggcgaattgggtaccgggccccccctatcggtgcggacgaattacggctccgaaacaaaattccccgattcacttcgatccccacctatctcatccgtgcctgcagtctcactcgttgtcgcggacgtcgattacggtcttcttgaactgcctggctggcaccttgcggttgaacagaatgtccaactcgcggtacgagcggtgcttgaactcgggcaggccgaagtaagctgccacccaacacacgagagccgtacttccccacacgtagccgcatttgccggccatgttccagcccgtggtgttgagcatttgagaggctaggtagatcatggggatttcggcgacgtagtatgctccgcggccaacacccgtgctcaaagcacggagacggacggaagaggcttccgccgatgatggagtaagagatcggacccattgcgcctgcgaagacggttgagaatangattcctagcacggcttgggggnnnttttgttgcttgggtttgaagtgatnggaggcgcaanattccgagcaannttgaggagg

SEQ ID NO: 99401 - DNA, 445 bp, Triticum aestivum
  unsure (1)..(445): unsure at all n locations
  Clone ID: PAT_TA_99401
gaccactatagggcgaattgggtaccgggcccccccttttttttttttttttttttttttttttttttttttttttttttttttttttttttggtccttaccaaaaaggtntacncaatatctttatatattaacaaaanatgcccagcaatcgcttggatgcgatgcggtacttaggtacaaaggataaaaatatcagatattaaattggcatgcttaaaaggngtaaaggcagctgccgtcgtcactcctcnccgttgggtcaaagttcttggcantcnggtcggtgcatcctgccggcanaggcaaagtaccttgctgtgcccctttacctcctcctatgcancaanaaatggngggtgtgtatgganaatgttcnaaccgtanaaggaaccantcttcatcgcanccnggttagcancanccanagctggctggctcaagt

SEQ ID NO: 99402 - DNA, 576 bp, Triticum aestivum
  unsure (1)..(576): unsure at all n locations
  Clone ID: PAT_TA_99402
cgactcactatagggcgaattgggtaccgggccccccctcgagttttttttttttttttttttttttttttttttttttcaagcaaaactaaatgtaatttaagggcatgcaatgtgcaattcgatcctgggggcaatttaaaagaagtgattattgttgtagcaanccacaatgtcnccataggacgaggctgttatacngctctttttcaccaagtggcgctactgaaaaacattgcacccaccgatgaacacacgttgaattacattcctttcggcacaggcagattancatcaaatcagtcagcacacaaaangactagaacagacttcctcgaantangaacatctacnaaccaangtaggacactaantcanacncccncgattcgagnacgacgatgataagtnccacctngaggaacatgaancccgcaggagcaacctnttggctggacatananaacgaattacccaangnnttggaggaaaaggggtggncccgcaaancttggannggcnaaccaggaacccatcctnaattnccgggnaagtntgncacccgtnacccaacca

SEQ ID NO: 99403 - DNA, 290 bp, Triticum aestivum
  unsure (1)..(290): unsure at all n locations
  Clone ID: PAT_TA_99403
gagcactatagggcgaattgggtaccgggccccccctcgagttttttttttttttttttttttttttttttttttttttttttttttttttttttttttttttttngcgggaaaatgaancnatggaattttgttgcccgttcattganatttacatgaaaatcaaattaataatcaagacataaaaaaacccccgcnngantaattaacccnaaaaattggtgananangctccacggaagcaangccaccnaantagcnggcnaaatggggacttggtaanaggtccc

SEQ ID NO: 99404 - DNA, 533 bp, Triticum aestivum
  unsure (1)..(533): unsure at all n locations
  Clone ID: PAT_TA_99404
ncccactatagggcgaattgggtaccgggccccccctcgagttttttttttttttttttcaagaaggttagtggcgcccacgggcgtcaccatcgttggctctgagcagagcatggctttcgccaagttgaacatacacacacaccctatgaacagattatttgaggtagaccgcgaacctgcatcaccatgaagcattgggccatggcagccccgacgccgcacatggccagaactccacctcccagccacccactgccgtgcagccagcagcgagccgccaccacgccactggacggagtaaccgccacgccacaaaactcgctggggccgaagtcgccagatctggtcagcaccggactgggattcccaaccacgccgcccgacgagcgtcaggccaacaccgctgtgcaccacggcgcgcccagccagaccgggaagaaggtcaagaccagcgggccgtaccagcacccgaagtcgatgcagcacacggatnnngggcacacanccccgccagaangggcatncccttt

SEQ ID NO: 99405 - DNA, 524 bp, Triticum aestivum
  unsure (1)..(524): unsure at all n locations
  Clone ID: PAT_TA_99405
cgacccactatagggcgaattgggtaccgggccccccctcgagttttttttttttttttttttttttttttttttttttttttttttttttttttttttttttttttttaaaanaanactttatttgtatttattccanaatttaactacaactttgggngggtcananatgatgttgtgtgacactttatttgtcaccacttccccnanatgtccatcgacnanatnacggtnttccaactatatataacnanacatcttttcntaacagtaggcaccaaccccggtgccaacnccgaanggcanactagnggnggagctgtacaatggaanattgacacngcanatcgttggnagggtacgggncgnaatggaagtcancaccncaaggngagctatctggngtggctgcaaaaaggnaccctgttgtacctgttgtttgttgaggctgttgacccantttcctgttgnggttgttgngaaaaaacattgtccnaagctgccgctgcgactgnctgttgggg

SEQ ID NO: 99406 - DNA, 512 bp, Triticum aestivum
  unsure (1)..(512): unsure at all n locations
  Clone ID: PAT_TA_99406
cgaattgggtaccgggccccccctcgagttttttttttttttttttttttttttttttttttttttttaagcaaaaccacgggagattttatttaggggttacatgcatggaatggcacccgctctgctcatgcaggcaggtgcgtacatacnacatacatacaaagaccctcgatcaggtggcattacatggtactagatggntacgtacatnatagatatgatgcacgcggcgcatgcatgatcaatgatctancanctgcagcaggagcagccgcagctggtgccgcacttgcactgggtgcagccgcagccgccgttctcggccgccatctccatgccgccggngctcgccttgtgagtggcagtggcggacacgaggagggtggcgccggcggcctcaacctcggggtacatgttgcanccaccgcagccnttgncgcacttgcaggcggtgccgcacccgcaggttcctcccgcnagcaggacnatattccgngggtgcttgggtg

SEQ ID NO: 99407 - DNA, 528 bp, Triticum aestivum
  unsure (1)..(528): unsure at all n locations
  Clone ID: PAT_TA_99407
gacccactatagggcgaattgggtaccgggccccccctcgagttttttttttttttttttttttttttttttttttttttttttttttttttttttaaccnnccggacgattttggcccgttagtgagacataaatatatatcanaaattaagccttacatgtacaatgaaattgtttggaatgggaagggggctgcattcantcgtttgtcgtgctanaattggccatgaagtctgtanaattatgtttttatctgagtcnatttttgcgagcgtacgtgccctttcttgcaccacgtgtcacaccgcttttttcctggccnccttggcacggnccattttacggataccgaggganatgctgaggacgtacccatcgacgaggggctcaggcaccacgganaanaggaacnacaggagggcgtncggncattaggggcncgcaccgnggctcgtacccaatgtancgcacggnggccccgggcgttacttctccgcgngtacggggcgaaaanggggacccctgcc

SEQ ID NO: 99408 - DNA, 526 bp, Triticum aestivum
  unsure (1)..(526): unsure at all n locations
  Clone ID: PAT_TA_99408
cgacccactatagggcgaattgggtaccgggccccccctcgagtttttttttttttttttttttttttttttttttttttttttttacaaagccaccgattgcattcacatacgagcatgctttctcgagccatgttggtacatgaacgtggacatacacatattcttaggaacaaacaagaaagataaatggagaaggaaaacccaaagcaatgtcagagttgacaaaaccgcaatggcacttatatgtggcccgtggtgagtgagctgtttaggccttgccggactcctcgcagcccggtggcttgaaggcgatnaagctgacgcactgcacctggcgcatgttgtcgaanccgatnatncggacgtacgcgtcagggtactccttcttgacctcctccacctcgttnatnacctgtgttgcgtcngttcaccccaacataggcagcttccacattgtccagtaccggccatcgnnggtacccaggggaatgcccttntgcncacgggagntgancccaaccnt

SEQ ID NO: 99409 - DNA, 352 bp, Triticum aestivum
  unsure (1)..(352): unsure at all n locations
  Clone ID: PAT_TA_99409
atacgncccactatagggcgaattgggtaccgggccccccccacccctcgngagcgagcgggcgagcgcaaccgatggcgggatcctccgccgtgtacacgtcctgcaggccgcacgcgcacgccggccaccgcgccttcctcctgcccgccgaccatgcccaacggggcggcggccagctcggcctgctccccgccggcaccacggccgcggcgtgnaggaggggcggcgcggcgccgagggccagcctggtggcggcgcggacggccacggaggaggcggtgtacgaggtggtgctgcggnaggncgcgctggtggaggacctgcatgggctgnggncggctcgggaggc

SEQ ID NO: 99410 - DNA, 526 bp, Triticum aestivum
  unsure (1)..(526): unsure at all n locations
  Clone ID: PAT_TA_99410
gacccactatagggcgaattgggtaccgggccccccctcgagtttttttttttttttttttttttttttttttttttttttgcttaaggtacttgattcattcataaaaacctcttgtacaagaaaacacaccgaaaacacaccaaccacaccctcacactcgcctgagacagcgacacacacgcanagctgttattctgaactctcaactccgcagtgcagatnataaacggggcatcgcgggaatggcagaagacctagcggtacccacgcatgcaaaccgatcataattagcaccgtcgaccactcaccgattaccaacccncttatgatgagatttcatcgctgggcaggacgggggtagacctgactcagtggtgcccgtggtatccaccaccgccgccaccgccnccgtangttggcgtgggagggacggggtggtantccgggtggggctgcggcttgggctcgggcttgggcacggggccgtattcagggntgggggctgggggcttgggctcccggt

SEQ ID NO: 99411 - DNA, 522 bp, Triticum aestivum
  unsure (1)..(522): unsure at all n locations
  Clone ID: PAT_TA_99411
gacccactatagggcgaattgggtaccgggcccccccttttttttttttttttttttttttttttttttttttccagggcacctgtgttaacattgcaataccaagaacatcagaagaacaaacaatttgatcaaatcagagagagatttctgacgttttccctctacgcggnanagatctacatcgaaacagcaattacngttactacagaacaccagagcggctaagctaatctcagagagatttgcgaactgttttctttcttggcagcacagatctacatcgacgccattagttttacagagcactaggacaagctaatggatgcgcgcctctctctaagccttcttgtcggccttcttgggggacttggcggccttcttgggcgacttgggctccttctccgccgtcttcttgggggagcagcaccgggttgatgttgggcagcacgccncccgtgcgcganggccacgcccgggccagcagccncccngaggctcctgggccgttcccgggacggc

SEQ ID NO: 99412 - DNA, 527 bp, Triticum aestivum
  unsure (1)..(527): unsure at all n locations
  Clone ID: PAT_TA_99412
aganccactatagggcgaattgggtaccgggccccccctcgagtttttttttttttttttttttagtcgacagatngtanaaatatatnatgtgcatgtgcatatacatagccaccgattgcattcacatacgagcatgctttctcgagccatgttggtacatgaacgtggacatacacatattcttaggaacaaacaagaaagataaatggagaaggaaaacccaaagcaatgtcagagttgacaaaaccgcantggcactttatatgtggcccgtggtgagtgagctgtttaggccttgccggactcctcgcagcccggtggcttgaaggcgatgaagctgacgcactgcacctggcgcatgttgtcgaanccgntgatgngggacgtacgcgtcagggtactccttcttgacctcctccacctcgntgatnacctggtgttgcgtcggggtgcacccgaacataggcaggcttccaacaatttgtncnagttgcgggncatcgntaggnacncaagggggantg

SEQ ID NO: 99413 - DNA, 415 bp, Triticum aestivum
  unsure (1)..(415): unsure at all n locations
  Clone ID: PAT_TA_99413
taccgggccccccctcgagtttttttttttttttttttttttttttttttttttttttttttttttttttttttttttgggnaaagatgttccncantattaattaccccaananatagtccananatngtaaaaatatatnatgtgcatgtgcananacatagccnccgatngnattcanatacnagcatgntttcncgagccatgttggganatgaacgtggacatanacatatncntaggaacaaanaanaaagataaatggngaaggaaaacccaaagcaatgtcagagttnanaaaaccgcaanggcactttanatgtggcccgtggngantgagctgtttaggncttgccggactcctcgcaacccggnggnttgaaggcgantaaagcttacccactgcancctgggg

SEQ ID NO: 99414 - DNA, 520 bp, Triticum aestivum
  unsure (1)..(520): unsure at all n locations
  Clone ID: PAT_TA_99414
cganccactatagggcgaattgggtaccgggccccccctcgagtttttttttttttttttttagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctnacgcactgcacctgacgcatgttgtcgaanccgatgatgcggacatacgcgtcagggtactcttttttgacctcctcnacctcgttgatcacctgtgtggcgtcggtgcaccccgaacatagggcggctnccanattgttccagttaccgggcaatcancagntacccaagggngaatgcgt

SEQ ID NO: 99415 - DNA, 273 bp, Triticum aestivum
  unsure (1)..(273): unsure at all n locations
  Clone ID: PAT_TA_99415
taccgggccccccctcgagttttttttttttttttttttttttttttttttttttttttttttttttttttttttttttttttttttttttaanacgcaangttttananataaatcaancaancaaccacnaaancaagattaaagaaagananaaanaaagaaacaagananaangtaggggaaaaanaatttanaagccaaaaccncacnaaaaatttctnaaaaaanctncaaggagtatnaaaaacccncgnaaacntnaaaancggg

SEQ ID NO: 99416 - DNA, 506 bp, Triticum aestivum
  unsure (1)..(506): unsure at all n locations
  Clone ID: PAT_TA_99416
ganccactatagggcgaattgggtaccgggcccccccctcgagtttttttttttttttttttttttttttttttttttacatagccaccgattgcattcacatacgagcatgctttctcgagccatgttggtacatgaacgtggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcancccggtggcttgaaggcgatnaagctgacgcactgcacctggcgcatgttgtcgaatccgatgatgcggacgtacgcgtcagggtactccttcttgacctcctccacctcgttgatcacctgtgttgcgtcggttcacccnaacataggcagcttccacattgtccagtaccggccatcggagtacccaggggatgcgttgtgctcacggaagatng

SEQ ID NO: 99417 - DNA, 518 bp, Triticum aestivum
  unsure (1)..(518): unsure at all n locations
  Clone ID: PAT_TA_99417
canccactatagggcgaattgggtaccgggccccccctttttttttttttttttggtcgtcatacgttattctagattataacattttacatcatgccaccttccctaaccaaacacagaaatgatgtantgaaactaacttccaanaaaggaaatgggatgtggcagcatgcangctgtaaatacagtaatagatataggcaataaaagcatcacggaacantcttcaaaaccttcatcttatcaatccatgcgttgaaggacttggccgtgttacggaagctgaggaatccatgctccctgctcttgttcatgctatccagntgctcactcttggacattgancacggnatcgaggaaccaccanttggccgatctcttggggctccgtcgtgacaagctcgttctccctggagggatntctgccccacaccgccttccttcccgattatggcgtcgggngagcatggaacgggcngtcctctccctcgtannccnggcccactccaaccccngat

SEQ ID NO: 99418 - DNA, 243 bp, Triticum aestivum
  unsure (1)..(243): unsure at all n locations
  Clone ID: PAT_TA_99418
gactcactatagggcgaattgggtaccgggcccccccccgagttttttttttttttttttttttttttttttttttttttttttttttttttttttttttttttttttttttttttaanaaaacttcaatatnggaattgattcannaggnaacgctccncnaaaaacctgacctagctanacaacgtcaanacngaaanaaaatcaaagnggttnggacgtccttccccannaaanggccaa

SEQ ID NO: 99419 - DNA, 542 bp, Triticum aestivum
  unsure (1)..(542): unsure at all n locations
  Clone ID: PAT_TA_99419
anccactanagggcgaattgggtaccgggccccccctcgagacatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccangtcttgatcgttacaaaggacgatgctatcacatcgagcctgttgctggggaagacaaccaatggatctgttatgtagcttatccattagacctatttgaagagggttccgttactaacatgtttacttccattgtacgtaacgtatttggtttcaaaagccctacgtgctctacgtttnggaggatctacgaattcccccctacttattcaaaaactttccangggcccgcctcaagggtatccaacgttgaaaagn

SEQ ID NO: 99420 - DNA, 304 bp, Triticum aestivum
  unsure (1)..(304): unsure at all n locations
  Clone ID: PAT_TA_99420
gagccactatagggcgaattgggtaccgggcccccccggcgagntttttttttttttttttttttttttttttttttttttttttttttttttttttttttttttttttttaaaaagggnaaacngttaangaaaatattattaaacttaaatataatgtcttttgatcacaggacgatnaaatnangcaccanacgggnagtanaattccccgtcanaaaatggtaaaaaaaaaagggttctattgcttanggngaattcanatcgggccatcccgggntccagtacgggaaaacaacgagta

SEQ ID NO: 99421 - DNA, 416 bp, Triticum aestivum
  unsure (1)..(416): unsure at all n locations
  Clone ID: PAT_TA_99421
ccactatagggcgaattgggtaccgggccccccctcgagtttttttttttttttttttttttttttttttttttttttttttttttttttttttttttttttttggaacaannaaggggcnatttgatttgncccggaaanaaaatgtcgtaaacananatgcnaaaccccaanaaattgctgtaccacctanatatatnnccatacagccatacanaaaaagagtanacncacgtggttaactgnaacngtagccctnggggttttanatccanagnaaagttncagtttcngtaccccccaanctncangtctngggggctgaaaananattattcangtcnagcgaancganactgaacncgtcnatttggggctncangccnctacaatggggtaggacncanaggttgcaa

SEQ ID NO: 99422 - DNA, 520 bp, Triticum aestivum
  unsure (1)..(520): unsure at all n locations
  Clone ID: PAT_TA_99422
cgaattgggtatcgggcccccccttttttttttttttttttttttttttttttttttttaggcaaaccagataacatgcatattgaccaacgngngaagcaggttcaaacataccacaggttcatacaacacaacaggttgtaaaccaaacaccacacagcaaacattcaaacagacagacnacagatagncccgcttgggcagatcacaggatagtagtagacnaaggcnagcttaacgtanatcaggncgcanactcagctnctctagtactcatcaccctcatcaccgtcctcgccctcgtcgaactcagngccaacttcttcatagtccttcnccagggcagcgagatcctcacgggcctcagagaactcancctcctccatgccctcacccacgtnccagtggacaaaggcacgcttggcgtacatgacggtcgaacttgnggtcaatgcggggagangacctcancaacgtttgtggngttgggggatnatgcacacgggccctcctggntcct

SEQ ID NO: 99423 - DNA, 484 bp, Triticum aestivum
  unsure (1)..(484): unsure at all n locations
  Clone ID: PAT_TA_99423
tatcagggaaagatatgtctacgtctgcaattcggcatcgtagctagagattatttttttggcaatactgggcgccggcgtgtcgcttcctagtcgccagatgccactagccctggctgttggatatatagcaaaaaaaagaaaaaaacacgattcgccccagacatcttcttcctcctgacgcatcttgccctcacgcagctccctgtctttcaccgtctcgtgtagctttccntagcggccagcgctgcgctcgccttccacttgcgccacccgcgctcatcctcggcctcatgctcgccggcgacccgctctcgacgacgcanccttgcgcccgcccgcgctcgtcctcggcctcatgctccgncggcaacttctctcgccgacgcatccttggntgccccacgctcggttcctcgggcctcggtgtttgccnggcaanccaaggctngggcggncggcatccttngggcgcccggttgcg

SEQ ID NO: 99424 - DNA, 493 bp, Triticum aestivum
  unsure (1)..(493): unsure at all n locations
  Clone ID: PAT_TA_99424
actatagggcgaattgggtaccgggccccccctcgagactagttccgaggtcacgccggacgaccagcacgagcacctgcgccccgagggcacggagccgctggcgcgcatcaccgtggactacacgccggacgcctgccaccacgcgccggcgtccggcgagatccacgtcacctacgaccaccgcggtggggcgcgctggcggtcgcgcggccgcttcctgccgggctgcgccgtggccgccgcggtccgcgcccccgccggcgacaccgcggggctcaactacaacctctacctgtcntcgctggagggctccaagcgacatggncnagattcgacttcgagttccctccggcnaacgaacaaagcgncgcccgtgtcnagaccancttntttcgtggtcngggggggcggctggtaagggganattggtccaaacancttccctttcggactccttgggnnggggtttcaaacaactatcnnccgtccc

SEQ ID NO: 99425 - DNA, 520 bp, Triticum aestivum
  unsure (1)..(520): unsure at all n locations
  Clone ID: PAT_TA_99425
acanccactatagggcgaattgggtaccgggccccccctcgagttttttttttttttannttttttttttttttttttttttttttttttttgaactgaaagagtangaactaanaagaacggtgaaaaatacactttactcgtcaaacatgatcaactagccatcctatcnggnagcatcaacngaataatgtacctgggtannctaagaaggnttgatacagcnaaacttgcccattggccgtcctgacacgccaggatacnaggatacgccaggatncacgtancccanagtatcccanaatttgcgaattaaaaaanataaaaatacaggggcacggctggganacntggatgatacattggggacacggtcagccgaaaaacagntacagcccaataccaanccctattttgcaggtttcgcaagtacgngtctccanaaaagaacanagtgcccaaagccctcccagggnagcaggcgaatggggctggnnancgcacgnctccntggactctg

SEQ ID NO: 99426 - DNA, 391 bp, Triticum aestivum
  unsure (1)..(391): unsure at all n locations
  Clone ID: PAT_TA_99426
cgaattgggtaccgggccccccctcgagtttttttttttttttttttcgntgcntttttatttatacctnctttatctttagttntanctacttnatcaatngtatcnaccggctcgaactctaanttgntcgccttccanacttcacaagctgcggctagttcaggactccatttgcaagctgctcgganaatttcattaccttcgcgagcaanatcgcgcccttcgttacgagcttgtacacaggcttcnaaagccactcgattanctgctgcaccaggtgcatttccccaaggatgtcctnaagttccnccaccacgnttgtnatacagaatcgtccccaagagatntcgggtnagagctggcatatgcccaaanatgnataccacct

SEQ ID NO: 99427 - DNA, 552 bp, Triticum aestivum
  unsure (1)..(552): unsure at all n locations
  Clone ID: PAT_TA_99427
ccactatagggcgaattgggtaccgggcccccccttttttttttttttttttttcacgaggaaaataattaataccaacactgcatctgcagcagctggccaaatgcagtaatagtccagtatggttgctattggtagaagagcaaggtgtagaanagctggttccaggtgtccggtaggcccgggaggcaccagtggctgcagtcggcggagccggccgggttgccgcgctgcgccggcgagaagtctccgctgtaaaccgacgggtgcgcgtccttccgcagcgccgacagcgccgtgatgtcgancaaacggaccgggcttttcatgccctgcagcaccgttttcgtcacctgctcctgggcccatcggctgcnccgtggagttgagcccattcaatgggggncgtctccccgtagcanttcttggncaccggggttggggccacctcccttgggagctgtantgggtggggcgacatggactgganagnagacacggggtcttgggncggggtccaacctttnagggtccancccaatttgggcccca

SEQ ID NO: 99428 - DNA, 511 bp, Triticum aestivum
  unsure (1)..(511): unsure at all n locations
  Clone ID: PAT_TA_99428
gaattgggtaccgggccccccctttttttttttttttttttttttttttttttttttnaggcaaaccagannacatgcatattgaccaacgtgcnaancaggttcaaacataccacangttcanacaacacaacaggttgtaaaccaaacaccacacagcanacattcaaacagncngacnacagatagtcccgcttgggcngatnacaggatagtantanacgaaggnaagcttaacgtatatcaggncgcaaactcaagctgctctagtactcatcaccctcancaccgtcctcgccctcgtcgaactcagcgccaacttcttcatagtccttctccagggcagcgnngatcctcacgggcctcaagagaactcaccctcctccatgccctcacccacgtaccagtgcgncnanaggcacgcttggngtanatnaggnccaacttgtnggccagtgcggggagaagncctcaacacanncttggttgnngttgggagatnatgcacacg

SEQ ID NO: 99429 - DNA, 447 bp, Triticum aestivum
  unsure (1)..(447): unsure at all n locations
  Clone ID: PAT_TA_99429
aattgggtaccgggccccccctcgagttttttttttttttttttanttcgttgcttttttanttataccttctttanctttagttttatctagttaatcaanagnatctacnggctcgaactcgaatttgatngccttccatacttcacaagctgcggctagttcaggacnccatttgcaagctgntcggatnanttcantaccttcgcgangcaagatcgcgcccttcgttangagctngtacanaggcttctaaagccactcgatnagctnctgcaccaggtgcatttccccanggangtcctaaagttcctccaccanattgtaatacaggaatcgtccccccacagatttcggtcagagctggcanatgccananatgaataccacgcnnaacgctnccggtntaaccacctggcaagggntncncactcctgagngaaaaag

SEQ ID NO: 99430 - DNA, 537 bp, Triticum aestivum
  unsure (1)..(537): unsure at all n locations
  Clone ID: PAT_TA_99430
atacgacncactatagggcgaantgggtaccgggcccccccttttttttttttttttttttttttttttttttttttttttttttttttttttttttttttttttttttttttttttttttttttttgaacaaaaaccacgacacttatncaccgaagggagtanttggnaananaagcanatgtagtaccgaaaanacnaaacaacctttttcactancantaaaaagcaaacncttttggnnaccccccatttacggnngtangttgatnatnttcccangccananggncaggngcaaagtacgatnatnatnatgttcaaacgggngnggctatacccncaaggggngtaaccatgganaggntgaccccaagcctttcanccatgtccagccccttcttcncgangtcaangggaagcccccacgggaagcgatncancanggacgcgancatganatnaaccatgcgaacggccaagcggngnccccggaaanatcccnccccccggacccgaanggnagggaactcccag

SEQ ID NO: 99431 - DNA, 533 bp, Triticum aestivum
  unsure (1)..(533): unsure at all n locations
  Clone ID: PAT_TA_99431
actcactatagggcgaattgggtaccgggccccccctcgagttttttttttttttttttttaccattaaaacgtanatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactcttttttgacctcctccacctcgttgatcacctgtgtggcgtcgggtgcacccgaacataggcagcttccacattgtccaagtaccggccatcaaagtacccaggaaatgcgtttgtg

SEQ ID NO: 99432 - DNA, 538 bp, Triticum aestivum
  unsure (1)..(538): unsure at all n locations
  Clone ID: PAT_TA_99432
tagactcactanagggcgaantgggtaccgggccccccccgagtacgcatctaatatgttgtgggagtctcaccaggaggcggcgacaacacatcgatcttcaccatctcgcctcctcctttttgtgcaccgtcgtagacaacactggaactgcgagcggcctccctcctttctgtcctcctctgcatgttgttcgctttgaagcagcacctcaccacaagcacctcacactttgtagtatttaatcactgttccatggaaagctcacaaatttttgataaagcccaaggattctccttcctactcctatgagtgatgagttgctctctttcaatttgatgtancccttgtctcttctgatttgattgttcctgatccaatctgtgcagtctgctgctgtgagctgtggatggccgtagcttcctctcacattcaaacatatctatttctctgattgctttctagaccacacccaaggacgcgcaagcgtcaggcaagctgcgcaaggcacaagcggctcaaaaaatcgctggtagca

SEQ ID NO: 99433 - DNA, 486 bp, Triticum aestivum
  unsure (1)..(486): unsure at all n locations
  Clone ID: PAT_TA_99433
agacncactatagggcgaantgggtaccgggccccccctcgagtttttttttttttttttttttttttttttttttttttttttttttttttttttttttttttttttttttaancgaaccacttcanataaacnatgaaataaacanatcangttcaccaaacgcanatcaaaanaccncgaanttaagcnctgagttcaaaanaccacttgccanaagtaacaaatctaanaaaaaancangtaaagatgatgggggnacnacnacaacnatccggnggaacctaggcgcggttgccaccgnggggtccgttnaagggctggnggtagggggcaacggcanatgcggcctcgggggcgcgctcaacgccggggaggtcggccangccgaggaacnccancatgtccatggncnccttggcgacgcgggntntcggtcgacctcggagcgccnanttcnccggcnaacaagtcccanggcggggg

SEQ ID NO: 99434 - DNA, 543 bp, Triticum aestivum
  unsure (1)..(543): unsure at all n locations
  Clone ID: PAT_TA_99434
tagagcactagnagggcgaantgggtaccgggccccccctcgagttttttttttttttttttttttttttttttttttttttttttttcanacatcaaaatacatncaacttcctttttgtacatcgaanatttanattgtgcanacaancanaaaaggagactgccaaaggtttcncangcttancacctngggaaattcatatctaangcacaanaggaaatanctctgtaattnanggtaaangatgacnaaatcctcatttttctgtctnctacctgtcatctnangcgggtatgcctaactttgaacccaaanagccctcgntagganaggatatgcgccatgcncacaaactgangangcaaaaccctacctcaacttggaaaagaacccnnaccgcttgatatgaccaagggnacctctnaagccanancggttaaaccgcccnaaggccagctcgaaacccaatctccatatntngcagaggggtcngttttcgattcgggggncgtganagaantcnccaaggttttttcccag

SEQ ID NO: 99435 - DNA, 356 bp, Triticum aestivum
  unsure (1)..(356): unsure at all n locations
  Clone ID: PAT_TA_99435
cgactcactatagggcgaantgggtaccgggccccccctcgagttttttttttttttttttttttttttttttttttttttttttttttttttttttttttttttttcaanaacaancccnnttttttaaaaaantanagataaanaaaaanttttnggggatacnnatggcaaaaantggctaatttgagtccccggaaaaaanatgcaggcagtaaatctttacggtctngccgtgncaacttggnaanagtggccgtgacnaggaaaccacccccgtcgggaangacaacnacaagcccttcgtcnccgccnganangatcctgtannaaanaagcangggcttgaggtccct

SEQ ID NO: 99436 - DNA, 333 bp, Triticum aestivum
  unsure (1)..(333): unsure at all n locations
  Clone ID: PAT_TA_99436
atgggtaccgggccccccctcgagttttttttttttttttttttttttttttttttttttttttttttttttttttttttttttttttttttttttcaaaaccaanacggnaaggatcctttgtannaacttttggncttccctggggnaccnaaaagtcacncacctcccgggnaaaaaaaagctanccnaaanaaanagaccctngcnacaaccctnnaagggaagganaaaacngatcccttccccnctgggaaggtcaattccggaaagatctnaggggnagccccaaccnctnccccgcgaaantcgggncccgccctctncaacgtg

SEQ ID NO: 99437 - DNA, 405 bp, Triticum aestivum
  unsure (1)..(405): unsure at all n locations
  Clone ID: PAT_TA_99437
cganccactanagggcgaantgggtaccgggccccccctttttttttttttttttttttttttttttttttttttttttttttttttttttttttttttttttttttttttnaaaaaagataagattaaatagcacnctgtcctaaacatgattgcttanccattttttattttangtanagtcacaaacngcgggctgcagcaccaccaacaaggcaggagtaganacgtagcgtgnacaccaacgcgtgcgcgtgcgtgctanttaccgccgggggnaaaagcctctggcggcgtgcatgtgggcgggatggccccggtgtacncntccttgcaaangttgagggaagggtccnacgtggacggnccncaggtcttgcaggngggagcgcantgctngacctc

SEQ ID NO: 99438 - DNA, 237 bp, Triticum aestivum
  unsure (1)..(237): unsure at all n locations
  Clone ID: PAT_TA_99438
agggcgaantgggtaccgggccccccctcgagtttttttttttttttttttttttttttttttttttttttttttttttttttttttttttttttttttttttttncnaaanagctttgaaattaaaagggnanggatgagccnangtaaaaggtgcaacnanaaagttaagggntccngtcanaaagatncacagnaaacaaggcancgnaggatcnaanaacgtanacngttaaa

SEQ ID NO: 99439 - DNA, 536 bp, Triticum aestivum
  unsure (1)..(536): unsure at all n locations
  Clone ID: PAT_TA_99439
atacgactcactanagggcgaattgggtaccgggcccccccctcgagttttttttttttttttttttaggaaaataattactattcattaattgcctgaacaagtaggtcaggcacatcacacgtacacatctcggctagactggagtacagcaaggaattgacagttcactcacgcatacggacgcgtgcatacatgtcgcataaatatatatgcacacacagtgtgtgtgcaaggtacagacatagacacactactgaaataacacacgcaggcaactttattttatttttttagtagctcatcagtatcgtacgagcactccatcaacgtanacattaagttccacacaagcgcgtccatgcatgcacgtaggaaggggttatattgaactagttgagagtgtcgcaagttggtggacaagctgatggggaagggcacactgacgccgcacttgccgggcacgccggagaccttgcccatgttgatggacttgatgctnggtggngaggctcttggangcacctgcacgctat

SEQ ID NO: 99440 - DNA, 542 bp, Triticum aestivum
  unsure (1)..(542): unsure at all n locations
  Clone ID: PAT_TA_99440
ttatacganncactatagggcgaantgggtaccgggccccccctcgagttttttttttttttttttttttttttttnttttttttttttttttttnctttttttttttttttttttttttttttttttggananacnatccncccanccattcccncgggnanacctggngcttaattaattnanattgcgcgcagctagcganaggacctcccncncgctcgatcanggnaaaaataaacacacaaagtangtgnagctacacgttnatccacgacgtanaagtacanatgcatatctcgtccgatggacggacggncggncggacggctaaananatttacctcccgggggcnaatttggnggcgaaggcccaggcgttntttttgaccgggtcggcaacnngggncaaanaggttctcaactggccccttcccggtnacnatngccngcacaaaaaacccgaaaatggaaaanatggggaggcggccgttcttgancnccttcaccttgaagctcgggggggcggtntcngggncctcg

SEQ ID NO: 99441 - DNA, 528 bp, Triticum aestivum
  unsure (1)..(528): unsure at all n locations
  Clone ID: PAT_TA_99441
cactatagggcgaattgggtaccgggccccccctcgagttttttttttttttttttaagtcaaataggtaatgccaatacaaccaaattcattacaatagatggatttcagtcctaacactggaatgtaaataagcataacagaagtgaatcatataacgtggtttatacaaagcacgatagtcttcctctgagtacaacttctaccacacatagcctagctagaacgaatcagcccatagcatttttcagactcatttcgtgtcctcggtttctcaatgctgctctaactgtagcatcttatctctgttttcaccgcgggtatcatgaatcattttgcttacatagcagcagggtcttccgacatggtctcatgtaacagccgtacggctgttttatctccaaaagatgatattgctgtatgcaaataaacagtcaagcacatcatgggaactgtcacattttgcttcgaaactcanccactggttggccaaaagtttgttagaaagaatatccaacatcatcangn

SEQ ID NO: 99442 - DNA, 515 bp, Triticum aestivum
  unsure (1)..(515): unsure at all n locations
  Clone ID: PAT_TA_99442
taccgggccccccctcgagttttttttttttttttttttagagcaacaataacaatactccaaacataccaagggacgtcacactggaaaaacaatgcaaccaacgggttctttccaatggcaaaattaacaatttttgaacttgcacgacatctaaacaagaactacatgatacataattttccatcatgcacctgctatcctgaacataaataaaataagagaagggcatcctgaacatctaaacaagaacttgcaaatttttccatcatgcacccagaggttctgccttctccccggccctgaaatgagagcaccatcagtttaattttaaacaaattgaaagttcaaacatgaggcatgtagattttcaaatgatgaaagtcacaaaagtgagctatttttgttttacntcaaataattnaacatgaaggnaaatacagattaaaaatttgtgacattctgaaagcaaaagtcagttcgacctttttaactactttttcgcaacaaagggg

SEQ ID NO: 99443 - DNA, 496 bp, Triticum aestivum
  unsure (1)..(496): unsure at all n locations
  Clone ID: PAT_TA_99443
gccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaaggggcgtcggcaagagcggcaagccaactgcactacaaggggaagctcgtttcaaccgcgttgattccccgaacttcaattttgccaangggggggcgaacttcaaccaaaggggcaancggcaancggggcggcgaattccaatcctaacggggganaaagtttcccccgacgangaaanntccgtcccaaaaaagcaacaacaaagccccggggattcttctccaatgggcaaacggcgggccccnaacaacaaacngggtccccaatttncttcattctngcaaccgttcccctng

SEQ ID NO: 99444 - DNA, 300 bp, Triticum aestivum
  unsure (1)..(300): unsure at all n locations
  Clone ID: PAT_TA_99444
gctagtcgagtttttttttttttttttttttttttttttttttttttttttttttttttttttttttttttanagtaaaactcaanaactgttcttggngaacnaanagcctggnccgtactttcttggggccncattcatacaatcaaacganaaacaagatgcacaacattcagagggtcttcagggananatttctggaaacncaggaaatgcnggctagttttattccgngaacaaatgttgngtgccccctganaaaaaaaccanagngttcctactaacttaaactaggngggg

SEQ ID NO: 99445 - DNA, 376 bp, Triticum aestivum
  unsure (1)..(376): unsure at all n locations
  Clone ID: PAT_TA_99445
gtttttttttttttttttttaaaacacaaccacaccaatttcacgattaccattacanagcaaataccacanttatcagaaagttttcgagacacttaacatctgatagttactgacaccaacattggagagtcgactgacaaccatacatagagcagagcaaaaatactgacgaccccaaagattttngcatactggtgccattaagcacttgacctccttcagcccaatgtgcaaaagtacaaggaaaagttgggtnaagcaagctccccctcccnttgttagtnacccgaaanaacnacgccggccatccaacaaggcaaggctncccgccnaacaaaangaactnggaaggggccctngaaccntggcaagg

SEQ ID NO: 99446 - DNA, 459 bp, Triticum aestivum
  unsure (1)..(459): unsure at all n locations
  Clone ID: PAT_TA_99446
cggcaatcagtgctagtaaagcagttagccgtacgacaagtacaaccagctccacaccaaaagtaaagaggagacgcacggcgggatcgagcaatgccgtcgtcgcaagccctagcgctcgtctcgctctcgctcgctctcctgctctgctgcacctcccccctcctcgcccatgcccagacaccggcgaccgacccggcggccgacgtctgcgccgccctggcgacggacgaagcctgccacaacgtccccaaggcgctgcgcctcaagctcatcgggcatcccgaacatcctcgtctccaacgtcatcgggggtctgcctgnngctcttcgccaagtnngtgccggggctccaacccgaacgcaacctcttctaagttgtcaagggcttcgcgtccggggtcatcctctccaaccggtnnattgaagttctcccggggatccttttaaaaacttcaa

SEQ ID NO: 99447 - DNA, 154 bp, Triticum aestivum
  unsure (1)..(154): unsure at all n locations
  Clone ID: PAT_TA_99447
ggttggcttcncctccccttccggttcgggttcgggttctggttcggttcgggtccgagagtagctagcctantctagggtttccgtananaggacgacgttcagnnacttaagatancaagngtttancagcngtaattctctngtntttact

SEQ ID NO: 99448 - DNA, 454 bp, Triticum aestivum
  unsure (1)..(454): unsure at all n locations
  Clone ID: PAT_TA_99448
gccgggggttcgcccaagacaagaacccaccagttccgacccttctccccctcctccctccctccctccctccctccctggcccatccaatccgggtcccgcccagatacgccgcgattccgagcgtctccgccgtggaatccgccggagaattccttcattgctcgccgcttcctcctcctcctcctcctgggttcttgcgcggtgggagtccggggagtgggaggagaacccgccgtgctccccgcgtttccggcccatgctcncagctcggcgggccgccggttcctgtctgccggngttcgggtggcaggaagaatctctgangccgaggttggnacaacaatggggggcaaaaggtngangtttaaanggtncaatcctgggcatttgcgccaanggggggatttccaagcnaagcccgaattgggtggggggntttccaatacnnagg

SEQ ID NO: 99449 - DNA, 454 bp, Triticum aestivum
  unsure (1)..(454): unsure at all n locations
  Clone ID: PAT_TA_99449
gctcgaattttttttttttttttttttttttttttttttttttttttcagaaccagcagcaaataccccctctactttcttcanacaaaggcgaatatgcagacgagtaccataggcaagtaagtaactgctggggcctagtgtagtgtcggatcaatcgtcgcggnaaagccgttccattcaatttcccctcaatcaggcatggtccgggtggtgatcgttaggttaggcgcggcgatgaggaggataggcgcgcggtcantccctcggctccccgtgctaaaacctgtacccgtgggtatgcaacaaaagtaacaatgggggaccccgccgggacnaatgactggtaaccccggtaaaagagnngggcgtactcccgggctcactgggagccccaaanggggccaaacgggnggcctgaacgggncaacgtcaangggttgccgttaccccc

SEQ ID NO: 99450 - DNA, 447 bp, Triticum aestivum
  unsure (1)..(447): unsure at all n locations
  Clone ID: PAT_TA_99450
gcacacagagacagtcatactactccatcaaataagatgatagcgttgggcgacatctacaaggtggtggaggcgatggcgccgctttacttcgcgctagggctcgggtacgggtccgttcgatggtggcggttcttcacggcggagcagtgcggcgccatcaacacgctggtggtctgcttctccatgcccttcttcaccttcgacttcgtggtccgcgccgacccctacgccatgaattaccgcgtcatcgccgccgacgccgtcgccaaacttctcgccgtgctcgccgcggccgtctgggcgcgctgcgccaaggccaaggccggcgcctactcgtggtcatcacggggttctccctgggcncgtacaacaacacnctcgtcgtcngggtgccgcttctgggacgccaatttcnggnaattggggggcanggactttattttt

SEQ ID NO: 99451 - DNA, 465 bp, Triticum aestivum
  unsure (1)..(465): unsure at all n locations
  Clone ID: PAT_TA_99451
gatcgctcgagccctccgccgccgccgcgccttcagctctctccttccttcaccgattcaagatgaagttcatcgctgcctatctgcttgcttacctctctggcaacgccagcccctctgcagaggacctgacatccattcttgagtcagttggttgtgaaatcgacaatgagaagatggaactcatgctgtcccaagtgaagggcaaggacatcactgagctcttggctgctggtagggagaagtttgctgcggtaccatctggtggtggtggtgtggctgtttcanccgctgctcctgctggctgggtgggtgctgctgccccctgcanctgaagtcaaagaaaagaaaganaaagtccntggagaaagaaaaaagttattattgacatggggcttcaagtctgtttcnnactaaattcgtgggggcatctttggtgtcctgcaagttatctaatcccttggg

SEQ ID NO: 99452 - DNA, 335 bp, Triticum aestivum
  unsure (1)..(335): unsure at all n locations
  Clone ID: PAT_TA_99452
ggtttttttttttttttttttttttttttttttcaaannaacncattgttccattgatttcacagatcanaagatacancgacagaanaagaacactctgcttcgagctgaagcacacccatacatccatcccanctacnccgacataactaancaatggtcaccnacnccttcttgggggacttggnggtcttcttgggcgacttgggctccttggggganttcncggcggncttcttgnggagcaancaccggnttgatgttggggatcacccccnccntgggcgagggtnaccccnggcnancaacgctgccgacctcctgtttcgttcctt

SEQ ID NO: 99453 - DNA, 454 bp, Triticum aestivum
  unsure (1)..(454): unsure at all n locations
  Clone ID: PAT_TA_99453
gggtgctggattttgacctgctaccgaaatcccgcaggctagctgcaaaccccccttcgccgccgccgccgccgccgatgagatccgccccgcccagatccaagcctttctagagccttacgccacctgcagcagcgtccatgggggactgcgccgtggagaacggccacgcccacccgaaggaagaggacgcgccggaagtgcccgtcgagcccgcggagggcgccgcggagccgcangtggtggctggcgggcaaaggaaacaaaagagggatacgcanggaagccgtccgttctcnccgnggtgcaangggncctccncggggcccaattgccccgccgggggccgcttccccgggctctgcaacgagcgacnatnattccggaggggntccnagctggcgcttnttgccgnccgccggcggccggccaatngttcgccgattggatatcn

SEQ ID NO: 99454 - DNA, 458 bp, Triticum aestivum
  unsure (1)..(458): unsure at all n locations
  Clone ID: PAT_TA_99454
ctgcacgccggccttcgaactttaacgtgcttcagttctcagtgatcaccatcagcctcgccgtatggatgccatgtcgtgcctggcgccgccaccatccacgtcgttcctctcggcctactacaccgacgccgccatcacgcaagcgctacacttctcctccatgtccatgcccgagcacgagtacgcttactcccccgcagtctcctccccgtcctccgcctcggcgccctactcctccgtccctgctcgcgggactttcccgggggtgggagctgggtttcgcgtccaacggtctcccccgccgaannagaaacggctcgcctggcgaanaccgttgctngttcgccgtttggaagncgggggccgnttcggggccccggtncnggggggggcgggggaaaacaanaaagggggggttccgggcnttggggccccaaaacgcnaacgggggcgca

SEQ ID NO: 99455 - DNA, 416 bp, Triticum aestivum
  unsure (1)..(416): unsure at all n locations
  Clone ID: PAT_TA_99455
gtttttttttttttttttttttttttaaagaccagnccaaattgaattaaatgaatcanaaatcatcaaacacattgtttgccagtaccaacaanacaatttancacctaggttccaaatgctcanttcanaatcacagtggacatcncccctgtaactaatanagcagattgcngctccnatgtncaanaccaattctgttcnacaaancggcgngtttcctttctttcttccagaaatncatannaacataagaacaggaagcaancaacaacctttttttctttgggggttcacgaggtttcagggaanantctcctgccaccaantcgtgttccggnatgngccnctcttcccancctcccaaactcaatggttcccggntttctctnagnccattggctggnannacctgg

SEQ ID NO: 99456 - DNA, 390 bp, Triticum aestivum
  unsure (1)..(390): unsure at all n locations
  Clone ID: PAT_TA_99456
gcccactccgagctcctcctactcgcaccagcatcatcatcatcatcagttggttagctgcgagctcctcaagatgcatgctaccagataggtggcagtacagggctggggagtgtgcgcgcgtgtgtgttggtttgtcgccatggttgcggagatgggagaagcagcaccggtagcaatggtggaggcagaggtggtgccaggggcagagggcagccatggcgaggcgctgatggtgctcgagactctggcgtcgtcttccctggcctgctccgtcccgcagttcccgaccaagtggaattccgtcaaggacaagctccggnagctctgctccggcctcagtttgctgcgcancaatggcggggacggcgangaggatnangaggaagg

SEQ ID NO: 99457 - DNA, 418 bp, Triticum aestivum
  unsure (1)..(418): unsure at all n locations
  Clone ID: PAT_TA_99457
gcttctttcttctgttaacaacaagaagatcagccagtgatcgcctcccaaaacaacacctcccaaccctcagaaaacaagtttttccaggccttctggtgtctattgacgttccttgagggagcagcctttcgctactgccgccacttcacatcttcccacccaaggcgaagatgtcggtggccgtgtgccgtggcccggccgtgccggcgttcgagacccccgcctggctgcgcccggctaagccgcacaagccggaggtggtggtggccgacgaccggcccgctcangtcgacatatggaatgccatccangccggcgtggacaacaaggtgggcgccgccaaaaaaccgtacgttaacccgcgcgtgcnaacgtcnattaaccaaaaaaanctcnaangtctgcaccganaacc

SEQ ID NO: 99458 - DNA, 419 bp, Triticum aestivum
  unsure (1)..(419): unsure at all n locations
  Clone ID: PAT_TA_99458
gctgtctcctacttccggcggccacctccgtcgttctccccctctccgccgccgccgcccggcctttaaacccccttggtcctccccccaccccccacaccggcggcgtgatctggtctgatctcctagattgatcgctcattcattctattcatgacgctctctggttccccgcactccccgccgccgtccaccagccgccccccgctcctctcctggcccagctagccagccggcgccagcgagcgagctctccgtccaccgtcaagctattagccaagctctctcgaggccggcaatggcggcgcccaggcccaagtccccgctcgacccctgcggccgccaccgcctgcagctcgccgtcaacacgctccaccgccagatnagcttcctcgagggggggccccggtacccaattn

SEQ ID NO: 99459 - DNA, 427 bp, Triticum aestivum
  unsure (1)..(427): unsure at all n locations
  Clone ID: PAT_TA_99459
nggtcncgtcccgtccccanccaacctcccatctccgtctcgcgtcgcggcggtagttccactccctcgccatgggcaagattaanatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcganaagccanttaacgtcttcggcgtcangaaccctgaaggaattccctngggtgaaggtngggccnattaacttgtgggagtncaaccggtgtccttaatgaaaaagnaaaaggcnccngccactttgaaggggngngg

SEQ ID NO: 99460 - DNA, 416 bp, Triticum aestivum
  unsure (1)..(416): unsure at all n locations
  Clone ID: PAT_TA_99460
gcaccgtcgccgcctcctcctcctccacttcgtcgtcgagtctccccaccaaaatcttttttacggtcctcgcctcccccggtctcttcctcgtcctcccgttgcttcaggatcctgtctaggaccgtgtgcaaaactatcaaatgtttgtanatgctttgaagaaaccaacagcaagtagcttgatcagaaaccgttcccacctcagaggacgtcaatgactggatggtttttgaagattcccagctggaagggctcgcctttcatacaaatgaatgcacggggcaaatgtcatgtctcttcattatgcttcattaagctgtgggtgcttgtgttacccaacctccggataacatgcagtggcagtattcaaaaataagttctcccaacaagggtcantggntcgggaatggngg

SEQ ID NO: 99461 - DNA, 304 bp, Triticum aestivum
  unsure (1)..(304): unsure at all n locations
  Clone ID: PAT_TA_99461
gcttctcccatttccgcaggggagaaggtaacanagacgcacacanntcctccccatttcgctagggttcctgcgatggcgancccacnatccccgagtcctcgcggggacaagctccttgactcanngccnctgctcggnggcggtgggnggcnccgtggcgcgctgcgccggccatcgctccgtgggacggcgcggttgctgcngnaagggcggtcggngggcgatgcggganccntcnctgcctcgtnacgggaagacnggcngncggagncagtttaataagngagngtcaangcccaac

SEQ ID NO: 99462 - DNA, 417 bp, Triticum aestivum
  Clone ID: PAT_TA_99462
gtttccagttccctgcccaaccctagagctccgaccagcaacatccttccgcgcctgcaatggcgtccagctccgtgctcaagatggccgccgctctcatgctggcacttttcgccgggcagctgctgatggctgcgcccacgacgggggcatactcggggccgccgatggacttggaacaatgtaatcgttctcctgcaggctacacatgtaagatcgtgtgcttcaaggccaaatttgcagtgtgcgtcgccaaacttctgagcttcgactgcaatgtgtacgcaatcaacacctgcaagttggtcatcactaagtgaggccgggcgaataggaacacgaggtgcgtggggtgcatgagcacgcatctcacctaagtgtcaactaattaagtattaataagccccgctgatatat

SEQ ID NO: 99463 - DNA, 428 bp, Triticum aestivum
  unsure (1)..(428): unsure at all n locations
  Clone ID: PAT_TA_99463
gcccaaaagcaagctagacccttgcaatggcggcgtccttcaccaccagctggcgttgcgcattcctcgcgctactggcccttttcgtctccggcgcctacgggcagctcancccgacgttctacgcgtcgacctgcccgaacctaacgaccaatcgtgcgcgacgccatggtcacggccttgaacccggcaatcggcggcgaacgcangatggggcgcttccctgctcaagctccacttccacgactgcttcgttgagggaatgcgaacgggattcggtcctcctgggacaacgtgcctgctaatgggaagcactccggctttctttggcgaaaaagaacgccttcgggaaacatcaactccgttccgcgggttcgaggtcatcgacacgatnaanggcgcaattggagcaagcctgccctggcgtn

SEQ ID NO: 99464 - DNA, 428 bp, Triticum aestivum
  unsure (1)..(428): unsure at all n locations
  Clone ID: PAT_TA_99464
gtcccatttcccacaggcacagtctagtcccctcccctccccgctcccccacccccttcttcctccgccggccggccactccaccgaatccaatccaggtaccgcctctccggcctcccgcttcgatttcgcgctccggcgacgcaatcgggcgagcagaatccgctcccaattttttcagctttttttaccccatcattccatcgctgattcgagcgccgagaaaggttcggggttgagcaaaaccctgcctgcttcgtgttctgtaatcacgctgatacccgaattctgtccctgaattgatccgctccatgaacatttgatgcaacagcgaagcgcgaatcctaacctaccaagccggtgttgaaaaacanttcggtcctgtncccttttggggaattgggaaattggcaaccggcagggganaa

SEQ ID NO: 99465 - DNA, 358 bp, Triticum aestivum
  unsure (1)..(358): unsure at all n locations
  Clone ID: PAT_TA_99465
gtttccattccctcctgctcccccacagctgctccatccgcccgctcccgccccctttccctttgactcccgccggccggaatcggcccaactccctccccgctttcttatcccccgccctccctctccccggacccctcaggccagcaagttcttgcgaggagcagccggtttcttggtcttggaaggaaggaattcggaggcggcgatggcgtcgatccggcggccgcactcnccggccagggcgcagcacctgctgcggnacaaccaacccttcgccaacgcctcgccggccctcctcgccggtgngccaaagcctcctcngggtnttttnggnggcgggggcnntcctcctcct

SEQ ID NO: 99466 - DNA, 305 bp, Triticum aestivum
  unsure (1)..(305): unsure at all n locations
  Clone ID: PAT_TA_99466
gcctcgtgccnaattcggcacgaggccgcnctgtatatanaaaccncaggcggtggcancgcctccacctccatctccacaacccacctcgatctccatttccatcccctcgatccccacccacgcacaagcacgccaaacgcccgatccgggccatggnagccagcngacttccnaatcangngtgaggccatccgccggcgccgggggcgttnacccgggcgcncngtccnccccccngcngggggcgantgggcggcgccgggcttcanncccnatgccccgcgccanagatntgncaataa

SEQ ID NO: 99467 - DNA, 263 bp, Triticum aestivum
  unsure (1)..(263): unsure at all n locations
  Clone ID: PAT_TA_99467
gctagncgagttttttttttttttttttttttttttttttttttttttttttttttttttttttttttttnananaaaaacncaanaacngttcttgggggaaccaacancctggncngtactttcttggggccncattcatacaatcaaacgacaaanaagatgcanaanattcanagggtcttcagggananntttctggaaacncaggaaatgcnggctatttttattcnngaaaaaatgttgagtgccncctgacanaa

SEQ ID NO: 99468 - DNA, 412 bp, Triticum aestivum
  unsure (1)..(412): unsure at all n locations
  Clone ID: PAT_TA_99468
gcgcccctttctctgctctgcgccgcaaagctggatggacggcgacgagcgacgccgcgtttcctaaccgcaccgacagcaacaggctcgacggcgacgggcgacgccacctttcctcaccacacggacgcgtctcccctggtttctcgccgaacgtgacgaccaaggagcagaggcctatcgtcgcaacaatagacaaagaaaaggggaaggcgaatgggaaggagaangagaaagaaaggaccttggaatccattatgaanagtaagttgccggtatcggggaactccgcctcaacgtccccctgaacccaacggcgctgccgtgggtgccgaatcccaatgcctccggctccgcaatcgactatgagagggaaggctacatcttcccaaggtatntgcgtgcaaaatat

SEQ ID NO: 99469 - DNA, 409 bp, Triticum aestivum
  unsure (1)..(409): unsure at all n locations
  Clone ID: PAT_TA_99469
gctcattcatcgcaagaattgcagctcccaancagcaccatcnccacgcttgatccgaccccgcgcagcaatgcgggacctgtcctgcttcngngacnggtctgtctcattccctgccgcgtcggcggnctctgtctccggncgnggntgcacgctcgaccgcncgctgcnngcggcgaccaccancgtgtanaacgcgtctctgtcctccgggaaggggatnctcatccgggtcacgtggagccggagcaacgtcngagccccggggctcancgtcnccttccaaaaanaaggtctcctctcnctgtcgtcgtccaagattgcaaccaacaacacgttgtgcggnaaaaaacccggaacaaggtccatcgtcaacgantccgggaacgggcgtncggggtcaattggn

SEQ ID NO: 99470 - DNA, 418 bp, Triticum aestivum
  unsure (1)..(418): unsure at all n locations
  Clone ID: PAT_TA_99470
gctcagctcaacccaaccgaagaagaagaagaagaagaagaagaagangaagaagaanaanaagaanaagaagatgatcgcgtcatgttgccaggaaggtttctcggtcagaanaaggcaaggtcaccgactggtgcgcccacaaccccaanaacaccaatgccggcggctaccacaagaccgtcaacaatggtggctccgcgcgtgccctcancaacgtcaccaagggtgactacacntgtggcctcaagatcgtnagcaagagtggtttcctccaccgcatcaagaacgtcagcaatggcagttccgaccacacactcaagaatatcaacaacgtcngctcaacccgctncctcaaganctttaacaacggctaatccacatgcgaanccttcaannaaacgttcatcaaccggtt

SEQ ID NO: 99471 - DNA, 440 bp, Triticum aestivum
  unsure (1)..(440): unsure at all n locations
  Clone ID: PAT_TA_99471
ggtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccaaaagatgaaatccgccatgctggtgatcttggaaatgtgacaactggagcggatggtgttgctaacatcaatnttactgactgccatatcccctttactggacaaaattaaattgttggccgttgcttttgtcctc

SEQ ID NO: 99472 - DNA, 449 bp, Triticum aestivum
  unsure (1)..(449): unsure at all n locations
  Clone ID: PAT_TA_99472
ggtgataaatataaaaatagtcttatctgtcttgtattaataggcttggttagcatcaggtacaaactgtactattaccaacatcatagattagtttgtctaacctgacaaacagaccattagtcgatcactatggtaatggagcaccattgtcacctggatgaggatgagccaaaccaatgactttgcatgcatcgatctaaggagtagtttgttcacttagttgaaccgtctttctggcatcatccatggcgctagtaggctaggtcggcagccgcatggccggtgtcgggcccacgaagacccgctgggatggtgggccgccctcgtcgttccgccaaggcctctgccctgccatccgcccgtggtcctcaagtggganggaanaacaagccaacaaccaacctccaactaatccccgaacccgaagctccaaccaattggcntgn

SEQ ID NO: 99473 - DNA, 317 bp, Triticum aestivum
  unsure (1)..(317): unsure at all n locations
  Clone ID: PAT_TA_99473
gctncctccctcccccactccgcccgcaaagctcccccgcctcctccttcaatgtgccgcccgtgcttcccctccgctccccgcgccgattcaaagcccagaccctcnccttnatccgcatctcnccatgtgcggcggngccatcctcgcgggcttcatcccgccgtnggcggncgccgcggcggccaanggggnggcagccaagaagcancagcagcaagcancancagcatcaacgcaacntnacggccgaactcnctnttgggcgggcctgcggaaaaaacccgggccaagangaggactttcgagggcgactt

SEQ ID NO: 99474 - DNA, 401 bp, Triticum aestivum
  unsure (1)..(401): unsure at all n locations
  Clone ID: PAT_TA_99474
gatgacacagaactaggcggagagcacaaaggccggccagcgccacctccacgcacgccgccgcagcggcgttcaccggcggcgagaggcgctcccgccgcgctcgtcctcgttcgaggatcctccagggagcagggtgcccgccgcgacgccgttgcaggcgccgttcgcgagtccaagggcgaacgggctccaagtcccaacgcgcgccgcgcggctgctcnaaggggttgcttnatgccgaaaagcnaaagggcataaaggcnggcgggccaagcgggaaatccggggaattgcaaaggcgccggatggccccaattgcctttnggggccccttgggcccttctgccccccngttgaatttcaaaccntttcgggaaaatttaacggtttggnaacaa

SEQ ID NO: 99475 - DNA, 442 bp, Triticum aestivum
  unsure (1)..(442): unsure at all n locations
  Clone ID: PAT_TA_99475
gttgcgatcttcttcttcttcttcttctgccttacatatcttcttcaaacaagctccacacaaacaccaatggctgccgcgcttaagacggcggccgttgccctctgcgtggtactggccctgtcgtccatggcgccgtcggccatgggacaggtagattgtaacgcgctctgcactgctgcgtgctcctgcaccggcacctgccggccctgcatcgagaatgcgtcatgcatcggcgtctgcaaccccacctccactttcttcccggtatgccaactctgcaaggacacgggcaagcagacgtgcgtaactgagtgcgtcaacgggctgcacggtcccaatgangcgccccccttgtngttttggcnggccggcccccctgggattaantttaaggggtcccccnaatgttttcgcncccngaaactgttttanaaaaana

SEQ ID NO: 99476 - DNA, 401 bp, Triticum aestivum
  unsure (1)..(401): unsure at all n locations
  Clone ID: PAT_TA_99476
gctaccacaacctcttgtanagagggcaagacatggagattgccatgggggctatcggccctctcctcccgaagctcgccgagctgctcgtcggcgagctcaccatggagaaacaagtgaggaaaggcatcgtgtctctcgtaacagagctgaaattgatgcatgttgtccttaccaaggtgtcaaaagtgcctgcggaccaacttgacgagggggtcaagatntgggcangaaatgtcaaggagttgtcctaccaaatggaggacatcgttgatnctttcaaggggcgtntggggaatgaangcgaattcancaaccccgaaggaaanngtcnaagaacatactccagnaggnncaaagattttcnagnattggaaaggtttccanccggatttctgaag

SEQ ID NO: 99477 - DNA, 444 bp, Triticum aestivum
  unsure (1)..(444): unsure at all n locations
  Clone ID: PAT_TA_99477
gaagcattctaccaccagaccgaccgcacagttgaagtgagatctgcgctaagggttcatcagcaaccatgaagagcaccaagctcgcggcgatcctgatcctccaggccgtcctggtcatggggatcctctcacacgtgaacgccgactatttccccaagtgctgcaacaactgcaggtccttctcgggggtcgacgtctgcgacgacgcccacccccagtgccccaagggctgctcggcctgccgcgtggtgacgccganccctcaaaagacgttccggtgcgcccacatnaaaaacaacgttcatngnaactggngggggncaatgnaaanaacaatnattcntttcaagggttcaaggtcaanccaaggtttgccnccctaaaatnaagctcaaaattgaaatgaagcnnttcatgggngnccnatgcctgtntngttgg

SEQ ID NO: 99478 - DNA, 457 bp, Triticum aestivum
  unsure (1)..(457): unsure at all n locations
  Clone ID: PAT_TA_99478
ggtccttcccccgtcgtcgcggctccagctagggtttctcgcccccgccctcccgcctcaccgccggccccgtccgccatgtcgaagcaaggagggaaggccaagccgctcaagcaggccaaggtcgccgagaaggactacgacgagaatgacctggcatacctccagaagaagaaagatgagcaaaaggccctgaaggagctgaagggcaangcaggccaaaagggtgcgctgggaggatncggtctcaaaaaaaagtgggaaaaaatgagtctgcccaaccatttgtaataaccaagaaaatgataatccatctatcntacctatctgtgttgcnccttaatccccggtgggtgttannaaaccaaccntcaattnttgnttgaagcaattttgcaatcntcccnantacnttcccttnaaaaaaaaaaaaaaaaaaaaaaaaaaactccnaagg

SEQ ID NO: 99479 - DNA, 339 bp, Triticum aestivum
  unsure (1)..(339): unsure at all n locations
  Clone ID: PAT_TA_99479
gcgagaaaggattcactcacgggagggagaggaggaaaaagagatntgggganagatcgatcgatgggggacgaccatggcgccaagctggtgaatancctgcggggcgcggccanaactacgtcggcgtggggttcttcctcggcttcttcctcgtcctcctcacctacttcaccntctccgacgcangttcgncatcgccgcgcncaacgctatncctgaggacctnggnggtttatccnaatccgacaccccgggccgtgngcanancaatacggtnncatcaancaacangcttcnccgtnaaatatggaangaancacctcctgncantagcat

SEQ ID NO: 99480 - DNA, 439 bp, Triticum aestivum
  unsure (1)..(439): unsure at all n locations
  Clone ID: PAT_TA_99480
gctatataggggagagagatgctctaatgctcctcggtttgactttgttcaatacaaattagctgccccgcttccttcttctcgttagttttcagatcgcctcagcggcacccaccagcagtagctagcgatgaagccctcctcgtggagcacggagagatgcgcccggacattctacgtcgcggtgctcctctccgtcgccctttgggccctcatattctactccaccagcttgcaatcccaatccggcgatgctctcaagcaagccgccggccttcctctcgccccgctctgcccgtccgggcccgtcgtgcgccggccggtacgtgtacatgtacgaacttgcccgccccggntcaacgccganctcgccccgcgnatggcgcaatgtcctcngggtcaaccgaaatttttcnaggaacgntggcaaacgaccggg

SEQ ID NO: 99481 - DNA, 358 bp, Triticum aestivum
  unsure (1)..(358): unsure at all n locations
  Clone ID: PAT_TA_99481
ggacgagttaggtaaccacttaactggcacaacacaaactccatgggtgtcttcgccgtgaccaaggtgtccgagggccccgtccggccatccgccgcgacgccgtcggagacgctgccactcgcgtgggttgaccggtatccgacgcaccgcggcctcgtcgagtccgtgcacgtgtaccgcgacgccgtgcccgagacggtggacgccggcgcggaagggaanaaaaggaagcccccggcggccgtctgcgcggcgccgctcgcnggacgccgcttggtgcaataattnacctttccgggggtccggatntttnggaaggngaagganaattccccccccccccccccgtntctgt

SEQ ID NO: 99482 - DNA, 466 bp, Triticum aestivum
  unsure (1)..(466): unsure at all n locations
  Clone ID: PAT_TA_99482
ggaagccttcccgatctgaactccggccaccacctgcagcgcgagggagctccggccgcctccctgcaccgtcatcctcgccatcgctgccccgctgcagacggcagcgtcatcccgttcccgccgggacgcagccggtgccctcctccgcttcgggggcccgggaacgtcgccggcctcccctccacgacggagagagactcgtcaggccgcggaaggctgaagggggcctcgcggtggagcgggagcggacgccggncgggccggctgctacggaacagcaactacaacaaccaagccaatacctactttgggaattcaagttgacaatggaaggccgaaaaacancgaaggtgggctgcttctggtcnaanaagattaacnggncttcaacgcccgncaatcttcnaagcctcccttcgcctaanccccnntcccccngaaagttcgangcccctnttcnatt

SEQ ID NO: 99483 - DNA, 440 bp, Triticum aestivum
  unsure (1)..(440): unsure at all n locations
  Clone ID: PAT_TA_99483
gcaagggagagaggtgacggcaacaacaatggcgggcgaactccttcttttcaatggttccaccctctctcacggtagtccctcgcaaactctatcgccagcggtggcagcggcgtcgaatggtgacaaccaggagtccaagatgaagcgggcggcggtggcagcgacggagaaccatcaccctcccagtgacgcgatcagcgccatggcaatttcctagccacccttgcacgaccatgaacccgagcggaagggccatctcaacttgccagctcgcctggccggcatccgtaggtgagaggtcatccaaatttggacgtcgtgcctcctccggtcctccctccatgccggttgttccttcctctgcaacaacaaacaaggacgtcaaaatggatttgattcaattgggtggggacgagaaancaaagaacaagataccc

SEQ ID NO: 99484 - DNA, 441 bp, Triticum aestivum
  unsure (1)..(441): unsure at all n locations
  Clone ID: PAT_TA_99484
gttctgtcccgcaaacccccgagagatcacaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccaaatcaaggacgaggagggcaaccccgcctttgccatcgtcaacaaggccactggcctcgccgtcaagcactcgctcgggcagtcccaaccggtgaaagctcgtgccaatcaacccggagtacctccaacnagtccgtnattgtggacggganancaacgaccttcggcaanggctttccgctgcaattcgcaatgg

SEQ ID NO: 99485 - DNA, 456 bp, Triticum aestivum
  unsure (1)..(456): unsure at all n locations
  Clone ID: PAT_TA_99485
gnntcntttttcagcaatgccgccgccgctggncaggtgcacagagctgcgggaccgcctctccgaccggttccggccgtggagccgctccgcgcagttctgggtccgcgccgtcgacatctacggcagctacaaggtgtgccagctgcgcacggggttcgtcaaggatgaggaggagcgggaggccatgtgggagcaacagcacnagatcggcgcccagaagatgtactcgctctgctccgagctcggcggcctcttcctcaaggctgctcaaattctgggcaaacccgatttggcgccgacgggctgggtgaanaagctttgttacaattgtgcgaaaagggtcccgtccacgccgatnnaaatttgtcaaagaattttttaaanaaaaaanttctgcaaaaacctttggatgaanaaaatttgaatttccttngaaanttgaaccctgntttg

SEQ ID NO: 99486 - DNA, 446 bp, Triticum aestivum
  unsure (1)..(446): unsure at all n locations
  Clone ID: PAT_TA_99486
gcacacacatcatctcctccacctctctcaaccaagccaaggccaagagctgagtgaagcacccgcggccatggagggcaaggaggaggacgtgcggctgggcgcgaaccgctactcggagcaccagcccatcggcacggcggcgcaaggcggcggcgcggacgagaaggactacaangaagcgcccccgggccccttcttcgaaggccggggagctcacctcctggtccttctaccggggccggcatcgccgagttccttggccacttctcttcctctanatctcggtgctcaacgttatgggcgttgtgggcaaacccgttcgggtccaaattgcgggaacggtcggcatcaaaggcatcncctgggagcttcggngggaatgatttttcgtggtcgtctaatggaaccgccgggaattttcccggggggcnaaattaanaccc

SEQ ID NO: 99487 - DNA, 459 bp, Triticum aestivum
  unsure (1)..(459): unsure at all n locations
  Clone ID: PAT_TA_99487
gaaagaaaaacacacacacagtagagagcttcagcttcccctgagagcgagagatggcggcgaagggcgacgggccggcgatcggcatcgacctcggcacgacctactcgtgcgtcggngtgtggcagcacgaccgggtcgagatcatcgccaatgaccagggcaaccgcaccacgccgtcgtacgtcgccttcaccgactcggagcgcctcatcggtgacccgccaaagaaaccaaggtggggatggaaccccatcaaacaacggtctttcgaatgccaaagcgtctcaattgggccgttagattcaaccggattcctaactggtcccaagaagtngatatttaagcttgtgggcccttcaaaaggtngtttgctgggaccttggtgancaaagcccaatgatnnaacgtccanttacaaaggggggggggggaaancaattttncanacttaaggag

SEQ ID NO: 99488 - DNA, 493 bp, Triticum aestivum
  unsure (1)..(493): unsure at all n locations
  Clone ID: PAT_TA_99488
ggccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcgggcggtggagaacttccgcgcgctctgcatcgggganaatggcgtcggcaagancggnaagccgctgcactacaagggnancnccttccancgcgtgatncccgacttnaatgtgccaaggnggggacttcaccaagggnaacgggaacggaggngagtccatctacggcganaaattccccgacganaaattcgtccacaaagcacaacaaacccgggattctctccatnggcaacgccngggccaacaacaaagggtccaatttctcatctgcaccgttccctggaaattggttccacgggaaacaacntggtncttcggggn

SEQ ID NO: 99489 - DNA, 432 bp, Triticum aestivum
  unsure (1)..(432): unsure at all n locations
  Clone ID: PAT_TA_99489
gaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggaagttgttgcaacaactgatgttgttgaggctttgcactggtggtgaatgttgcggttatggttggtggattccccaaggaaagaaggaatnggaaagggaaggattgttatgaacgaaaaaatgtttcaatctaacaaaagctcaaagcaatcctgcctccttgaaacctcaatgca

SEQ ID NO: 99490 - DNA, 470 bp, Triticum aestivum
  unsure (1)..(470): unsure at all n locations
  Clone ID: PAT_TA_99490
ngntnaancactctccctatccccgtgtccaagaanctaccccccggntccaatggcggcgaaggaaccgatgcgcgtgctcgtcaccggcgccgcaggacaaatcggatatgctcttgttcccatgattgccaggggagttatgcttggtgcagaccaagcctgttattctgcatatgctggatattgaatttgctgctgaagctcttaaaggcgtcaagatggagttgatcgatgccgcatttccaacttctcaagggaagttgttgcaaacaaactgatgtttgtccgagggcctgcaactgggtggttnaatnttgccnggntaatggggntnggtgggaattcccccaannaaaagggaagggantgggnaaagggganangnatttttntnncccaaaaaaattgtttcnattcctaacaaaaactncaaagcattctggctccttggaggctnnaagcaannc

SEQ ID NO: 99491 - DNA, 502 bp, Triticum aestivum
  unsure (1)..(502): unsure at all n locations
  Clone ID: PAT_TA_99491
gggagtagcaggcaaaggcctacaggaaggaggcgtagaaacctctcctctttcaaggtctcgggtctccggccgttcgcgccgtcgccatgggcaacgcctccaagctgctgtccttcctcttgctaacttcttcccggcttcgttttcgggccttcggccgccgctttcgggctaatcttcncttcgcgcaacgcgggatcccgccgccaacaactgntctcctccccctctcccctccgcacgctctccaactcgggcgccgccgccgccgcctcaaccctcccctaaaagctccaactccgcctcggtaaacccaacgctccaagcccctttcccggaatggtcccgcctggtcgaccgcctcncgggcgccggnttngccgccggggcccccttccccgncngatgaanctcnccgtcncctccgggaaannggcttttcggccaaggggggnttccnctnttttcctcctggctggggctttngggggngnaaagg

SEQ ID NO: 99492 - DNA, 444 bp, Triticum aestivum
  unsure (1)..(444): unsure at all n locations
  Clone ID: PAT_TA_99492
aggcagtcatcanactgctcgagnaanccggtagcactaacttnaactaaccaacctcttnctctccggggancctcntnaatcaattnanggaatnggcantccngacgtccanaatccatcggccgcnctgacggatgaggcgcccgcggcggagacgccattggccgcntcaggaggnatgcgaagacggaggaggtccccgccccncganganggacgttntcgatgnagcgtngcnccttcgaggttgaggagaccaaggaggaggcaccgggaaggcgctnntnactgggnaanancaaggacccccgagncagcatgtncacgtcnaaccngaaggcgnaatcncccaaatgttnaagaagggtcaaaccgtcagccgatttnaaaatnagttgttttcccaangcaaaanaccttttttgttgggncaaaggaant

SEQ ID NO: 99493 - DNA, 185 bp, Triticum aestivum
  unsure (1)..(185): unsure at all n locations
  Clone ID: PAT_TA_99493
gctcgatcgaaaaatttttcgtctccctctcgcggaatcagcaagcgcaccggtcgattcccaagcgggagcaagcaagcaagagatggcgcaagtccggcaacaaacgaacgcccgcccccgatnaagcaacccaanccccgcnggcgggagggaggtgacgggtgggaaaagggacccccagt

SEQ ID NO: 99494 - DNA, 404 bp, Triticum aestivum
  unsure (1)..(404): unsure at all n locations
  Clone ID: PAT_TA_99494
gcccgccattccagccggngctccatcnaatctacccacctttgcngcccgggtgatcccgttccatcccgttcttctcctggagcatcttcttcacagctctgctgcgcgggaagctgtactgaatcgccgcggnattttactgaattgctagcatcacaccggagatcttccgccatgagcgccgccaggtcgtccttcttcgcctccagcancgccaanaagaagcccgccgntgcccggaaccccttcgaactccgactccgacgacnnacngcggcatggtgcggcgggcggggggttcccnccncnctcccagcaaaatccccccctgnncgtttttgnaatttntttttttttccgncnttcccctnaaggttgntttgaaccccnaaagggaaaaa

SEQ ID NO: 99495 - DNA, 233 bp, Triticum aestivum
  unsure (1)..(233): unsure at all n locations
  Clone ID: PAT_TA_99495
gtcaagcttgaagacttcacttanccaaagccacctgcatcgatntnatnaccggccggnggctcgcctcgatncaatggagcttcctcaantggggtccttcctcggtgtggtgctcgccacggtgctcttcttcaaggntgtcctgcgccgccgccgccaagtacaanctcccgccgggncccaaaccttgggcgatnatcgggaanctcaatntcaanggnaagcccccg

SEQ ID NO: 99496 - DNA, 453 bp, Triticum aestivum
  unsure (1)..(453): unsure at all n locations
  Clone ID: PAT_TA_99496
aggccaccattcattcctcccccttccttcctgggatcgatcgattcattgcccgctgctcctttgactgcctcgctcgctccccgggttgacacggagtggaatgatcggccagtgatccgtccatccatccatccgcacagctcaagaaaaggcatccggacggacggacgccatggataacatcggnggcggcggcgtgctgcgggaaaagcaaacaagcaagcgccctctccgcgcatgtcctttctccgggcgaaggacgggccgggggcgcgcaangnccgggcccccccccgggcgcccgggnggcgcggaccgggccgatggtgaactttcgcgcgggggcangcaactcggggccgctangtcagctactccccgcgaacgaaccttttaacancnagcttgggcaaaaannnaaactcctccgggggggnngggttttncncc

SEQ ID NO: 99497 - DNA, 451 bp, Triticum aestivum
  unsure (1)..(451): unsure at all n locations
  Clone ID: PAT_TA_99497
gctccgatccgatggcccgcaccaagcagactgcgcgcanntccaccggcgggaacgtncnccngaagcatctnnttacaacagcnacgggcaagtcggcgccggccaccgncggcgtaaagaagccgcacaggttccgccccggaaccgtcgccctgcgcgagatccgcaagtaccaagaaagagcacggggctgctgatccgaaagctgccgttccaaaggctggtgcgggagatcgcncaagacttcaanaacggacctccggttccaatcgtcccgccgtgttccgggcttgcaagaaagccccnggagggcattaactncttcccgggctgttccgaagggacaanaaacttctngggncaatncaaggcccaaaaagggttctccaataatcccgaaagggttntccaaattngccccgcccntttttntggncccaaaaaaggg

SEQ ID NO: 99498 - DNA, 446 bp, Triticum aestivum
  unsure (1)..(446): unsure at all n locations
  Clone ID: PAT_TA_99498
gaagcaccagtntcttggtctgcatagaagtttccacggctagcaagttgggcagcagctcgggcagcaatgcttgccatctctgcagaatctgctgctgcctgggctgcagatgctgcatccttgaattccacattccaattggaaccactaactgaagacttcctttccctaggccggttgatctcttcagtcctggatactgagtctggaactgttgagccaaattgggagtgangtctaaaaacactttnactcccaagtattaaaagtaattgttaagattcaagaataattttgctgagggaataaatantttgcaacaatgttgggaagcctanggagggaactggaagcatcccgaaaccccntcctaantttcccngtggnggnaacaattaaaantttggnaantggcaatgttgggntttctaattnanctgggg

SEQ ID NO: 99499 - DNA, 487 bp, Triticum aestivum
  unsure (1)..(487): unsure at all n locations
  Clone ID: PAT_TA_99499
gccccactctctcgctcctgccgccatgggacgggatgacgagcttgcttctctcagagaaaacccaaatcccctcctcgcccttatcacaccgtcggattccccactccacgaagcttcccgtcgaccccaatctcgtccanacgcattgatntgctctgctctgctctccgctccaagggcattgctaccacacnaaangctagggggaaaaaaaatcatccgtcgtctccatgaaccaaggnngttcgggtggggcgcngctggnnttcccctctncnggantgggggngcgtctaacaacggggtcangggggtnctgccgcaagtccaaggngctccgccgcgaacgggcgcgcctggaggaaatcaaaaaggtctccggaaacccgcgaagaanancctccgtngccccctcctccaaaacggngggnaacaaagganaaggnggaanaaagggtnaacaaaaaattnctccaaggngtaa

SEQ ID NO: 99500 - DNA, 262 bp, Triticum aestivum
  unsure (1)..(262): unsure at all n locations
  Clone ID: PAT_TA_99500
ggcaacgaagggcttngcctcctccgtttttttccttaaacttttttgggggggaaaaagttggttttggtgtncaacgggcaagaacaagtaataagtaagggctttggtggtggaagttggatttaaaaaaagcttcaaatcaattccgattcaatccttaagctaagccaaagtaagcaaaaagattcttccgtttcttttcttctggttttcctttgcttgccaatccatccattcaataaaataggggaaggggggt

SEQ ID NO: 99501 - DNA, 372 bp, Triticum aestivum
  unsure (1)..(372): unsure at all n locations
  Clone ID: PAT_TA_99501
gccccttcctcatcctcctctctcagtccgaagccgattacttagcagcttgccttcgtcttcctctcctgcggttcctgnagctacgtcttctcggcccctgccctttggttcgccgctccgctctcccccttctgccgcaaagggggacactcatggcgagtctagtagttctggcatcgctgcttaccgtaattgggctcgcgcagggggaggcgcaatgtgcgcggtacaagcgggcggccgcggccacatagcgtgaccatcactgagtttggggccgtcggcgacggnctgnccgttaatacggtgcccttccanaaaggcatcttctacctggcggtccttttgccgaacaaggggcggcgcaca

SEQ ID NO: 99502 - DNA, 439 bp, Triticum aestivum
  unsure (1)..(439): unsure at all n locations
  Clone ID: PAT_TA_99502
gggaaaacaaatctgtttcaactgtcttaatcaagaacggtactgttgtcactgccactgacaaatatgacgctgatgtctacattgttggtgaaactgttcacaccatcggccgcaatcttgacgtcaaagctgacaaggttatcgatgccaagggcaaatatcttttccctggtggtattgattgccacacccatatggaacttcctttcatgggtacttacaagtagcgacaactttgaaacaggtactctcggtggtctttacggaggaaccacctctattgtcgactttgctatccaaactcaagggaaagtaccttaaatgctgccttgggatgactgggcaataagaaaaagctgatgggtnaaagctgtccggagaattaatgcctttccaatgtccgggtggttacccgattttngaatcccaaaaacta

SEQ ID NO: 99503 - DNA, 436 bp, Triticum aestivum
  unsure (1)..(436): unsure at all n locations
  Clone ID: PAT_TA_99503
gctccgctcccctcctcctccttgacccgccgccacctctcctcaccgggaagaaaaccctagctagagagcttcaaagtttcccgcagcacganagatggcggcgaaaggcgatgggccggccatcggcatcgacctcggcacgacctactcgtgcgtcggcgtgtggcatcangacagggtcgaagatcatcgccaatgatcaaggcaancgcaccacacccgtcgtacgtgggcttcancgactccgagcgcctcatcggngaacgccgccaanaaacaagtngccaatgaaacccatcaanancgtcttntatgnnaaagngtctcaatnggcgttaattnaatgagtctanaggccaaagtggatattaaaggatnnttgncccctccaaggttttggcttgttccctgggnggaaaaacccanttatttg

SEQ ID NO: 99504 - DNA, 466 bp, Triticum aestivum
  unsure (1)..(466): unsure at all n locations
  Clone ID: PAT_TA_99504
gccgccgccagcagctgcgcaaaggctccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactcggaggcgcctcatcggggaatgccgccaaagaaacaaggtcgccatggaaccccatcaaacaaccgttcttccgaattgcgaaaccntctttatccgggcaagaangggttttgctggattgctccctggtnccaagaggtgggtattnaagaattgtgnngccggttacaaagggntaattncctgggnnccaagcaagaccaaagcctaatggaattggttgtggn

SEQ ID NO: 99505 - DNA, 460 bp, Triticum aestivum
  unsure (1)..(460): unsure at all n locations
  Clone ID: PAT_TA_99505
gcgcacccacacatacttgctctcccttcgcgtccaagcctccctcccatccccgctgcaccgcaagtcaaccgcctttccanctcccccgccccctcgccgtcgtctccctcctgccggaacgccagtatatagagccgcacaagcatttctttgctgccacgaacaaggaggagacggaggctcgcaaaggggtgaaactggaagtctcggnaaanggccgcctcctcctttagctagcggtagcanaattctgtttaaaactggttctttgcgtggaaatgcaattntttgggtnanctaacttactccgggcaatngggggggttaacaaaaggggnagaagggttcaaccccgggggacctttggangggnggggcaaaacccaagggccgttttgggggccctttgggggccccnggggaaaatncctttccggntccggaaaaaagggggaan

SEQ ID NO: 99506 - DNA, 417 bp, Triticum aestivum
  unsure (1)..(417): unsure at all n locations
  Clone ID: PAT_TA_99506
ggtccctggctcgagttcccacgacacccacgccgaccttgactcccattcctggaccaggaggacggctgctgctgctcggcgcccacgccgaccttgacgcccagaagctgctcggcgacctcggctgtgaactgaaccacgccgacgcccctgcctgctactgctggacctcgaccgcgtcgctacgcctgccccgactcgccgccgcgacctccgacggncaattgatcgatggatnccaacgccgacgtgctacgtggtcttcgcatcacctcccttgacgacgaagacgatgatgaaacagaactgcccaaccaaactctgcccantaacaccgcgaaccctggctgcgggcgcctcgggctaatgaagacgangacgaggacgaagatgaaaaancgggaatcatgcntn

SEQ ID NO: 99507 - DNA, 424 bp, Triticum aestivum
  unsure (1)..(424): unsure at all n locations
  Clone ID: PAT_TA_99507
gttcgtgccctcaaggctttcgacaacaccaaggccggcgtcaagggcctcgttgacacgggcatcaccaccatcccctccatcttccaccaccccctccccctccaccgtttgcatgcagatcaagagcaccacttcaccatcccggtcatcgacctcgcggctgccatgggtgctactactactactactgcaccatccgagcgaagctgagctggtcgccgcggtgaaggcggccgtggagacggtgggcttcttccaaggtggtgaaccatggtggtgcccaaagggggtcatgtcagaaatgcttgcggggttgcaaggctttcaagaagaagaccgtggagggcaanggcccctactaaanccgggactctcnccggggcgtgaggtnacaaaagnaactttaacctgttccggtcan

SEQ ID NO: 99508 - DNA, 425 bp, Triticum aestivum
  unsure (1)..(425): unsure at all n locations
  Clone ID: PAT_TA_99508
ggtcttcgtactcgcctctctctcgcgcttccgagctttggcctccctcccctcctccccgcaatctccccaccagcgtagcgcagcgcgcgcctccgccgctccgacccgcagccatgagggagtgcatctcgatccacatcggccaggccggcatccaggtcgggaacgcgtgctgggagctctactgcctcgagcatggcattcagcctgatggacagatgcctgggtgacaagaccgttgggggaggtgatgatgctttcaacaccttcttcagtgagactggtgctgggaaacatgttccccgtgctgtccttgttgatnttgagcccactgtgatttgaanaangtgaggactgggcaactaatgccagntcttccaacctgagcaagnttnttaagtggaaaaaggangatggagccn

SEQ ID NO: 99509 - DNA, 349 bp, Triticum aestivum
  unsure (1)..(349): unsure at all n locations
  Clone ID: PAT_TA_99509
gcacggtagcactagcttcagctagccagcctctgccactccgggcattttcttgcatccacgacggcaatggccaccgctgatgtcaaaaacccgacggccgcgctgacngaggaggcgccaacggtggagaccccgttcgccgccgngganggncgcaaaaacggaggaggcccccgccccggcccgaggccaaggtnaaggggcttgtngcccccntcaaggtcaaggaaacaaagggggnggaactngccncccctaaaacggaggaggcnaaggagncngaacaaaaanttgcggccaanccggagggcggaggncccaaaaaaanaaanggggcaaaccctgg

SEQ ID NO: 99510 - DNA, 193 bp, Triticum aestivum
  unsure (1)..(193): unsure at all n locations
  Clone ID: PAT_TA_99510
aagactgaanggctcantnttcttccacctccacctccagctccagctcaggtaaatacgtacgtggggaagggaggnatntctgcaanggctcccaagttcttggtgtagcttttgccactctcaccaaagagatttcangtctgatcntgaanttcaaatcccaactgcncgttttcnccctttggccttc

SEQ ID NO: 99511 - DNA, 424 bp, Triticum aestivum
  unsure (1)..(424): unsure at all n locations
  Clone ID: PAT_TA_99511
gcacccaatctcgtctccgattgactccacgctcgtcgaatactcctcccccaacgcctcaaagatgcagatctttgtgaagacactgacgggcaaagaacatcaaccctttgaggtgggaagtccgtctggacaacaatcgaacaatgtcaaagggccaaagattcaaaggacaagggaggggcattcccccctggaccaagcaagcggtctcatcttttgctgggaaagcaagcttggagggatgggccgaaaccctccgcttgactaacaaacaatccaaaaaagggagtccaaccctccaacctttgtcctggcgtcctggcgttggtgggcaatgcaaaattttccgtggaagaaccctcanccggggaaagaacaatcaactcnttgagggtggggggagnttccgaaaaacaatccg

SEQ ID NO: 99512 - DNA, 259 bp, Triticum aestivum
  unsure (1)..(259): unsure at all n locations
  Clone ID: PAT_TA_99512
gcttttctgatgtgctcccgaccccagctcccgtgcggccgcgccgggccgcaccggggctcttcagtcttcactgccggccgctaaccgccccgcgtcgcctctcctcccaacgccgctgtggcggcggcggatctcctcggttggcgatctggatcncgggggnggcgcccgtttccggcctaatcgggaaataatgcttgcaaagggtggggccggncaattgcggctccgccgttgccttngcnggcgttaaaat

SEQ ID NO: 99513 - DNA, 303 bp, Triticum aestivum
  unsure (1)..(303): unsure at all n locations
  Clone ID: PAT_TA_99513
gttctcctccccttcnggttcnggttctggttcggttcgggttcggttcgagagagaggccgagtagctagcctagtctagggtttcggtagagaggagtcgccattcattcccctgantctcctcatccaaatcgaagccgccgccgccggttcgccctctcctgcgccanctcgccgtaancaccgccgccgccgggntcgccctctcctgcgcnaactcgcctgggncacccgacgacaacaancctccagcaggcccttcaagncnagtangggtgaatattcctcctacgccaaagat

SEQ ID NO: 99514 - DNA, 448 bp, Triticum aestivum
  unsure (1)..(448): unsure at all n locations
  Clone ID: PAT_TA_99514
ggatccatctccacccaatccaaccaccgcctccatttccgtgcccgaccacctcctctggccgcagcctcacgtctccacgctcgtgcccgagcaggagctcctcgagatggagctcatccacagcaggccccttgcctccctcgatccacatcgtccccgtgctaatctgccaaggaaccgaacaagcagccgccaacccctctcttccgagggccggagcaagggagcgctcgggcctcgtctttctccgcgcggggcaaaccggcctccgaacgggagaacctccaaggattaaccaaccaacgccctggcttccttncttnctaactccgangggagaangcccctcctcctccgaagcaaaaatngttnaagggcgtnttntgnaatttcctnnccaaagntccccaacancaanaattngaaggnaaaggtaaggcaanan

SEQ ID NO: 99515 - DNA, 445 bp, Triticum aestivum
  unsure (1)..(445): unsure at all n locations
  Clone ID: PAT_TA_99515
gccaccgccgaatgccgatacagcaactcgcccccaaatcccccggccgaaaccccatttccagcgacgccggcccaatccccctcgccatgagcctgccgcagcgcggctggtactcgccgccggcgctggtcgacgacgcgatgcgcgagatcttcaagcgcgtccctccggacgaccccaggagcctcgtccgcgccgccgccgtctgcacgagctggcacggcatcctctccgacgccgacttcgcccgcgagtaccgcgccttccacggagcgcccgcccgttgctgggcttcctccacaacacgccgccaaaaagaagtccgtggggaaaagggggaaaatcaagacaactacaaggaaagggagttacngtgggtctccaaacttccgtctccaattcgcggtcctttccggcaacgcccgggcgttgnccgcgaang

SEQ ID NO: 99516 - DNA, 476 bp, Triticum aestivum
  unsure (1)..(476): unsure at all n locations
  Clone ID: PAT_TA_99516
cgcagcaaagcaagcccacgccgttcccaacccagaccacgccctccccaacaccatccatgccgttccacacattagctgctgtacctgtagtactattatggctcggcgcagtgcttgccgcaaggttcccactgtttggagcaacatcgccacaacctagcagccagtgccaaagaaaatgcggnaacgtagacatcccttacccgttcggcatcgtcaattctccccgacgaagaacacggncactgcgccatgaacggcttcaacctgacctgcaacgaaaagcgggaattgatgatgggtgggtccgccacaaggccaatttttatgaacgaacgttgggagggtcgtccggcgtctcgcctgcaacaaaggtcaaaggccccgggattgcctgaaattgatatctcataattaattgctacaacaacaancaactccnggaagatgggaccccttcaaggttcatccct

SEQ ID NO: 99517 - DNA, 458 bp, Triticum aestivum
  unsure (1)..(458): unsure at all n locations
  Clone ID: PAT_TA_99517
gccagtcctccccctcccggcgcgcgtgacaggcgaggcagacaggaagatggcaacggcagcctccgcctccgcctcccccgccgctctccgcgccaaaaccccagccccgggcgcgcaccccaagcccgaaatccaagcctcgcattcccgtggccttcccccggcgcctccgcgtccgcctccgccgctgcctccggcaggctccacgccaagctccacctcggnggggtccgcggngtcggnaacgccaaagggnaccggnctccaagtgcttgcccccgaagtcaaagccgctgggcgtggccaaaatgggccnggcgggcgccgggggccaaaaaagagcaatcctggcttctaacaactgncaaggaagattaggggattttcgcccaagcaaggtgggccgcgcgggaattgaanaanatcnaagcttcctgcaacaatctcctgggagg

SEQ ID NO: 99518 - DNA, 449 bp, Triticum aestivum
  unsure (1)..(449): unsure at all n locations
  Clone ID: PAT_TA_99518
ggtgacgcccacacaccacacacagaaggacctccaccactttgataaangaanatggccggggcctcccctatcctcctgntctccttcctccttgtttcgatggtggtggcggaccagtgccacgacgatgaccatgccgccttggttgccatcgacattgccatgggcaacccctaacatttcncgtcttggacgcccgactccgcctggggggaanggtaagaactncaatgtngatgccgaaaangggcgcctcctcnggcttcgtgtctaacaagactccaaaatgtccggngccaatnccgggacgncaatccgggaaactcaacctttctttgagaaccctcaaccctccaacaacctcccgggcaaatctccgggtgtcaatcccgggaatcccctcgccaacgctggtcnaaacctccccggggggttcanaaatnctc

SEQ ID NO: 99519 - DNA, 264 bp, Triticum aestivum
  unsure (1)..(264): unsure at all n locations
  Clone ID: PAT_TA_99519
ggtctccgccccctcccccctcccctcacccccagatngcaacaaccgnccgccgatgggcgccgccgccccgccgctcgccgcggggctcctggccgtcctgctggngctcgcgggcccggnggggggcganatctgctccaaggggattcgggncgaacccggcaacantaanccgctncaaaaattnngnttttccaaacaaggggtngtggggcttaaaatnaacggggatcgccttcgaaaccgncngggcttccccgg

SEQ ID NO: 99520 - DNA, 429 bp, Triticum aestivum
  unsure (1)..(429): unsure at all n locations
  Clone ID: PAT_TA_99520
gatccagtcaccataaccatgatagtttccttgaagaccgctcgtttgtaaagcatggaagccgaatcctgatcacaacgcgagaccagagtgttgcagcaggaatgaatcgtagctacattcataatatgcaggaatggccattccaagacttctggactctgctctgtgctagtgctggcctggacaaggaacatgatcaggagaacttgagggaaattgtgataacaattatccagaggtgtaacaaggtcccactggctatcaagattatcggcggtgtcctagcaaccaaggacccaacacangcgggagtggcaacaagttaatgaaaagtgaactgtgggccctggatntggagggacaatcctggtgggaagaaaaaactgagtgggggccgtctacaatggataaattaattttccacaa

SEQ ID NO: 99521 - DNA, 408 bp, Triticum aestivum
  unsure (1)..(408): unsure at all n locations
  Clone ID: PAT_TA_99521
gccacctctcaaccaagccaaggtcaagagctcagtgaagcaacggccatggagggcaaggaggaggacgtgcgcctgggcgcgaaccgctactcggagcaccagcccatcggcacggnggcgcagggcggcggcgcagacgagaaggactacaaggagccgcccccggcccccttcttccgaggncggggagctcanctcctggtccttctaccgggcggggatncccgagttcctggccaacttcctcttcctctaaatctcggngctcaacgtgatnggcgtgggtgggcaaaccgtccgggtccaaagtgcggnacggtcggcatccaaggcatcncctgggagctttcggcgggaatatttttcnggctcntctaaatgcaaccgccgggatttcccgggggg

SEQ ID NO: 99522 - DNA, 169 bp, Triticum aestivum
  unsure (1)..(169): unsure at all n locations
  Clone ID: PAT_TA_99522
gctcaagtcaagtggctctcgatcccaccaccaacatcttctgtccgtagaccgtagcttcctggtgcctgcaggtggtagctatcttccgtgttcacatctccatcgatgaagacgaagcaggcttccaaggccaaggcggcgccgttcgcggggaaangatgaagta

SEQ ID NO: 99523 - DNA, 505 bp, Triticum aestivum
  unsure (1)..(505): unsure at all n locations
  Clone ID: PAT_TA_99523
ggtaaaaatggtgaagggggacttacagttacggtattcacaaaagctatccatcgctctactctacaagttatctgcagcagggtggtgagcctgggttttctgtatctccgcagcagcagcgaggagcacaccacgctgacggacgagaaggccatgcaggcgcccgccaaccacggcggcatctggagccccgtcagcgggaacaagcgcgccggncgccaacggtatggccaccacgttgtacgccatggcgaaagaantaattccaagcggattcggttgaaggtcttcctcnagaggtcnatgggcgtgatcacgtcctccaagttgttcctcancaancacgtaatnccgcgggctcnatggggatgtccgtgccaanccccgatgggcaaccccgacgtccgcccgccgccaangggcgggcggantcntttnatgccgtccccnaccnaagggcancaatggtncccaccccttttggggggggacgggggcnaaa

SEQ ID NO: 99524 - DNA, 294 bp, Triticum aestivum
  unsure (1)..(294): unsure at all n locations
  Clone ID: PAT_TA_99524
gaccccgccgccacctcccgatccaatcactgcccaatcnaaccagaaccnatccccacgcgcattccctccgctccccgccccggatccgaccgaccgaccgaccgcgccgcgcgaccgccgggagagcatggggagcgggggcangacggatntggacggcggngccgtggngccgctgaccatctgcgtgatnggnancggggggttnatcggntcgcacctctgcnanaagctcaaggncgagacccaacananggtcctccccgtnnacntctaatgnnacaagattcg

SEQ ID NO: 99525 - DNA, 451 bp, Triticum aestivum
  unsure (1)..(451): unsure at all n locations
  Clone ID: PAT_TA_99525
cgggcgaccggggcgcggcctccctcgtctgccgctcctggcaccgcgccgagtccgccacccgcgcctccgtcgccgtccgcaacatcctcgccgcctccccggcgcgcgccgcgcggcgcttccccaacgcgcaccacatcctcctcaagggccgcccccgcttcgccgacttcaacctgctgccccccggctgggccgcctccgccttccgcccctgggccgccgccctcgccgccgccgccttccccgcgctccgctccctctcgctcaagcgcattaaccgttaacgacgaagaactcgaactcctcggccgcttcctnccggcctcctttcgggaagctctccctcctcctctgcgaacgggtttctcctccgggggctngccttcctcggctcccaattgcanaagggctgcgtttgctcnaangttggnggacntgcnaagnt

SEQ ID NO: 99526 - DNA, 427 bp, Triticum aestivum
  unsure (1)..(427): unsure at all n locations
  Clone ID: PAT_TA_99526
gctacgcccgaacccgccgccgccgcgccgcccgatnccgccaccttcccacgccatagcgcancggccctaacccccctcgctctcttctctgtattccccgccgcccccttgcattctcctcccctcacacgcctccgcggctaancctagccgccccgggananacaaanagcgtannaatcggcggcggcggcggngacgatgaggatcgaggnngtaaangtccacgtcgaanaaacancgcatcgccanccacacccacatcaagggcctcgggctngaagccaatgggacggggataaggatgtccgngggattcctggggcaaggggangccaaaaaagcgtntgggctggtgtccacattattcggcaaaanaaaatttgctggacgggcgctgctccctntcgggccaactggcaaa

SEQ ID NO: 99527 - DNA, 154 bp, Triticum aestivum
  unsure (1)..(154): unsure at all n locations
  Clone ID: PAT_TA_99527
gncgccttccttccttctccctcccncctcanccntctnttgtgctcctctccgcccctccngggctccacaggcgaaccctacacgctcgcgcgcgangggccgccccgatctgcgagatgtngcgcaaccacctttnacaggnnctccggga

SEQ ID NO: 99528 - DNA, 380 bp, Triticum aestivum
  unsure (1)..(380): unsure at all n locations
  Clone ID: PAT_TA_99528
gcctaaacctcctcgcanaaaggaagcagctttcnacttccgcccccaaattcgctcgatcggaagcgaccccgtanagagnancaatggnngggntgtccctgcggtgcngngactgcggcgtncaaatgangagcgttggangaggcgcaaggcgcaacgccgaggccanctcccanaccaacttcgccggagtccanccgagggcgtcctcaaactcgtttgngccgactgngggaaaccatggcgctcccaaaacgnnggtgggactgnaaaanaaacgnaccgggcaaaccccagtttanaggcaaaaacanngngggggggcaancccaaccatttccaagggnccccnaaacccggctntggggggcangggt

SEQ ID NO: 99529 - DNA, 424 bp, Triticum aestivum
  unsure (1)..(424): unsure at all n locations
  Clone ID: PAT_TA_99529
ggttctctacagcccaccttgnctttgntaccgcgttcatggcttcaccactaccggcattcgttgtgcggcgagccacgccggtgctggtggtgccctcggcaccgacgccgcaggaggcgaagcccctgtcggacatcgacgacgcagcggtcatgcgcttctactccgcgggcgtccatctgtaccgcggtgacgtctccaaagaggggtatgaccccgccanggtcatcanggaggcgctggcaaaggncctggtcccctaatacccgctcnccggncgtccgcgtgaggaggccgggaggaagctcntcntggagtgctaagcncangggntcctttcctncaagccnncnctgaacttancgggggcgaattccgcgaaattgggtaacccccaatcccctgctaagaacaattcgtn

SEQ ID NO: 99530 - DNA, 469 bp, Triticum aestivum
  unsure (1)..(469): unsure at all n locations
  Clone ID: PAT_TA_99530
gcgatncataaaagcatcgtctctcgtctcgtcnaggaatcatacaaccatncggcggtggcaacttttcattnagtccaagatggcgaggnagattgaacctcgagaagctgaagggcggcaaggggaagccaagctcgaggccaacangaaggccatgaacatccaagtgcaagatatgcatgcaagactttcatctgcaccacctctgaagcaaagtgcaaaggatcacncccgnangcgaaacatcccgaaagagcgaactccgtccaagtgcttcccccacctcaaagcccgttgatatctggcaaaatccngacgggggaagaagagattaaaagnnaaaaganaagntcctgcccggttntccagcctcctattatcatntttccccaatngnaangggtggnttccccccaaancctaggggcnaaaacccngggggnccnaanggttccaaatnattttt

SEQ ID NO: 99531 - DNA, 486 bp, Triticum aestivum
  unsure (1)..(486): unsure at all n locations
  Clone ID: PAT_TA_99531
gcggcagcgaacagggtaagctgacgcgagacatcgccatggcgtcgcgattcctaacccgatncaaaaaccctaagctctcgccctctcccgcgcggatgcggcgccggcgcccctgggctggatccgcgcgctctcctccctcccgcgccaacccgccaacgccggccccgtcccggcgattggattccctcctgggcctcaacaaggttctggggacatgagccaaaaatcacacctcaagcgggaanaaaaattttaaccggggtttggnttttctactggtngcaancaaatggggttttcccaaatgcaaaaaanataacaanggcccaanaggatnatgtaaagnccaacntttcctgggaaattggtncaantcctgaattgcaactaaaaagccgacttggaaggggggcccttcccctaaaatttaacgggnaatttaaagccccacttanaangcaagctggctnaaacctaaaa

SEQ ID NO: 99532 - DNA, 453 bp, Triticum aestivum
  unsure (1)..(453): unsure at all n locations
  Clone ID: PAT_TA_99532
ggctatacgacacgagtgggcggacggcgacgttggcgacgaggacgagagcagggcaggaacccagctagctagctagctagccggcaatggcgctgccggcgccgaggtggctgcggcgggaggtgctcgtgggcctcgcgctcgggcagttcgtctcgctgctcatcacctccaccggcttctcctcctccgagctcgcacgccgaggtacgtacgcccggccggcggccggcgcgccgccgtttaatccgctgtccccccgcaatgccattttgcctggtccanttatgaaatttcnttgggaattgggaaataattatgaacctggcttgataagggaaattgcctcctgctaacaaatcaataatcctccctgaacnacctaactgggatttctaaccacncccaactcctggaaaanaaaantcttggaaaccaaaanggaaaaaa

SEQ ID NO: 99533 - DNA, 458 bp, Triticum aestivum
  unsure (1)..(458): unsure at all n locations
  Clone ID: PAT_TA_99533
gctcttcttccttctccaaatagcaagagcaaagcaacattcacactatcctccatgcctcccctctacgcattttcgctcgggcttctcctcctcttgcacattcctcattggtgcccttcgtccgcagctgcaagcgataccctcacggctggccaatcgctcgccgtcgggaagcaaagctcgtctcaagaaacggcaagttcgcgctcggcttctttcaagccaagcagcaggcataatcaagtaagtccctggacaccaccaagctccaagctggtaccttggcatatggttcaacaaagattccaagtttttactgctgtgtggggttgcctaataggggcccaagcccaatcaactgggccccaaacctcaaacctaacaacagctcaaagaatatcgaggcgatggcaatccttgtcaatcgcgaaacaaacganttccggtngttttgg

SEQ ID NO: 99534 - DNA, 430 bp, Triticum aestivum
  unsure (1)..(430): unsure at all n locations
  Clone ID: PAT_TA_99534
gtttttttttttttcaattggtaagttttgggactatattcttctacttttatcactatactaagctggtatccagtccatcgatgtcaaatccgaaagcatcgaactgaatgctaccgagtcgaacgtctcgccgagcgacgtggcctcgcatatatcggactcttcgccgcgatatactttctatcgctatcctggatcgagggtcgtgatcttcatttacacctgtccatcagaatcgtccatcaaagaaaagatgttgtatgcaagcacgcgtcgagtggcgattcaattaggcgaggnggagggtatccaaatttgacaaagaaggnaaacgattcaacaacccaacaaaaaatgaatgacatatctgactaagatgattaaagattcgaggggagcntcaacaaacgaaatcantgggggnaag

SEQ ID NO: 99535 - DNA, 491 bp, Triticum aestivum
  unsure (1)..(491): unsure at all n locations
  Clone ID: PAT_TA_99535
gcacgtcatggccatgaacgcgtactggtacatatacatgcgcacccggggcagcgacctgtcgaagctgatcggcgaggagcccatgaagcggcggtacaagacctcggccgaggaggcggcgtgggagtaccaaggacgcggcgtggagcccgctggtccggctccttggcggtggcggcggcaaggcgtggccggccgacgaggcacgggagaaggcggcggcgttcgtcaacgtgctggaggaganggtgaggaaacacngggcggagtacaagatnccggacggggacctcanggcgcaaatnaaaggccccgtgaccaaaggcntncnccgcgcntacgccnggtttctganaaagnaagggggggncccgggnccaaattcaccnnaagggggtattctccgggncaacaaggtcncatntttttgcaaccancttggggaaagcccgtncccttccccgnnttaaanctncctgnagggntcc

SEQ ID NO: 99536 - DNA, 434 bp, Triticum aestivum
  unsure (1)..(434): unsure at all n locations
  Clone ID: PAT_TA_99536
gncccgctcccctcccctccctcctcccgagatcccatccatggncgcctcctgcccccggatctggccctgaggncgccattgctggattcgcctcccccctccgcgccgtcgcgctccctgcccctccgcgcgccccgttgattgcggcggcctgtcctttcccccctttcttgggggtgcgttcgttcgttggntcttgatncgtcgcatttgcgccggggaagctgccccagancaangaatttgccctgagatntccggtcgccgttgctgtccaantccccccctccctgcctggcantgnaaacccccggttgctgtccaaagggngtcttttaaaaaaaaatttccnngaggaatttaaaaggtcgggntccccgggaggangggttttcncaaanggttcttttatttggggggaanaaatttnn

SEQ ID NO: 99537 - DNA, 441 bp, Triticum aestivum
  unsure (1)..(441): unsure at all n locations
  Clone ID: PAT_TA_99537
gcccctcctaggggatcgccggagaggaatcgcgacgagggcttcctcctatcagttaaatcaaagccatggagcacaaggagaccggctgccantctcgggagggccccatcctttgcgtcaataattgtggcttcttcngcancgcggngaccaagaacatgtnctccaaagtnccacaaggagatggcgatnaaacaagagcaaggaaaagctgggccgcctcctctttcgacaagcatcgtcaacggtggcgatgccgcaaaaaaanatcttgctgntggnaacaaaggggtgggaatttctcaccttnaggngaaaaaccctttttaacgcanaanctgctgaaaatccctggtccaaancnangggggcaattggnaaaccccaaaagggccaaaaccggggggaaaaacctgcaaaaaaaaangggtcggnttt

SEQ ID NO: 99538 - DNA, 445 bp, Triticum aestivum
  unsure (1)..(445): unsure at all n locations
  Clone ID: PAT_TA_99538
gcgatgttcaagcggtcggtgacgtttgagaagcgcgacgacacggactttgcatcgcaggcggccatgtggggaggactgcacgagttcggcgacatggcgtggctgccgcggcaaggcaaggtgatctaccgcaaggacgatcgcgtacccgtctcaaccaagggcaacggcctcaacgactatctcggctttcgatccaatcctacgctcgcgctcatcaccgccagagccactggaggagcaccttggaggaggacnngcgggcgacatcgccaaggtgcctnggcgggcgcnggncgcccgtccgtggctgttccgagnctgcnnggcctaccngccttcanccaanccgancgggttcanttctttcaanaaggggtggnccnggnggttgggggttccaacnacccgccatnccnaagtnttccgggcacgtngcaat

SEQ ID NO: 99539 - DNA, 230 bp, Triticum aestivum
  unsure (1)..(230): unsure at all n locations
  Clone ID: PAT_TA_99539
gaggaagcgcccctccgcgtcctctcttcttgtancaccgctgctgcttatgcttcttccagcgtttggtcttgctgcagggaggcgcaacctgatcactagagaccctcggtacgacccacacacgatgcccanatccanaaccactgccagagncacancctgatcngaacgctcanccattaccacgaaccgcatcctgacccaaatccacaaccattgccaggcca

SEQ ID NO: 99540 - DNA, 453 bp, Triticum aestivum
  unsure (1)..(453): unsure at all n locations
  Clone ID: PAT_TA_99540
ggcatccagcagcgtaatggtcgcaagagcctgaccactgtccagggcctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaaggccggcattgtgaagaaggaacacatcaagattcatggtttctgaacaactgccagctccatatcaagaagtctacatgcaaagcaagctatatattggtggtgcagtatatttagtttgtgtgctagcgcaaagcaggcgttaccaagcttgcgccgtctgagtttacggaaaaatcctagcatagcccaacctcctctggcgtgttatggcnttgttacccttggtgtttgaaacctttngtaagggagcnn

SEQ ID NO: 99541 - DNA, 271 bp, Triticum aestivum
  unsure (1)..(271): unsure at all n locations
  Clone ID: PAT_TA_99541
gcgcgcagctcgatcgcgtccccagcttcagctgagctccaactcaactcaaattaatcgcagatggtttcttgtgggccagtagtggcttagcgcattagcggcggaggttggtacgatcaggtaggccggaggtgaggtgccacatgttgagtggacaaacggcggttagtggcagcagcagcagcatcatcgtcatcagccgcggcgtcgagcaggggagcgggagcggggagcagcagcaccagcggcggccggtcganggtgaaga

SEQ ID NO: 99542 - DNA, 456 bp, Triticum aestivum
  unsure (1)..(456): unsure at all n locations
  Clone ID: PAT_TA_99542
gcgaagcacccacaccctcacccacccctcttctccgatggcccgcacgaagcagacggcgcgcaagtccactggcggcaaggcgccgaggaagcagctggcgaccaaggcggcgcgcaagtcggccccggccaccggcggcgtgaagaagccccaccgcttccgcccgggcaccgtggcgctccgggagatccgcaagtaccagaagagcacggagctgctcatccgcaagctccccttccagcgcctggtgagggagatcgcccaggacttcaagactgacctgaggttccagtcctccgccgtgtcggcgctgcaagaggccgccgangcgtacctggttggcctgttcgaggacaacaaacctctgcgccatccaagccaaagcgcgtcaccatcaatgcccaaagggacatccaagctcgcacgcccgcatccggcggggaacgcgccctt

SEQ ID NO: 99543 - DNA, 436 bp, Triticum aestivum
  unsure (1)..(436): unsure at all n locations
  Clone ID: PAT_TA_99543
gcaaaagctggctatcatggcggcaagtgctctccccaccctctgcactgcgattgctcccaaatcctttgtctcatctttgcctcgccccactccgataaacctcctcagatcaaaaatagtgtgcagctccgtccgttccgtgaaggcaacgcccatggaagtggaggaggaagcagctgcaggaggcggcggcggcacaaagctgtctgcctggacaagcgtcccgcaacaacggtgggaaggcgacttggttgtcgacggacagctcccactctggctgaacggcacgtacgtgaggaatggggcaggactgtgggaggccggcgacctcgccttcgaccacctgttcgatggctacgcgacactccgtccgtgtctccttccggcaagggcgtgccactggngcgcaccgggcaaattgagtctgaccgcn

SEQ ID NO: 99544 - DNA, 194 bp, Triticum aestivum
  unsure (1)..(194): unsure at all n locations
  Clone ID: PAT_TA_99544
gcgacgcgttccccggaccagaccagccccaggcgacacgcagtcacggagagagttgggagaacggaggtggccgggaggaagatgaaggccaagagcggcgccgccgccggggagaggaggccggtgntgtctncgaccatactgctcctctgcgcctgcagnttcgatcctcggcatgntcttcaccnacc

SEQ ID NO: 99545 - DNA, 450 bp, Triticum aestivum
  unsure (1)..(450): unsure at all n locations
  Clone ID: PAT_TA_99545
gcaccattcggctataaatagtggcgccggtgggaggctatccattcaattcaattgtgctcatcatcatccccgataccaaagcccatcttcttctccttgaaatctttttgggttcacaagatttggaggatgtcttgcaactgtggatccggttgcagctgcggctcanactgcaagtgcgggaagatgtnccctgatntggcaaagcaaggcaacgccgccgcccaagtcccccccgtnggnntgctccggggnngtccctgaaaaaaaggggggcaattcnaaggtgggccgccgggcaatccgggcgaaggggtggaactggcggngaanaacttgcaaattgcaaacccctgcaaatgtttaagctgcaatgcaactcctacgttncnttacctgttgatnggngttganaagtatnactttaataaacgggggggcctggan

SEQ ID NO: 99546 - DNA, 449 bp, Triticum aestivum
  unsure (1)..(449): unsure at all n locations
  Clone ID: PAT_TA_99546
gtctacacaatcgcatcgaaaccatagatcggttaattacccancctgctcccangtgaatccacgcgcaaaattgcccgcggnaacttttccggcggatttggtttcccttcctcccttggnatccancccttgctgggtgggtgccccaagttctgctctantctaaatataatatattctgcaaagacganggaacacgaaggagatcgatncaaagatgttgtacgtggcgccaaagtggcggtgcctgctaaccgtggccgcgggcaatcgccgcgatgctgtcggcggcgggcggcgcccggggcgcaagaaacctnctccggtgccgtgccngcgcccccccaaaacgcgggggccttggatgttcaaattgcgaactttccggcgggngcccggcgaacgggccgggacgctcaaanaaaggggggggtttcccnggccgc

SEQ ID NO: 99547 - DNA, 447 bp, Triticum aestivum
  unsure (1)..(447): unsure at all n locations
  Clone ID: PAT_TA_99547
gcaacaaatccccacccaatctcgtctccgatcgactccacgctcgtcgaatactcctcccccaccgcctcaagatgcagatctttgtgaagacactgacgggcaagaccatcacccttgaggtggagtcgtctgacaccatcgacaatgtcaaggccaagatccaggacaaggagggcattccccctgaccaagcaagcgtctcatctttgctggcaagcagctggaggatggccgaaccctcgctgactacaacatccaaaaggagtccancctccaccttgtcctgcgtctgcgtggtggcatgcanatnttcgtgaaaaacctcaacgggaaagaacatcactcctttagggtgggagaagtcccgacaacaattcgaaaaagttaaagggcaannattcaangacaaagggggggnaattcctcccgggacaaaaaaacntt

SEQ ID NO: 99548 - DNA, 447 bp, Triticum aestivum
  unsure (1)..(447): unsure at all n locations
  Clone ID: PAT_TA_99548
gccccgctcccctcccctccctcctcccgagatcccatccatggccgcctcctgcccccggatctggccctgaggccgccattgctggatccgcctcccccctccgcgccgtcgcgctccctgcccctccgcgcgccccgttgattgcggcggcctgtcctttcccccctttcttggcggtgcgttcgttcgttgggttcttgattcgtcgcattttgcgccggcgaagctgcccgagagcaaagaaatttgccctgaaatctccggtcgccgttgctgtcgaagtccccctccctgcctggcaatggaaatcctcctgtttgctgtcgcaaaggtgcgtcntttaaaanaaaantttccccaaggnaatttaacggtccgggttccccgggaaggacgggattttctcccaaatggggttctttgatttgggggganaaatttgnn

SEQ ID NO: 99549 - DNA, 241 bp, Triticum aestivum
  unsure (1)..(241): unsure at all n locations
  Clone ID: PAT_TA_99549
gccgagttccacaggaaagaagcgcgaccggaggaggaagaagaggngcantnatgtcttcggtgttcagcgntgatgatacggcgcncttcttcggnttcctcggcgccgccgncgcgctcgtcttctcatgcatggnggcggtctacgggacggccaagatcggggtcgnngtggtgttcatgggggtcatgccggtcacagctcntcatgaantccatccttgcccngtcgtcatggt

SEQ ID NO: 99550 - DNA, 421 bp, Triticum aestivum
  unsure (1)..(421): unsure at all n locations
  Clone ID: PAT_TA_99550
gcaacaagaggccaagcaagggagggacggcatgaccacgactgcggatctgctccgccgctancctgctacctcgccgccggccgatccccccaccgtcctccagcgccccgccccctcctccatggtgagaccttggctgactgacaatcaattcccgccctccccttcgctgcatctgagttcgtccgcttcttttcttctgtttttccatgcncgacccaatccaatctggttgatgcgatgcccagnntccgtggcgangattcaagtgcgcgggaggattgttaaagtggttttggtgcaataagattggtagtggaaaaatttcgntttttttgggctgtcnggntgnggagggcggggatncngntttatagcaaacngannaggggtgctttccccctngntctccctggaa

SEQ ID NO: 99551 - DNA, 366 bp, Triticum aestivum
  unsure (1)..(366): unsure at all n locations
  Clone ID: PAT_TA_99551
gaagcgggcagggcagccatggcgctgcctcaccccaacctcatcatcgcccttctccccctcctgtagacacccatcattgcactccactcccccaccccgatcgtgtcgtcgtgtccccagctctcgccctcctctcccactccgacccccttctcctgtcctccctcgtcttcttgctcctgcaccgcccgcccacgccccagcccacgctatatatattgctgcccgcgcgccgtcggcttccagctcgatcccgacctcaccggcaccgcacaagtaccgctgcggacggactgtanagcaagagccatggtgaacgccttcttcgngaccctggggcgggggctggaacgacctgagcgg

SEQ ID NO: 99552 - DNA, 455 bp, Triticum aestivum
  unsure (1)..(455): unsure at all n locations
  Clone ID: PAT_TA_99552
gcangagccantccaaaccaaactcgtnagccaaagtagcaatacaagtacctctanctaggacacgtcatgggaaacataactgntagtgccagttnggncatgcaaagaagcagcgaagacaccaaacgcctcnccgccccgcgccaaaaacgcctcganagcttcgccggntcgctancggncgtcgccgctggtcatattcaagcgcctgcctcgtcctgatcggcgccggcggggccgctcctgctgcgggtctacttcgtccacggcgggcaacgccctgtgggctctccgcgctggctccanatntccggnttgggncgctcctccctcccaacccctgtgtggtctccctcttccgcgggtcngccggccaacggtatcgccaaacctcctcctcccttctccggcctcgttcgtcgcgggcgcccgttgctcgggngggtttttag

SEQ ID NO: 99553 - DNA, 462 bp, Triticum aestivum
  unsure (1)..(462): unsure at all n locations
  Clone ID: PAT_TA_99553
ggcggcggcgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggngcttttgcccccaagccatcatccggtcctcacaaggccagggagtgcctgcctctgatcctcatcctgagtgaacagantgacatatgctctcacctaccgtgaagtgnaatctatccttatcagcgtcatattatggttgatggaaaggtccgcactgacaaagacctaccctgctggtttcatggacatcaatttccattcccaagacngggtgagaactacaggcttctgtatgncaacanngggtcgcttccgccttcaatcctgtcagggacnaaggatcctaagttcaangnt

SEQ ID NO: 99554 - DNA, 273 bp, Triticum aestivum
  unsure (1)..(273): unsure at all n locations
  Clone ID: PAT_TA_99554
gcacacaccacaccactcctccactccactcaactccactccccggcagcacttcacgtacctagccagccagcaatggcgatgcagcagggaggcggcggcggcgagggggagacgctgatgcancggtgcaagccgtacgttgcnatgatctcgcttgcagttcggggtacgccggggatgaacgtgatnaccaanggntgtcgctgaancaacgggaatgaggcaactacgtncctgggtggtngtaaccggcaagcctttcgccaacct

SEQ ID NO: 99555 - DNA, 460 bp, Triticum aestivum
  unsure (1)..(460): unsure at all n locations
  Clone ID: PAT_TA_99555
ggtcaatcatggacttcccgcaccgccacggncacggccacggccgccgcgacgacgacgacgaagaccgccgcgcccccgccccctacggccgccacgagcctgatgcgtacggcgcccctcccccgtcctacggccgccgccccgacgacgacgctggcgacgcctacggccgccaccctcccgccgcctacggcgctcctcccccggcctacggtgccccgcctccccgcctacgggggcggccgcgaggatgagtacggaggccgcgccccggcatacggtggccccggcccccggnctaagggtggagggccgcgangactaactanggggcgccaatccgcccggcgcctggcgggctancggcgggtgggtgactacgggnggccangcccctggctccggggcctaacggaagggcgggccgccaacnaaaggnttatgnggcaacccgccc

SEQ ID NO: 99556 - DNA, 373 bp, Triticum aestivum
  unsure (1)..(373): unsure at all n locations
  Clone ID: PAT_TA_99556
ggttgcaatggccagttgaagagattgatcccttcgagaaatgnaatcaaccatcaaggggctagagctgaacaagggagacctatttgagattaagggaattgacactttgcaggctgatgtcgagatagattttgagctgacatccatcgatgacgcgggaccttttgatccttcctggnttttanacgccccnaagcantgccgggaagctgatgcatcggttcatggtggcatagggccattcggacttgttattctggcctccgacaacatggaggagcacactgatgtgcacntcagggtttacaaatcacangcaaaactacatgatcctcaagtgcactgnccctaaaaanggnngtcccctggg

SEQ ID NO: 99557 - DNA, 393 bp, Triticum aestivum
  unsure (1)..(393): unsure at all n locations
  Clone ID: PAT_TA_99557
gcanntcccnagccaatctcgtctccgttcgaccccagnctcgtcgaatcctcctcccccaccgcctcatgatgnanatcttcgtgaagaccctcacaggnaagaccattacccttgaggttganagctccnacaccattgacaatgncanggccaacatccaggacaaggtggggcattcctccgganagcancgtctcatcttcggntgggaaagcanctgggngcgatggtcgcaccctccgctgactagnacatccatnagngtntccanccttcancattgtccctccngccttcnggggagggnattncagatnttcgttcnatcaacccccaccnggnaangaccaatcanccgcctntggggtngangtcancttgacaacatgc

SEQ ID NO: 99558 - DNA, 322 bp, Triticum aestivum
  unsure (1)..(322): unsure at all n locations
  Clone ID: PAT_TA_99558
gcagcggtgagtccttccggcgattggagcggcagcgggaggcgcgcgagtgcggcggagaggatgcgggagggctgcgtccctacgatagggcgacgcccgccgggcaccacgttgcggccctgtgggaggaggcggcggcgaggatgcggtcggcgggagggaggcggtggccggcanaagctgtttcgacgaattgggagctcctcctgcacgtcganagcaccgtacggcaccaagcacgcgcgcatgccgtgtccgcgtccgngtgccatgtgtcactgncnggngggccngaatccctctgnngtgctcctcgccc

SEQ ID NO: 99559 - DNA, 293 bp, Triticum aestivum
  unsure (1)..(293): unsure at all n locations
  Clone ID: PAT_TA_99559
gctgatgccaacccgaggtctccagatgctgctgggggatgcctctccgtggagcatcgccggcgcggtggcggccgtggcgctgctgtggttggccgcctggatcctggagtgggcatggtggacgccgcggcggttgggccgggctctgcgggcccagggcctccggggtacccggtaccgcctcttcaccggcgacntgccggagaacgcccggctcaacagggangcccggttncaagcccatgccgcngcggctnccncnaacatnaaccctccgcngtggnagncca

SEQ ID NO: 99560 - DNA, 483 bp, Triticum aestivum
  unsure (1)..(483): unsure at all n locations
  Clone ID: PAT_TA_99560
gcctcgtgccgaattcggcacgaggctgagcctgagcggtcaggcgagctctcaccactcacctccgtctccggccatggtngaccatctccgcggctctctccgtctccttcctcccgcccgcggnccgccgcgccgtctccaccgccacctcctcctccccgcgcgtcangagagccgcgcggttcangtgctgcncccancctccttccccggagcagnaggagacccccgcgccgctgccctctccgccgggaattgccttcgtctctgtggggggtctccacgatgcgcctgtgncaagcgggatntcnccggngctggggctcttggannccggctacctcangtngctcaaagntcaaccggctccgagggccttctnccccntcncccgggggaatgnttgcgnngacgtttnctncgancaancganttactccgtcggnctttcngggattccntctctccaattnnnttttg

SEQ ID NO: 99561 - DNA, 402 bp, Triticum aestivum
  unsure (1)..(402): unsure at all n locations
  Clone ID: PAT_TA_99561
ggaagctcctanccaacaccaatcaaagcttccatccaatcccaagcaacctcgacgatgtcttgctgcggaggaaactgcggctgnggtagcgcctgcaagtgcggcaacggctgcggcggctgcaacatgtacccggaggccgaggccgccggcgccaccctcctcgtctccgctaccgccacccacaaggcgaagctccggcggcatgganatggcggcggngaacggtggctgcgggctgcaccccagtgcaanntgtggggaccaagctgctgnatgctcctgctgcantttgcctngatncatcatcggtcatggcatngcancggngtgnatcaataatcttttggttcggntcaanccatcttcctntncaatngtaanccnttnacctgggtc

SEQ ID NO: 99562 - DNA, 267 bp, Triticum aestivum
  unsure (1)..(267): unsure at all n locations
  Clone ID: PAT_TA_99562
gcagctgcaacctaccccaaatccctccgccatcgccgccgccgccgccaccgctgccggcgccatgctccgcctccggagctgcatcgtcttcnanctcctcttctttncggggggctttcntntctcttngncccancgnctcctctccgccggcgngggggcccattttctccgaggcaancgnttctcccgtnggagggaatanctcgtctncancctggcgggctnancccngaggcccaaggggcttcaaangggcttcca

SEQ ID NO: 99563 - DNA, 374 bp, Triticum aestivum
  unsure (1)..(374): unsure at all n locations
  Clone ID: PAT_TA_99563
gctcaaatccgcaccgctctatttaaagaagccctcaccttcttcctccaacaggagctagctacctgcagctgcagatcttcgccactaacccggagtagaactgcaagctgcaacaccccctgaangatatgtcggtccaggcggnggagccgcgggacacgnagacagcgcctgtcccgctcangcgccatgactcgctttggggtgattgcanagaaagtgncccatagcanccaccatggggctcccgggtgaanctggntccggtacgctgaggcctcgcncttccangaggcgtcgggnatcatctnacggggganatcgggggaacgtnccccgntctactgtctantccantgaacctttccccg

SEQ ID NO: 99564 - DNA, 316 bp, Triticum aestivum
  unsure (1)..(316): unsure at all n locations
  Clone ID: PAT_TA_99564
gtcgctctcctcgggaaaaagcgtgccccagctgcaagccacagccgcgagcaactcaacttgaagctcatctcaacccgccgtgtcggaactcatcactccgtccaccacatcacttcaagccttcaagctcacctcccccaccctccccatccncacccccanccccaaccgccgcacggcgacatttggtttganccttccatcttnatatngaggctccggtcacactacgcctccacgctntntcctagatttataagtcggggtagtctctctcgggccgagtcnangggaataatatccatgcnatacg

SEQ ID NO: 99565 - DNA, 469 bp, Triticum aestivum
  unsure (1)..(469): unsure at all n locations
  Clone ID: PAT_TA_99565
gccgcacccatacacaacacactcacgcgcacacgcccacaatttgtcccagcaatggagatggaggcggctccggtgagcgcggtgacgggggccctcaaacccgtcctggggaagctggccacgctgatgggcgacgagtacaagcgcctcgagatggcgcgcggcgaggagatnaaatccctcgccgacgagctctccgccatggacgcggctctgctggacattgtgggggangangacccccgattcccaaggacaatgcntggatnaangangcgcgggaactctcctaccaatatggaaagactccatcnatgacttcaatgngggacnatncatnaccaaggattnnaaaccgggccancggccttcctcntggaaaaanantaaaggtttnccggggaaaattaaaggcccttctcaanacnggcattggtttncaagggaccgggtnaananggggggt

SEQ ID NO: 99566 - DNA, 326 bp, Triticum aestivum
  unsure (1)..(326): unsure at all n locations
  Clone ID: PAT_TA_99566
gcctctccgatcgcgctaatggaggatgcgcgtgcgcacacatcgatcgatccgcgaggactataggctgtctctccgtagtggccttcctccccccttcaaccaagaacagtagggggagggctccctcttctcctcttgctcgcctgctcggagcactcactgacggccttccgcgcggcgaccagacagagctgcggcgcgagccacccgttcgacgaaatggctgagggggccgaagccggtaaaatcaagaaagcggccatggnttgcngcaangactgcttccaanggacctcccggaancccgtgctccgancttctgg

SEQ ID NO: 99567 - DNA, 413 bp, Triticum aestivum
  unsure (1)..(413): unsure at all n locations
  Clone ID: PAT_TA_99567
gccgccgccggctcccgggacaccccacagcgcacagacaacccaaggcctagcaccactctcgttgtctagcgcctgccggccggccgcgccgctcgcatcgatccaagccgacgcgcgcgcgagggcttctgcatgataaggaggaggatgggggcactgcacgtcggcgangccgcgggtcaagcttccagcagcaggtcggcaagaacggcgggggccacgggcgccgtcgtggngggaagataaaacgggctcatncggcgttgtacaagggacgggcaacgttggaggcgcctccccgggggatnccccgacgtngcccttgcaacngtgggngctcngaccggccgnccggggaagcggggtttcctccgccgcnncgaacgtngncgggtccgaaccgccnccaa

SEQ ID NO: 99568 - DNA, 466 bp, Triticum aestivum
  unsure (1)..(466): unsure at all n locations
  Clone ID: PAT_TA_99568
ggacacctctacctaccttagctctcctctttcagactgccagtactccactgctgcccacagcgcgcgcgcacacacacctcgaaacgacgagtacttaacggcttacccacccggcatacacctgcgcgcaccatagatttgctaggttcataggcgcactgcagctctggcatgtgtgtgtaggtgtgtgtgaatatatagaggggcgtgccctaatggtacatggctgagcagccttctggagcctcctcgtctgctgccggtgctgctactcctcaagctgcaagtncaaagctggctggctgaaccgggcganccgaactttccccggggtggtcctggctccncccaatccccnccggttcanctaaggcnaaacngggggggaaaaacnncngggtttgggggngaanaactccnggggagccntcccncgggtccanttggaagcaccccctttttt

SEQ ID NO: 99569 - DNA, 438 bp, Triticum aestivum
  unsure (1)..(438): unsure at all n locations
  Clone ID: PAT_TA_99569
gtagagatcccagaggaccagaccaccttcttggtttatgttcttttatcaggctttctggagaaggatactgccaagctttgcaagaaaggtgggactttagcctgaaattcttctccaaatcctttccaaattgttcatgcccttcagaatcattttctagtttcgccaccacctctcgctaaagatgggaggctactactgcttgatcccctgcttgctcgtctgctttctgctccacacacatggtagccactccctgaaccaagacatgcaattccactgacctggaggcgcttctcgctttttccagtggcttggatangaaaggcagcaaggcttgttggatggggtcccaacgaatgcaagcatgctgttcctggaccggcgtctcctgtgatcttgggnaggggttgttggggttgggattctccccna

SEQ ID NO: 99570 - DNA, 429 bp, Triticum aestivum
  unsure (1)..(429): unsure at all n locations
  Clone ID: PAT_TA_99570
ggcttaacccattgccgatcgagcaggcagatatcgtgtgtgcatagcgagagcggcatggggaacctgatctcggcgggcgcggcggcgggcgcgagcggagggaaggtggtgatggcggacgggagcgtgcgggcgctcagcgagcccgtgtccgtggcggagctcatgatggaccacccgcgccacttcgtcgtcgacgcgcgcctgctgcagcagcggaagggcgccgcagccggcggggccagcaaggtcgcgccgctgccggccgaccacgtgctgggcgcgggcggcgtctacgtcctgctgccggccanccgcggcaaggtgtccgnccgaggaggcgcggngccgtgctcaanggcgttcgcggtccgctggcgccgctccaaaggtcaatncccgggcnggtcggcggaaggaaagctc

SEQ ID NO: 99571 - DNA, 470 bp, Triticum aestivum
  unsure (1)..(470): unsure at all n locations
  Clone ID: PAT_TA_99571
cttcatacgtaccttcttcttcacttgatgccgcctgtctagctagctagctactcacatatgtcattcatggcgagctcaaggcagacgcggacaacatggtgcagccgctgcggcgcgtccatctccgcgccgccgggcgcgcgctccgttcgttgcgcgctctgccacaccacgacgcgcgtggagcgccggccgcaagcacaacggcggcctgcaccaggccgtgggcttcatcaagggcctgctcttcgggtctccgtcgcaagccgcagccgccgccgcccgcgtcctccgggtcgatgcgtgccggggacccgtaccgcctgncggncaagctaaccgcgcgcccgcgggcaaagaagcgggcgctcctccgtcggcaatcaagntacagnttcaacaaagtacgagcttcaaagggaccgtcaaccgacgtcaactggatggcctancttgctnccgcagng

SEQ ID NO: 99572 - DNA, 466 bp, Triticum aestivum
  unsure (1)..(466): unsure at all n locations
  Clone ID: PAT_TA_99572
gcttttccagcccccctcgctgcgtctgcgtctgcgtctgctggcaagagacacagcaccacgccgcggccgccccacccacccgccagccagccagccctcacaaagacttgacctgttcctgcgaccgcctcggnctcttcgcctccaacgcctcttccgcgatccccttccgcccgccgtcttccgtccgcagccccagcaccggcttccccctgctggttaacgctctcctctccggtcgatnggtcgggggtacgtcccggcgccgttgcgggttntggtctcccgcaccaaaagattaatatactangnaactctacgnnacatggntcctggcancaaggatttggattccatcccaaagggacaactgaactccgtttctcactatctgaaaaaannaaatactccgtcaanaaaattgaaatatgacattatacccngagggtgggtatataaaang

SEQ ID NO: 99573 - DNA, 174 bp, Triticum aestivum
  unsure (1)..(174): unsure at all n locations
  Clone ID: PAT_TA_99573
gcgaccgaccagagggagtgagcccgcccctgtcatccatctgtggccacggattggccggccggccggcctctcgggattctcggaacgaggnaggaggagagaggaaggagacncccctattggncgggagccgccngcctcactcatcacagcttcttccactgggcgcgg

SEQ ID NO: 99574 - DNA, 481 bp, Triticum aestivum
  unsure (1)..(481): unsure at all n locations
  Clone ID: PAT_TA_99574
gctagcttcagctagccaccctcttccactccgggcattttcttgcatccacgacggcaatggccaccgctgatgtccagaacccgacggccgcgctgacggaggaggcgcccgcggtggagacgcccgtcgccgccgaggaggccacgaagacggaggaggtccccgcgccggcggaggccgaggtcgaggcgcttgtccccgtcgaggttgaggagaccaaggaggaggcgccggcagccgctgagacggaggagaccaaggagcccgagccagcagctgccgccgagccggaggccgaggcgcccaaagagccagaggcgccaaccgtcgtcgaggcanaaaccaaaggaangccgttggcttgaagcaaagcccggcantcctccaangaaggtnaaangaaggaaggcnggcgccctggcttgnccgagccaaaaaggtgcccgggccgtcccccgaagggaancacccnggctnt

SEQ ID NO: 99575 - DNA, 470 bp, Triticum aestivum
  unsure (1)..(470): unsure at all n locations
  Clone ID: PAT_TA_99575
gccagcctagggtttcctcccgccgcccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaagtgccatggcgcacagggctgttgatgctgtgatgggtccccgtaccattcagcatgagactgttgtcggtgaggctgctgcatctatgactccaatggacaatgctgctgatgacaagtgtggcaacccttccaaggggctttcaagattgcatcaaccaactaagggnaggcgatatcnagcaaagttgccaattcctaactttgacatgcctgaaacgangtgccncccgttggagggn

SEQ ID NO: 99576 - DNA, 275 bp, Triticum aestivum
  unsure (1)..(275): unsure at all n locations
  Clone ID: PAT_TA_99576
ggatcgatcccccaccccaacgccgcagcgcatatcacgcggtcgtctctcccccanaactcccacgctagagctgctgctgcttcaaaacccggccccctattgcctcnatctcccctcgtcaaacccattcacacacaatgggtaaccgcacctcgcgccaccgccgcgccgccgccgaccagccggncacggnccctccgccgacggtccagcccaaacnccagncgccgtcgnagccccanacggcnccggccccggccccgatcgtcggg

SEQ ID NO: 99577 - DNA, 225 bp, Triticum aestivum
  unsure (1)..(225): unsure at all n locations
  Clone ID: PAT_TA_99577
gaaaaaggctagcaaatccccgccggtccgctcggggcatcgccgcgggtccggatccaggcgccgccccngccccccccncccctccccngtgtngggtctngaggccttcttangcaagttcagggcctctgttttcnatgcctcaanccgcancancgctgnttctantgccanaaccccctccactgcattcatctgcaatccttctgntcacatcgggaa

SEQ ID NO: 99578 - DNA, 357 bp, Triticum aestivum
  unsure (1)..(357): unsure at all n locations
  Clone ID: PAT_TA_99578
gcagcatctgccccagaaagaacaaagctcaactggtgccaccatgaacttaaccagtggagtatatctactctccagcctccaggaattataagaggaacctcccgcacacgctgcacatcggcgtttctctgttggtcaccagtcccatcccaagatgaggaaaggcgctctcgctctctacctccttctcctcctcacctttgctacccatggcagatggtgtgcagcaagctgctagaagcggcatggctgaggaagatgaagcacaatgatgctctgagggctcatcactatnaaacccaagggcaagagtctccctgggngatgcaagangtcccaaggaaagggttgggc

SEQ ID NO: 99579 - DNA, 445 bp, Triticum aestivum
  unsure (1)..(445): unsure at all n locations
  Clone ID: PAT_TA_99579
gctctgctagtagcgggctagagaggatggcacttgctccccggtcgtctctgcgctccctggtgctgctcatgtcgcacgggaagccacggctgagctctttcttctcctcgtcctccgcggccggcacaggcgttccgccggccaccccaggagccgatgctccggccgtccagcccccaggtagtatactaacccgcacagattaatgcttcctgcacgcacgccgtctccttttgatgccattgctaacagagtggcaagttactccattgtgctttgcagctccttcangncccaaagctccctgtcgaggaagagtttgttcttcanccaattcctggggttctacgtccaacgtccgtgttccgcaacccaactggaggcccgttggnagaatgttaaccgaacaaaggggtttgttctgnnaacgccccctnaaacn

SEQ ID NO: 99580 - DNA, 481 bp, Triticum aestivum
  unsure (1)..(481): unsure at all n locations
  Clone ID: PAT_TA_99580
ccaacgcaaatcctccagtcctcccaccttgcgcacccacntccgatctctcgtctcctcctccccgctcgaaacagncatggcgcccaaggccgagaagaagcccgccgcggagaagaagccggtggagacggagaagaagcccaaggccgagaagcgcgtgcccggcaaggacggcggcgccgacaagaagaagaagaaggccaagaagagcgtcgagacgtacaagatctacatcttcaaggtgctcaagcaggtgcaccccgacatcggcatctcctccaaggccatgtccatcatgaactccttcatcaacgacatcttcgagaaagctcccccggcgaagtcggncaagctcgcccgcnacaacaaagaagccaacatcaactcccggggagattcanaccggcggtggcggctcgtcctccccgggngagctcgccaaagcanggcgttttccgnggggcancaaggncggtnt

SEQ ID NO: 99581 - DNA, 435 bp, Triticum aestivum
  unsure (1)..(435): unsure at all n locations
  Clone ID: PAT_TA_99581
gatcagcaactgaccctgtaataccttacctagctagctaggtgtagtttgcttgagccaagatgttgggggtgttcagcggcgaggtggtggaggtgccggcggagctggtggcggccgggagccggacgccgtcgcccaagacgcgggcgtcggagctggtgaagcgcttcctcgccggcgccgagcccgccgtgtccgtggagctgggatcgctgggcaacctcgcctactcccaagccaaccaatccctcctcctcccaaggtcttttcgcttgcaaaaggatagatnttctggctgttcnaanggaantccttggacaaatttgggnggggtnanccaacaataacggctccccaaagggcggnaacganggggctccncctggtngaagggctnaaaaaaancttaagggaaaaggggcccctnacccc

SEQ ID NO: 99582 - DNA, 462 bp, Triticum aestivum
  unsure (1)..(462): unsure at all n locations
  Clone ID: PAT_TA_99582
gcgnctcngatcnacccgangctcgtcgancccttcttccccancgcctcaagatgcagatcttcgtgaagacactcacgggcaagaccatcacccttgaggtggagtcgtctgacaccatcgacaacgtgaaggccaagatccaggacaaggagggcattcccccggaccagcagcgccttatcttcgctggcaagcagctggaggacggtcgcacccttgccgactacaacatccagaaggaatccaccctccacctggtgctccgcctgcgtggtgggcatgcanatcttcgtgaaagancctcaccggcaagaccatcactccggaggttgatangctccgacaccattgacaacgtcaaggntaagattcaagacaaggagggcattcccccgggancaacancgnccttatcttcncaaggaaagcanctgggagggattggncgcacccntgccg

SEQ ID NO: 99583 - DNA, 462 bp, Triticum aestivum
  unsure (1)..(462): unsure at all n locations
  Clone ID: PAT_TA_99583
ggaaaagcatcgtctctcgtctcgtcgaggaatcaacaaccatgggcggtggcaacgcgcagaagtccaagatggcgagggagaggaacctcgagaagctgaagggcggcaaggggagccagctcgaggccaacaagaaggccatgaacatccagtgcaagatatgcatgcaagactttcatctgcaccacctctgaagcaaagtgcaaggagcacgccgaggcgaaacatccgaagagcgacctcgtncagtggttcccccanctcaagccgtgatatttgccaaatcggacnggngagagagatnaaaganagagagagnaacttgccgttatccaccctagtattaacatgtttcncaatgaatngttntttacctaancatgggttctgnaactccgggtgtggccgctgtcccaaacngcctttggggtttgtngnccaacnactatgttancctcc

SEQ ID NO: 99584 - DNA, 384 bp, Triticum aestivum
  unsure (1)..(384): unsure at all n locations
  Clone ID: PAT_TA_99584
gttctggttcggttcgggtccganagtagctagcctagtctagggtttccgtagttcggagaggacacaanggnagagatccatggcggngactgagtatcgctgcttcgtgggcggnctcgcctgggccaccgacnaccacancttccagnaggccttcatccagtactgnnacnatcctcgacgncaagntnatcaacganccgccaagactggcangtcccgtgggcttcngcttcgtcacgttcggcancnnaggagtcgattccccaccccatncgaggnnattaacgntcaagcgtancttcganncggtcggcaacatcaccgttaaatacgggnccaagtctcggccagggttcncgncgntgggtgggnctgtcc

SEQ ID NO: 99585 - DNA, 477 bp, Triticum aestivum
  unsure (1)..(477): unsure at all n locations
  Clone ID: PAT_TA_99585
gcacagtcacatgttgctcttgcctgatcccctttctctccgctcactcctagattgctgccgctggatagctcccatcaagcttgctgcactaattcggtgccctgagcttgctcgtcctcatttgtagcgacccccaccgctcgattcgctggatcggncatanggtgacctccgacggtggctggtttgtctcgtgaacggcgatggagggggtagtagggccaaggtggagctgcacaagggaggaggcgaagatcgtccatttgcaaaggggatgttactctccggcgtccgtgcaagtgatgttggtgtggatttaagtcccccgcaagccagttttgatncaattttaagtaatgaaggaatggctgtagacgttttctggcgnctaaaaccgccaagccangaatgcaatcctccaaaatnctccaaaaattcctcnaaagtttcnaccttgcanngnattttttgcaa

SEQ ID NO: 99586 - DNA, 479 bp, Triticum aestivum
  unsure (1)..(479): unsure at all n locations
  Clone ID: PAT_TA_99586
gagtaggactagcttcagctagccaccctcttccactccgggcattttcttgcatccacgacggcaatggccaccgctgatgtccagaacccgacggccgcgctgacggaggaggcgcccgcggtggagacgcccgtcgccgccgaggaggccacgaagacggaggaggtccccgcgccggcggaggccgaggtcgaggcgcttgtccccgtcgaggttgaggagaccaaggaggaggcgccggcagcccgctgaaacggaggagaccaaggagccccgagccancanctgccgccgagccggaggccgaggcgcccaaaagaaccaaaggcgccanccgtcntccgaaggaaaaaacaaaggagggccgtnggctngagggaanaaccngcantccctccaanganggttaaaggangaagggggccccctggctgccaagccaaanangtnccccnggccgtcccccnaagggaann

SEQ ID NO: 99587 - DNA, 466 bp, Triticum aestivum
  unsure (1)..(466): unsure at all n locations
  Clone ID: PAT_TA_99587
gcagccatgttaggactttggaggtaggagtagtccaggatcggagagagatagagagcgtccatggacgtgttcatacacgaggactacgtgaacaagcgcaacatggtgaagagggagcagaggaagaagacgcagttgcaggtgctgcagctgggcagcccaggcgcatgccggccgccgccggcgcacagggaggacagcctgggagcgggagcgccgaggcagtgcctgacgccaanccgggcgtcttaccttcgtccgccgtcgggtctccccgcgtcaggctcgtcggagggaagccatctcatcggattaacgccgtcacctcttcgattgcctgaagccgttactatgcaangcnacnagangttaatgttgtgagggttaaagaataaancctggggttcctccnatggtgaangtttgtttgcaaacccaantttttggggcncctntttcaagc

SEQ ID NO: 99588 - DNA, 373 bp, Triticum aestivum
  unsure (1)..(373): unsure at all n locations
  Clone ID: PAT_TA_99588
gctcaaccacccagcaggcccagcaccaccgcgtcaagcagagcaggtgccgcctcctcctccgcgtccttatctgcggcggctgcaatggccgaccgcgtctaccccgccgccaaagcccactccgccgcccccaatggccaacggcgccggcggcccgacggcgcccaagccgcagatgtaccaagcgccccatctaccggccgcaagggcaagcgaagagcangcgcgggcggtcctgccggttgcaacttttgctggctggcttntngctggggaatgncttgtnggtaatcctncctcncgccaagtcgccgccgggcngcggggcgggggnccttttnacttgctcctaccggccctcaaaggccca

SEQ ID NO: 99589 - DNA, 448 bp, Triticum aestivum
  unsure (1)..(448): unsure at all n locations
  Clone ID: PAT_TA_99589
gcttcattctccctcgttccatccaagctccaccatccatcactgatttgcacttacctagctactccgcaacccccacttccggcttcttcatttctcactactagtacgtagttgagattatggagggcggagaaggatccggtggcggcggcgagccgaccaagtaccgcggggtgcgccgcaggccgtggggcaagttcgccgcggagatccgggactcgagccggcacggcgtgcgcatgtggctcggcaccttcgacaccgccgaggaggccgcggccgcctacgaccgctccgcctactccatgcgcggccgcaancgccgttgctcaacttccccggaccggggcgcaantttacaaaggccgatgccaaggccgccangggcnanggggttcttctttcctccngcnaanggcatnagggttcaccnngtaancagcag

SEQ ID NO: 99590 - DNA, 439 bp, Triticum aestivum
  unsure (1)..(439): unsure at all n locations
  Clone ID: PAT_TA_99590
gattagccatcgtaatttgctagctacatcacatccggaacacaaacacaagaggagagtgaaactgagagtgcaacaatggcggagtttgctcttgggttgaccaagacggctgtggaggggacggtgagcttggtcaagtcggcgatagaggaggaggccgatctcaaggaaaagatgcagaacgacctggtgttcatcaccggcgagtttgaggtgatgcagtcctttctccagatcgccaacaaggagcgcaccaagaatgaagtgatgcggacctgggtgaggcagctccgcaacctggcctttgatgttgaggactgtgtcgaattggtcgtccaccttgactacaagtcaccctggtgggcatgcttgccgcgcgtgtggcacacggtgcgctgcaatgcactgcccctgccnactagacgangcggtcgcn

SEQ ID NO: 99591 - DNA, 440 bp, Triticum aestivum
  unsure (1)..(440): unsure at all n locations
  Clone ID: PAT_TA_99591
gcaacaagaagaccttctctagctagctagcaccccatctcagagagcgccggcgtagacgaggagatcggcgatcaccgatcagcgatcggtggaccggcaatggcgtcctccgggctgctccttttcctcggctgcctcgcgtccgccctgctcgccggcgccaccaaagtgcaccaccacgagttcatcgtccaagagacgccggtgaagaggctgtgcgaggagcacaacatcatcacggtgaacgggcagttcccggggccgacgctggaggtccgggagggggacacgctggtcgtcaacgtcgtcaaccaaggcgcagtacaacgtcaccatccactggcacggcatccgggcagttcaagacggggtgggcggacgggcccgaattcgtgaccagtgccccaatcaaagccccggnggnaagctacaantac

SEQ ID NO: 99592 - DNA, 449 bp, Triticum aestivum
  unsure (1)..(449): unsure at all n locations
  Clone ID: PAT_TA_99592
gcaccaattcaaatcatagccaagatggccagcttcgcctcccatcccagaccagccatggcccaaccggcagcaccagctccaccgacgagttcactagagcgtgccaccgctaccgagagttcaccggaagacgccctatccgaagatagcctcaagagcttcatatcctcgctcccatcaagggaggggtggccacagccgctcacccagtacaagggctactggttcaagccggggatcctggatggggtcctgcacgccagatggacctttgcgccccgcgccgacgacgtcgtccttgccacgcagcccaagtgcggcaccacctggctcaagggncctcgccttcgccgtcgccacccggtcccgcccacatcgtcgggcgccgccggaacaacccgctccttcacccgccaacccgcaggaacctcgtgccgttcaatctg

SEQ ID NO: 99593 - DNA, 400 bp, Triticum aestivum
  unsure (1)..(400): unsure at all n locations
  Clone ID: PAT_TA_99593
gccaatccccagttccaggttcttggaggaggggggaanccatgggcagcttcnccaanctggccancangtgcgtggagacggaggcnccggtcatggtgaanatacaaaagctgcttcgatggtgncacngatgtgatgtcgcttgcncagggaattgtttattgcgcaacctcctgagtgcagccctgaacaaggtcaatgaaattgnatgggaaccacncatccattaaatatngtgctnatgatggccttcccgatgcttcgaaaancactttctcgnngaaancttctngagagagaactnancctaaccactgttatcactttatngntgacccgctncgntgcanatcaanggcttttntnaacctgggttctggacnctttncagattgct

SEQ ID NO: 99594 - DNA, 405 bp, Triticum aestivum
  unsure (1)..(405): unsure at all n locations
  Clone ID: PAT_TA_99594
gccctgcctcccctcttcccccgccgccgctcgccgccggcgtccctcgtcccggtccggagcctccggtcccgcccccgcccccncccccgcctcctctcctccgcgcgcacnacccccgtcctcctccccgccgccgcgatggncgncccggaccccgcngcctcctctaanaggnacctgttcatcttctangncgaggagaacctcncggtggtcctggccaagtanacggcggatatttccgccaagttcgccagctagagaggggcgccntcaccgtcgtnctctccgggggatnccctcaattannccccttaaggaaagctgaanngaggncgccgtntttngangangtgtttgactgtanncaaagtgggcaatnttttcttgggtnaaacgaaa

SEQ ID NO: 99595 - DNA, 442 bp, Triticum aestivum
  unsure (1)..(442): unsure at all n locations
  Clone ID: PAT_TA_99595
gcgaggagtgaacaccaagactgcagctataactagctgcccgctcgctgctttgtggagccaaggctcttcttttcatgctctcgcgcctccccgggtatgatgaagcgacacagctctgccgccctgccgccgtcgacgggcggcgagatgcacgagcagaccacgggcaaggcggacaagtcatacaagcggcctagccgctgctcccgcctctgttccttcctcatcatcgccaccgccttctcgatgctggcatgccactgctacgactacgcccacggcggcgtcgcgcgcgtcgagcacggccgtgcgtcctcgcgacgcagcggcgggtcgccgttctccgaccctgccgtcccgcctcggcgtgacaaccggcgacctgaaggtttcggccgacaacgaaagcgcgcgcgctcgnccgcgggcggacgaaaag

SEQ ID NO: 99596 - DNA, 444 bp, Triticum aestivum
  unsure (1)..(444): unsure at all n locations
  Clone ID: PAT_TA_99596
gccccaatctcccaaccaatccaccaagcaaaccctagcccagccccgatggcccgcacgaagcagacggcgaggaagtccaccggcggcaaggccccgcggaagcagctggccaccaaggcggcgcgcaagtcggcgccggccaccggcggcgtcaagaagccgcaccgcttccgcccgggcaccgtggcgctccgggagatccgcaagtaccaagaagaagcacggagctgctcatccgcaagctgcccttccaacgcctcgtcagggaaatngcgcaagacttcaagaccgacctgaggttccaatcctccgccgtgtcngggctgcaagagggcgccgaggcctaactcgtgggcctctttcgaagaaaacaaacttctgggccatccaagccaagggggtcaacaataatgcccaaaggacatccaactccgcaaaggg

SEQ ID NO: 99597 - DNA, 446 bp, Triticum aestivum
  unsure (1)..(446): unsure at all n locations
  Clone ID: PAT_TA_99597
gctggngtcaatctggagcttgtggtacatgcagtanccactcaagttggttggttacactctgctcagtactacagctccactgtatctctacaagctgctagccactcaagtgagctgaagcacggccacagtttgttatctcatcaggttacaagacataggtgagtagtaagtgtatcattccgagaggcaagaatccaanatcttggatcaggggccaagacggaggcggtgccgtggggtgaagcaacctacctcacatgctgtgttgttgggaaccgagcttaacaagctgcgcttccaagaacacatcgtatcactaacctgggntgcgcttccccgatccatcaagcacaagttaccaacgtgctcacgcactgactgagntgactgatcgattccatccatcgagcaangcaggctacgccttttaatcgtttggg

SEQ ID NO: 99598 - DNA, 443 bp, Triticum aestivum
  unsure (1)..(443): unsure at all n locations
  Clone ID: PAT_TA_99598
gcagagctcgatcataagctagctagtcaggccaggcgggcgatcggacgatcgggctataatttcgactacggcgacgatggccggcgcgggcgtgacgacgacggggtcgccgtgcggggcgtgcaagttcctgcggcgccggtgcgcggcggagtgcgtgttcgcgccctacttctgcgccgaggacggcgcgtcgcagttcgcggccatccacaaggtgttcggggccagcaacgcggccaagctgctgcagcaggtggcccccggcgaccggagcgaggcggccgccacagtgacctacgaggcgcaggcccggctgcgcgaccccgtctacggctgcgtcgcccacatcttcgcgctgcagcagcaggttgtggcgctgcangcgcangtggngcacgccaggacgcaaggcgcagctgggggcgggcgacgggggn

SEQ ID NO: 99599 - DNA, 404 bp, Triticum aestivum
  unsure (1)..(404): unsure at all n locations
  Clone ID: PAT_TA_99599
gccaaagcgaaaccgacctttcccccttcccctccccctcncccctcccctcccgnagcagcctcgccgatatccaatccggctgccccccaactcncccaccggcggcgagngactcggcganagggagagagcgagggcggancnaggncgagcgggcggagccatggggcaacattcgctgatctacgcgttcgtggcccacggcactgtggtgcttgnngagtacaccganttcacnggaaatttcancagcatcgcctcncantgcctcctnaagctcccggncancaacaanaagttcacctanaacngngacggacacaccttcaactacctcgtcgnggacngtttcacatactgcntngtttgccgtttaatcatcggngcatcaagaatgccaa

SEQ ID NO: 99600 - DNA, 433 bp, Triticum aestivum
  unsure (1)..(433): unsure at all n locations
  Clone ID: PAT_TA_99600
gccttccccaccgcgtgncggctctctctcctcccctcccatatctcgcgcgacctagctggaacgccgcccccctccccctcccccggtggacggcggctcggcgccaccccccgctcgtcggagtttgattttaggtgaatataaaggagggctgaaatggctgaaaattgggtagaagaaggctcaaaaaatacttctgctccgacgtcgccccctanttgtcaaacctcttcgacaaagaagatnaagggaacgaaacatatttnaactaattaaagtnaacgagaggngtctcctcnaacaaaacancaaagctnaaaggnantggnataaacctcgacctngnggggtgggtanangtgagttttagatantcaagctaaagnttctnaaaaattatctantttccggggggnanatcaaaaatccc

SEQ ID NO: 99601 - DNA, 489 bp, Triticum aestivum
  unsure (1)..(489): unsure at all n locations
  Clone ID: PAT_TA_99601
ggaatcgaagccaaggctttctcgtcctccgagatgcaagatctttgtgaagaccctcaccggcaagaccatcacccttgaggtcgagtcctctgacacgatcgacaacgtcaaggcgaagatccaggacaaggagggcatccctccggaccagcaagcgcctcatctttgctggcaagcagcttgaggacggtcgcaccctcgctgantacaacatccaaaaggagtccaacctccanctggtgctcccgcctgcgtggtggaatgcanatnttcntcaaagaacctcaccggnaaagaacatcangctccgagggttgagtcctccggacaacaataaaacaacgtnaagggngaaagattcaaagaaaaaggangggaatnccccccgggacaannaaacgcctnaatcctttggctggggaaacnaacnttnaanggaacgggccgcnaccccttgctggnatanaaaattcccaanaagggnnt

SEQ ID NO: 99602 - DNA, 461 bp, Triticum aestivum
  unsure (1)..(461): unsure at all n locations
  Clone ID: PAT_TA_99602
gcctcgtgccgaattcggcacgaggctcggttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaaagttcgagaccaacaagtactactgcaccgtcatttgacgcccctggtcaaccgtgacttcatcaaagaacatgattactggtaactcccangctgattgtgctgtgctcancnattgactctaccactggtggtttttgnggctggtatctccaagggatnggcca

SEQ ID NO: 99603 - DNA, 503 bp, Triticum aestivum
  unsure (1)..(503): unsure at all n locations
  Clone ID: PAT_TA_99603
gcaactctgctcgatcttccccatggtcatggtgcctccatccatggggcctttctgccaccttccctgccccaccaccaccggcgtcctgctgcggtgcatcttcatctgcctgaccctccacgccgtccgcgcccagtccgccaccttcaccaagcaccgtgggcggcaaggagttcaccaccttctctttccccacgttcganaggtccctgatgcacctccccgccaacctgaccttcgccggcaactncaagcggtcaagccaagaacacgcctccaagatnaaccccgggacaagcaaacaagcccccaagcggggccccgancaaatttcctcggtcaaaccangaacgggcagcgtncttccctcctcctnccccggtttcgtcctggtggggcctnccgggcgcgggacgcccgggggggaaggntaagttcgccctccntntccaancnggggttcccgggttaaaacttntacgggggcaaaacgngaacna

SEQ ID NO: 99604 - DNA, 432 bp, Triticum aestivum
  unsure (1)..(432): unsure at all n locations
  Clone ID: PAT_TA_99604
ggaaaaagcatcgtctcgtcgaggaatcaacagccatgggcggcggcaacgcgcagaagtccaagatggcgagggagaggaacctcgagaagctgaagggcggcaagggtaacggagctaattcccccttctcttggtcgtcagatcttgttggtcttcctgatctgatcctgtcggtgtttttttcttctgatccttcgcagggagccagctcgaggccaacaagaaggccatgaacatccaggtgcgccgattaatcccgcctatccaatcgatcgaatcgatctaaccctccctaaccgaattggggaatttttttccgctgaccangactgttatccgttgaatttggttgnaattaacgccctttgactggggacgggatgcgtngcccccgtcanttngcaaaccnanantgggtnagcctntttc

SEQ ID NO: 99605 - DNA, 471 bp, Triticum aestivum
  unsure (1)..(471): unsure at all n locations
  Clone ID: PAT_TA_99605
ggtctccgccattgccctccctctcggatgcgtagtcccctcgccatcggccacctcccattgtcgcctccctctactgttggatgctcccctcggcccctctcaacgattcagtaactgtcgtcggtctcgcctcccgttccgccgcttccactgtgccacgccagaagcgatggtacaacttttgtgggcgaggccgcctgatgaagcgcgagggaggttggtgctggtcgtgggtgaagctaaccaaggcaggcacgtggcaggccggtgttggtcaccggaagaatgtggttgcgaggtggaggtcgggaggagttggggcaaggagcgcacatgtgcgacagganaaacgaatgccccaaggggcaacggcnggnggggggaaaataccccccaatgtgggggaattttgggcganaatggagcttccctgggtngttntttcaaagttaaaaggaagttccccgg

SEQ ID NO: 99606 - DNA, 481 bp, Triticum aestivum
  unsure (1)..(481): unsure at all n locations
  Clone ID: PAT_TA_99606
gcgagtttttttttttttttttttttttttttttttttgagaagcagtattttatattactatcaattgatggatcgatcctgcctccaacacttgaattcacagcgggagcaacgacaaacagaagagctgatgcaaactctaccaatgatctctactaaaagtggcaacattttagcaagcatccgaatcactgatcccattggctgggtggtcgcctccaaggtttcatcacttcggtcacttctctttcggattcagggggatcatcctctatnttaacattcacacgggnccccaccccganaattgccggcgttcccgtttcggcctnctcaaaattgtttccccanccaagatnangaaatncgagcaaaaacaatgcacgtacgttaangctacaaaaaaaaagcccgcctacgtggggttcnaaacatnttntaanacnccnccggngggttcaaagccaancggcgttcnn

SEQ ID NO: 99607 - DNA, 463 bp, Triticum aestivum
  unsure (1)..(463): unsure at all n locations
  Clone ID: PAT_TA_99607
gcgacgacttcgacggcagacatggtcggngcgggccgccgccgcgtggtgttcttcccgttccngttcctcgggcacttcaacccggtgctccgcctcncgggcgcgctgcacgcgcgcggcctcgcggtcaccgtgttccacaccgagcagcgggtgccggacccggccgactaccccgcggactaccgcttcntgtccgtccccgtggaggtgcccccagagctggcggcgtccgaggacatcgctaggatgggcatggccatgaacgacgccgccgaggcccccttcagggaccggctggccgcgctgctccccgatgaggaggcggaggacggcgggcgtcctctgcgttaatcaacgacgtcgtgttggtactcgggncaagcccttggcaaggagctccggcgtgccggggnctgggggaatnaatgaacggcaagggccgccaatttttcggctg

SEQ ID NO: 99608 - DNA, 398 bp, Triticum aestivum
  unsure (1)..(398): unsure at all n locations
  Clone ID: PAT_TA_99608
gtgcacctgcgtcccactgcaaatcctccaactccacttccttctcgtggcgtctctttccggccggcgtcccctagcccagcctacctcgctccaatcacaccaacagtcacctccaccgtgtctccatttcgccctggctaactcgctgctcgactcgccgccgcagctccctgccgccggnccttggggctctctgttcgccgtccangagcccgcgaagcctcggggtgtgtcgctggcgctgccgttcgctcccaaaaagatgccgacntaccggtacggnatgaaacgggacctggagatntggcacgaggngctcgggtgcganaacggtggngtncaaccaagccgcgggacgaagggcccttccagggcgtnggagcggnagaagaaat

SEQ ID NO: 99609 - DNA, 473 bp, Triticum aestivum
  unsure (1)..(473): unsure at all n locations
  Clone ID: PAT_TA_99609
gtagctttctcgaccccccaagaaaaaggagcaaccaagatctcatactanatctgttgatgggagctagctggtttcattagctgcaatttcatggcgcataagatccatggcaccgtggtgaagctagctgggcaagaagtcaactaaccaagaaagcttgctagccgcccttgggactacacagggaagaagaagaccagatcaagcaagctgtaccacatagagttaggttaggtggagagatggccaacangtggtggggaccaagggcggctgacggaggcgccgggaanctgcatcangnctcnccagcgancaaaacccggcaacaattgggnggacgccaaggcngtgcccaaggttaaccnggggaagagcanncacaancggccggagggaagcgggcaaggnccaccnagcnccnagcccaaaggganggcnccggtngtggttcccggccaaacccgccc

SEQ ID NO: 99610 - DNA, 214 bp, Triticum aestivum
  unsure (1)..(214): unsure at all n locations
  Clone ID: PAT_TA_99610
ggcacgaaattccccattgctagggtttcccagcggagatcgtgtggaggcagagaaaggaagacgagcgcggggaacggtaaatcagaaggcggccgccgcggcctcggtggcgctgcttgggtcactgaagatggggaaagngggggaggggagaagaagcgaancangggcngtcccggtcgncngnaagtttcnnggattgnccacnccc

SEQ ID NO: 99611 - DNA, 366 bp, Triticum aestivum
  unsure (1)..(366): unsure at all n locations
  Clone ID: PAT_TA_99611
gntttctcgtccgcctccaanatgcatatctttgngaagaccctcaccggcaagaccatcacccttgaggtcgagtcctctgacacgattgacaatgtcaaggcgaagatccaggacaaggagggcatccctccggnccagcancgcctcatcttcgctggcaancancttgaggacggtcgcaccctcgctgactacaacatccagaaggagtccaccctccacctggtgctccgcctcaggggtggtntgcagatctttgtcaanaccctcaccggnaatnaccatcancttgggggttgagtcatccnacaccattgncaacggtganggcaaagatccaaggacannggagggcagccctcc

SEQ ID NO: 99612 - DNA, 463 bp, Triticum aestivum
  unsure (1)..(463): unsure at all n locations
  Clone ID: PAT_TA_99612
gcncntcttcttctctagcnagcgagcaagctacgcttggnggtnaccgaaaatgccgggtcagcaggatcgccgtggggagccaccgtgaggtgtacnangtgggcnccctcaaggcggcgctcgccganttcatctccacgctcatcttcgtcttcgccggccagggctccggaatggccttcagcaagctganaccncnaccgtgnngtgaccccggccggnctgatctctgnggagatancncacgcnttcgcgntgttcgtgnaggtntccgtgggcgccaacatcnccggccggggcaacgtganacccgnncgttaaccttcaggngncttcntgggccggcaacatcaacctncnttccacnggccttgntctactggggntcggcccaagcttcctggggntccnaaccgccgacatgntttcctcctccggccttctcccaccggggggggnt

SEQ ID NO: 99613 - DNA, 435 bp, Triticum aestivum
  Clone ID: PAT_TA_99613
gcaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaacaaatctctccggcttgctgc

SEQ ID NO: 99614 - DNA, 206 bp, Triticum aestivum
  unsure (1)..(206): unsure at all n locations
  Clone ID: PAT_TA_99614
gcgccccctcgcctccccccanggccgccggcctaccgccgggcagcgccgcccctcgccgctgctggcgtctcgtcncgggctcctgcttctgctgctcatctcgcggccggctcatgctttcngtttcnacngtgntcacccncctttngggattcnatgggtcgctccccttccanctcnanaccgtgtnnttttggcnttgt

SEQ ID NO: 99615 - DNA, 238 bp, Triticum aestivum
  unsure (1)..(238): unsure at all n locations
  Clone ID: PAT_TA_99615
angactatanagttcccacttannagttagaacaagtcgcaacacagcacgccccaacaaccccaccgcccaagaacacnccacaggaaagagaaaaatctccggcccgtcctgtcctaatcgcaccggtgaagaacgcgggcgggctanctagctagctccggcgaggncgganacgggagacgcccatngtntacangaggtcatcccatgtggaggaggaccantttctggtttt

SEQ ID NO: 99616 - DNA, 453 bp, Triticum aestivum
  unsure (1)..(453): unsure at all n locations
  Clone ID: PAT_TA_99616
gcgaaatccacccaagccgccgagctcgtctcgtcgtcgtcgcgctctaggcttttgggatggaggccganacggcggcgaaaagggcgcggganancgangtccctgcggcggcggacggggccggtgagcaagcggggatntcngncgtcatccccggatggttctccnagattaaccccatgtggnccggngaagngcactcnctcaaagnggngaaagtnctgtttcaaagnaaattcggctaacaaaaagttgtgggttttcaatcctccanctaacggaaaggggtcctncttgattggggnattcaaagtnaaccggnaaggaacaattgcccctaacaaganaatgtttaccaacttcctntctggttnaattaaaanttccaaaaaaggccttgtccancgggggggggganngggggggtttttncggggagggtccaaggaa

SEQ ID NO: 99617 - DNA, 459 bp, Triticum aestivum
  unsure (1)..(459): unsure at all n locations
  Clone ID: PAT_TA_99617
gcctcccgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccaagcacgctcacgatcgtcgacagcgggattggcatgaccaagtcgggcctcgtcaaaaacctcgggaacatcgccaagtcggggaccaagggagttcaagggaggnactcnctgccgggcgcttgacgtgtccaatgattgggggcanttcngtggttgggntctactccgcctaactcgtngn

SEQ ID NO: 99618 - DNA, 473 bp, Triticum aestivum
  unsure (1)..(473): unsure at all n locations
  Clone ID: PAT_TA_99618
gaaaccggatagaaagtcgaccactcgagcatcatcattcattcatctcattctctgtatcccatcctagacacattctcacaatgcctgccaaaatcccctcccactaccccctagaccacgaggtcaacgatgccgaatctggctatgcaagtgcttcgtcgagtgaagctagcctgccagaggtcgtcttcaccaaggcccacctccaattcctgaaccgtcagttgcaatttcttgagcctcaagatgtcttgagatggtgcatcaccactcttcccaacctgtatcaagacaactgccttcggactcactgggttagccatcaccgacatgctctcgaagctcgatgtgccccgtccacaagtaagtcgacctcatctttttgggatactcttcatcactttaaaaagaagactcnttctccttgtggaccgtgtcggcaaacgctaaccccaaccntaanggtccaa

SEQ ID NO: 99619 - DNA, 455 bp, Triticum aestivum
  unsure (1)..(455): unsure at all n locations
  Clone ID: PAT_TA_99619
gctaaccctaaccgccgccantgcaccggngcctcccccgccccactgactggcttcctanggctgccctccgcccgcttcttcaccggcgcgttggtcgcgaccccgccaccccgccaccctcgccagcgctggtccctgcacggacggcacgaacgccgccgccccgtacaagatactgcaccgactccgcagcccgtcctcgtcctaagggcaaaccccaaccccgcggntcccgctttcttaacactctcgccgtcccgccgccgggaaccaagcatnacgacgcgtatcgcgcccggcgtgggccgcgaacctcctngggcaacaatcggggggagcggaancaaggacgccaacanctaacngtcgggaacctncaaccgcaagtttccgagggaaantactgtggggaattngttttttcaaaacaaggccctngttgnttaaagtgc

SEQ ID NO: 99620 - DNA, 460 bp, Triticum aestivum
  unsure (1)..(460): unsure at all n locations
  Clone ID: PAT_TA_99620
gccacccgccgcggcagcatccattcgcctagtcatgcagatgcagatcatcaccctccgcgccagcccctccgcccaccgcctcgtgccgccgctggcgtcggccagctcctcgaacctctccgccggccgatgcttcctcctgcggccttcccactcccgctgccggcggccccgctccctcagggccccaagcttcccttgagcaggaggtcaaggagcgcgccgactccccgtctccgtctgcaggggcgagtagtcaagcaactaaaagagatgtgagaaatattgcaattgttgctcaagttgatcatgggaagacaactttggtgggattcaatgttaagacaatccaaggttttccgagacaatcaagttgtgcaagaaaaggataatggactctaatgatttgggggaagggaaaaanggattnctatactggggcaaaaatacatcnatt

SEQ ID NO: 99621 - DNA, 481 bp, Triticum aestivum
  unsure (1)..(481): unsure at all n locations
  Clone ID: PAT_TA_99621
gctcgccgagaaatctcctccgatcgaagcgaagccaaggctctctcgtccccctcctcaagatgcagatctttgtgaagaccctcaccggcaagaccatcacccttgaggtcgagtcctccgacaccatcgacaacgtcaaggctaagatccaggacaaggagggcatccctccggaccagcaagcgcttgatcttcgctggcaagcagctcgaggatggccgcaccctggcagactacaacatccagaaggagtccacccttcacctgggtgctcaggctccgtggtggcatgcagatatttgtgaagacactcaccgggcaagaccatcaccctgggaggtnngagtccctcggacaaccatccgacaacgtcaagggctaaagatncaaggacaaagggaggggcatcccctccgggaccaagcaagcgtctcatctttgctggcaangcagctcgaaggatggccgcaacccttgn

SEQ ID NO: 99622 - DNA, 372 bp, Triticum aestivum
  unsure (1)..(372): unsure at all n locations
  Clone ID: PAT_TA_99622
gggaaaggaaggaaggaaagatggcnaantggacatcatcgcccgtcgccgccaccgccgccgccgcctcccaggcccagctcggcttctcggccgcccgcccggcgcaggcgcggcaggccgccgtcctgccgcctctcgcccgcaggttccccggctcctccctcctcgccgtcaacgcccccgccccctccccctcntggaggcnccatgccctcnccaccgaggtntagggcctcnccatcagaaaggacctcactcttactnatantnaagtnccccaccncaantgtcancnggatttggnnaaggttttctcnccaacgttnccctnaanggttggnaantattgccccncttctnttcttgtta

SEQ ID NO: 99623 - DNA, 477 bp, Triticum aestivum
  unsure (1)..(477): unsure at all n locations
  Clone ID: PAT_TA_99623
ggtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcaagcaaggtcgggttcatcttccgtgagcacaatgcgtctcccgggtactacgacggccgctactgggacaatgtggaagctgcctaatgttcggggtgcaccgacgccacacaagtgattaaacgaaggtggaggagggncaagaagggagtacccctgacgcgtacgtcccgcatcatccggattccgacaacatgcgccaaaggnggaantgcgtcagcttcaatggccttcaaagccancggggctgccgaaggagtn

SEQ ID NO: 99624 - DNA, 463 bp, Triticum aestivum
  unsure (1)..(463): unsure at all n locations
  Clone ID: PAT_TA_99624
ggtagcagcaacctcaaaattccgacaaaaaacttgtaatcagaaacaaacatggcgcccaccgagtacgctattccccgtggaagcttgatcttagtcaccggcgccaatgggtatatcggatcacacgttgtcgaccagctccttgcgctgggttataaagttcggggcaccgtgagagacaagaagccatggctggatgcattctttgaacagaaatatggcaaggacaagtttgagagtgttgctgttccagcgatagaagctgctggggcctttaccaacgttgcaagaaggggctagtggtgtcgttcacgtggcttcggatgtctcttttgggactcgatcccaatgtcgtcattccgattgcaagtacaaggcacgcttaatgttctcgaaggaagctgccaaacaangcttccataacacgttttgtcattacgtcgtccttcgctacgttaca

SEQ ID NO: 99625 - DNA, 471 bp, Triticum aestivum
  unsure (1)..(471): unsure at all n locations
  Clone ID: PAT_TA_99625
gcaacactgtgcgcatgtcttggcgcctgcgacggatgaagctgactctccagcacaggcgtcctctttcacgcactgcagcctgcccatagtcgacggccccattgtcgcgacgtcaccaccatcaccaccctcaccggccgaccacaccgaaggaacatcgcttcacccagttgccctcttgcgcatatagtctcgctttggcctagtacagcgacatagcatcccaggcccgtttgcacgctgctgtctaatcaacgccacaacaccctcgccgcggtgctcccgtccgacgcgccttgaatgagccaaatcctgtatccctcgagccaaactgacactgggtataacatgcaggcatcgggccgctcaaggatcaattccaagccngaccatagagatgaagcttaagagaacatctgctccgctgccggggcttggacaagccagcggtgcaacctctcccccaat

SEQ ID NO: 99626 - DNA, 474 bp, Triticum aestivum
  unsure (1)..(474): unsure at all n locations
  Clone ID: PAT_TA_99626
gaaaacacttacactgctattactgagtaatagctttgaatcatggatttcctcaagaagaagatgaaggagctcatggacgacgacgacaagaagccagctgaatctcagagtgccccttcccatgactcgtatggtggagccccaggtggtgctggtcctggagatcgcgcgctgtctgattcgtactacggacacggcggcccgccccaagatcagggccagggctacccgcctcaaggttacccgcctcagggtccgcctcagggccaaggatatcctccccaaggccaaggctacccgcctcagggctaccctccacaagcaagcaagtacggtcaaggtgcgccgccccaagtaggtccaccaagcgccctacggagcgcctccacccaatgccgcctggctggacgcaacaatggggaccaagaacaagncaacgttggttctaacatttgagcaaagccactgggc

SEQ ID NO: 99627 - DNA, 534 bp, Triticum aestivum
  unsure (1)..(534): unsure at all n locations
  Clone ID: PAT_TA_99627
gccgctcccctcctcctccttgacccgccgccacctctcctcaccgggaagaaaaccctagctagagagcttcaaagtttcccgcagcacgagagatggcggcgaagggcgatgggccggccatcggcatcgacctcggcacgacctactcgtgcgtcggcgtgtggcagcacgacagggtcgagatnatcgccaatgaccaaggcaaccgcaccacgccgtcgtacgtggncttcaccgactccgagcgcctcatcgggngacgccgccaaaaaccangtgggcatgaaccccatnaanancgttttcgatggcaancgtctcaatgggcgnanattcactgattctactgtccaanagtgatattaanctgttggccctcaaaggtttttgctggacctggtggacaaacccatgattaatgtccaattcaaaggtgagggggaaacaattntaacttgggggaaatcctctctnggccccaacaaaaatgcgtgggaatgngggagcntttccttggaacaattggaaaan

SEQ ID NO: 99628 - DNA, 457 bp, Triticum aestivum
  unsure (1)..(457): unsure at all n locations
  Clone ID: PAT_TA_99628
gagatatcgcaatcatcacactttgctgcatcacattcttcagcgcaattgtcctcgattggcaatttggaatcaattgtcccatgatgacgcggtgtgactacatgttcgatgacacgattaaagaaaaagtatgcatattgggctgtaaagttcgacaagcagtgggtctagacatgaaatattacgtcgatagagccaatgatctggcagttaaaaataatccaccatatttccggtatttgaatggtgcgagtacgttcgtgttgctgccattaagaattgttgctgtctatggcttgattaagcgtaaagaatggcgcattcctggcattctttttgcggcgcttcatttggatcacgccagtttgtatttattcgacgtgttcaaccaaaatcagcaangccgaccgatcctaagttgattataggagccnantcaatggtggatgaatcc

SEQ ID NO: 99629 - DNA, 463 bp, Triticum aestivum
  unsure (1)..(463): unsure at all n locations
  Clone ID: PAT_TA_99629
ccacaacatcacagcgaataacagactaccccagactccgacttgcccatcatcgccgctaccacaaaccatcaattacatcatnaccttcccggcttctacccacgctcggatcaccttccctcgattggccgctgctttaagcctctcaccacagactactgccctatacataacaaacatcatgccttcctcatcgcatctccgcatacaaacctccttcgagcccttcaccgccgagaccacccgctcccactttgtctcttcaccaccgcaaaagaagcagaagatgtctctcacccaaacctactacattgctgcctccgcccgctccaagctcggcaaagaggcatgcanggccgaccacgacctccgccttctcgttggacacgcaaacctcctncgacagcctcatggtcgagctccaagaacgccggaacggccagcaangaacatgggttaa

SEQ ID NO: 99630 - DNA, 252 bp, Triticum aestivum
  unsure (1)..(252): unsure at all n locations
  Clone ID: PAT_TA_99630
gccccgccgcctctgaccccgccccgccgggncgncnccggnatctcgaccgngagatgcngatgccgccgccgccgncccctcccncgcantccacggcgtggtcatcatcaccctcccgccccccgaccaagccctccaagggcaagaccatcaccgccttcacctacaccgacgagccgggcgccggngctcnggccccnccgntgaatnggggacctcnnatggctaccgcggggaggggaggtcatg

SEQ ID NO: 99631 - DNA, 474 bp, Triticum aestivum
  unsure (1)..(474): unsure at all n locations
  Clone ID: PAT_TA_99631
ggctanctaagcttgaacgagggagaccaaggccgagcanacaccggcgggatcccaactgaatcgtgaggggaggcggcggatggcgccctcgttgctcgtctcggcgagccaaatcctcgccgttgccggccggggaggccgtaagcggcgtctggtcatcgccaactccggcggtgccggcactcccccgaagctggtgactttcctcggcaagggaagctccggcaagaacacggggggggcgccatcgctggctcaaatattatgcaaagttaangncctgaaaaaatgcctgggttttaaaaatccgcaaagaacccgacaagcaanaancaatttgatggggcttgtnannatttggaaactccncccaactgaaatgtngctggctaaaccttncaaccaanaaagctccaaaacaanttaaattgctaactttagccccttnaccggtttaaaaaaaantaaatt

SEQ ID NO: 99632 - DNA, 481 bp, Triticum aestivum
  unsure (1)..(481): unsure at all n locations
  Clone ID: PAT_TA_99632
gatctcctcagcctcgcatcgcaatacccatagttaatactcctcgctcccgcacatcatccgacacctttgctgcaccccgcatcctcaccaaaccacctctccaagctatacccctttgtatcgcttttgttgtggtcgagctccctggaatcccacacaacccagcccctcacccaaccaatatctgaaccaccatcgaccaacaacaccgtaatcatgtcgcagttcttcaattacggtgcccagcagcaccacccgcaacacctcaaacgcccatacccacaaaccaaccaacggcggnccgattaaanggaggggcgcccccgggattttggggtcaagcaaggnaaaaacaaaggcaagtttccggccaaagttccggcaaccccccaaagggaggttcaaanttcgaagccccccaacgctcaatcgcaataaaagcgnagancttcganggcggcaaagggtaanttngana

SEQ ID NO: 99633 - DNA, 457 bp, Triticum aestivum
  unsure (1)..(457): unsure at all n locations
  Clone ID: PAT_TA_99633
gagccaaaggcactttgcgaggtattcagccttgcctcacagacgcctagagcccgcagctcttttcgtttttttcttctatcaccttgtttcgtgcacgcaaagcaccctcgacgaccgcccgcacccctcaagcctcgctcctcgccaatatcgatataatccgtcgctggccctcgtgagccagaactcctctccgcagccatgggtcagaccctctcggngcccgtcgtcgaaaagacttccgaaaaaggngaggatgaccgactcctcttcggtgtctcggccatgcaaggctggcgcattagcatgngaggatgcncacacggctgaactgaagctaccgnacccggataacgataccaagacgcaaccccgacaaggctggcctttttcgggagtctatgacgggacaactggngggangacaaanntcccattgtttcccaggnnaaan

SEQ ID NO: 99634 - DNA, 458 bp, Triticum aestivum
  unsure (1)..(458): unsure at all n locations
  Clone ID: PAT_TA_99634
gcgcaccctactttcttgcactcgcccaattgactccgactgccttacaatcgcttccattcatattcagcaccctactttcgtttcgtcgccatgtgcggtatcttcggctacatcaactaccttgtggagaaggacaggaagtacattctcgacacactcatcaatggtctgcaacgtctagagtaccgtggttacgactcggccggtcttgccattgacggcgacaagaagaatgaggtctacgccgtcaaggaggtcggcaaggtcgcctcgctaaagaagctcgtcgaggagcanaacttcgacctcaacaaggtcttcgactcgcaacgccgggtatcgcccanaacccgatggggcaaccaacggtcccccaatcggcgtgttcaactggcatccccaaaaggtccggancccaactggggagntcctccgttcgtccaaaaatgggtatn

SEQ ID NO: 99635 - DNA, 367 bp, Triticum aestivum
  unsure (1)..(367): unsure at all n locations
  Clone ID: PAT_TA_99635
gcagccccgctccgctaaacctcgcaacaacccccgtgggcgancaacccagcccagccgcccccctctcctcaccaacccccgaggccggaagcagagccgcgatggccggnaccgtgcccannctcgcctccccgaggccggcggccgcggggncgctcccctcgcagccccctccgtgccgncgcgctcgccttcgtcacctnccgcccgacgcttcngcgtctccctcgccggccgcgccaggagcccccnttanttgcnatnggtttccggccaanggaaatgggaaccggngtggggtgancaaaataantanaacgctccaannnaccctcctaatnagcnaccaaggttnaagtnnccc

SEQ ID NO: 99636 - DNA, 378 bp, Triticum aestivum
  unsure (1)..(378): unsure at all n locations
  Clone ID: PAT_TA_99636
ggcgaggcaaccaacaccgcacggtccgcaccacagcgctcagcactatcgcctcgccagccgccaccaccgcaacgcaaaagccagcgctagcgtccgaccaccgcaagtcccaacccaacaaaaggtcgttgttgttcgtagagggagctcgatccgcagccatggtgtcgtccccgtccccttcccctcctaccttcacatccgcggtgtccgagaccaagcggcatgctggtgcccccgacgacggcctccgagaagctgggnccaaaagtacgcccactccgcgacgccgctccacgggcacgggggggccaaagaaaacgccgcggcggggggaggancaanggcggggtcccccggattcgggncngcgtt

SEQ ID NO: 99637 - DNA, 457 bp, Triticum aestivum
  unsure (1)..(457): unsure at all n locations
  Clone ID: PAT_TA_99637
gctcgccaccacttcccctacccgagcccaatccctccccctccgccgcgccgcgccgtggcgtagcccagcccanactcncggccgccgccggcgccccatctcaagcattgggtttttgacgggtaaaggcgcgaccttttagcgctccggcgccgtccagtccagatccgccgcgccatggcggaggcggagtcggcggacggcggcagctggcangagatgatgaggcgggatcctgncccccggngnccccggtcccggaggaggcgcccaacctcnactactccaatcgccgctcgttgtangaacgggcccgccgngttgcccctaacgaacctccccccggggtggacccggtngggagattccccgccggngattcccaacgggcgggtcccggnttcggggccccccaaganccccccgggggggggggggaanaanggggttcccc

SEQ ID NO: 99638 - DNA, 473 bp, Triticum aestivum
  unsure (1)..(473): unsure at all n locations
  Clone ID: PAT_TA_99638
ggcggtagcggcggcgcctctctcgcgacctggacctctagcagcggagccatccgtgccttgccagctcactttgtagtctctaggcgagctgccatcagaggttcgctctgctttttcacactctcttacgcggggtctcgcgtcctgatctgtttatctcaatcgatcaccttcgccccccccccctcttgtaacgccaaatatgagtgccgttgttcgttgtgggtgcctggcgatcagtcaaggcggggggaacttcttttcgtactggattggggangttccccccaaaaatcaaaaatggcntggttttcaaatcctgtggcaactccccgaatggggcaactccttcaaataactggatttggtggcaaaaaaattttcctggattaatggtcaccnttgcnaaaanaatnaaatgtttgtngaacgaaagtccaangggtttggngnanctttaactttgggtt

SEQ ID NO: 99639 - DNA, 345 bp, Triticum aestivum
  unsure (1)..(345): unsure at all n locations
  Clone ID: PAT_TA_99639
gcttccacttcccctagctttgatagaaaacaaagaaagaaaaccgagaagctctcaccatggcaaccaatgggtactccaatggcggcagcaccaagggaaagcccatcaagtgcaaagcggcggtggcgtggggtcccggcgagccgctggtgatgcaggaggtggaggtggcgccgccggcgcgcatggaggtgcgcgtcaaggtcctctacacttccatctgccacacgggacctcancttctggggaaggagagaaacgaagcgtcaacgcaaggttcccctccgcnatcttttgggacancnaaggcaacccgggagttggtgggaaaagcgttccgaa

SEQ ID NO: 99640 - DNA, 466 bp, Triticum aestivum
  unsure (1)..(466): unsure at all n locations
  Clone ID: PAT_TA_99640
cgacggcgggaggagcagggagctggagaggctgcgggcggagagggacgagctagacgcccgcatacggctgctagagtcggagctcgaggccggctccgccgctccggtctcacccggggcgggggtgggagacggcgggtgcgtcggcggtggcggtgcgtgccaggcgcgccctgggctcgcggatgccgattccctcccggccgacatgatctaccggtacagccgccacctcctcctcccggacttcggggtcgaaggccanaagaagctctcccggtcatcgattctggtggtcggcgccgggggactgggctcgcccgttggcgctgtatctaacanctttgcggtgttggggtcttgggcaatgtcnatggtgatgatgttgaacttaacaaacttcatccgacagatnatccaacaaagaaagcttaanatttgggaagattcnaaagttgaannn

SEQ ID NO: 99641 - DNA, 372 bp, Triticum aestivum
  unsure (1)..(372): unsure at all n locations
  Clone ID: PAT_TA_99641
ggacgcacagatccctccctctcctctgcacatctctcctccctcccccacgacgcggcaaaaacagggaggaganagagcgagagagggagcccgagcccnaatctctgcgatnccccctcccggtctgaggatcnggcgatcagccatgaacganaangcctccgtctccaatgagctcatcgccaggcanatgatgatattgnaaaggcnttcctgcggttgccngntaaanacagaatgtgtacantgcangntcaanggggtccctcgatgggcaaagtntcaatntttggggatttttccgttntgcaatgnaagtgtttctgggtatttcantanaaanccctttggggggtntaataataatca

SEQ ID NO: 99642 - DNA, 459 bp, Triticum aestivum
  unsure (1)..(459): unsure at all n locations
  Clone ID: PAT_TA_99642
gcttggcagcttcctcgcgcagtccctccctcctcatcctctcaccccacgtctcacctcacgcgcctcgcatcccattcccttttccagcccccctcgctgcgtctgcgtctgcgtctgctggcaagagacacagcaccacgccgcggccgccccacccacccgccagccaagccaagccctcacaaagacttgacctgttcctgcgaccgcctcggcctcttccgcctccancgcctcttccgcgatncccttccgcccgccgtcttccgtccggaagccccagcaccgggcttccccctgctggttaccgctctcctctccggtcgatnggtcggggggangtcccggngccgtcgcgggttctggtnctccggaacaaaagatnatnattctnaggggaactcctaacgtgacaatgggtctgccaacaagaatttggatttccntcccnaaggg

SEQ ID NO: 99643 - DNA, 448 bp, Triticum aestivum
  unsure (1)..(448): unsure at all n locations
  Clone ID: PAT_TA_99643
gcctcctcctgctcctcctctcttcttgacacctcagatctcattacaatggtcagcgcctccagcctgctgctgctgccgtcctccgtgcgggacctcgcctcctgcgtcgtcgccgacgtcgccgcctgcaccaccccctcctccaccctcacctcccccgcctccccctccacgctctccgtcaccgtcttctaccgcgccgccgcgctcctgcccgggcagagctcccccgcgcacctgcggctcacctggacccgctccccgctcggccccacgctctccttctccccctccgcctccaaccccgccgtggtcctccgcaggcgcaagggcacgcagtccgtccccgtcgacgaagccgcacgggcacagctcgtcgtgttctgggaactcaacgccggcgcgctaagaacgcctccccgggaggcgnactccngntaataag

SEQ ID NO: 99644 - DNA, 442 bp, Triticum aestivum
  unsure (1)..(442): unsure at all n locations
  Clone ID: PAT_TA_99644
gcagcttcctctcctccaccacggccgacggatgccgacgcctcctgccgccggccggagcctcgtcctccactgttgctgctgcctgatcttgcttgtcctcctccccgcctgccacgccttcccgctctgcaccgaccacagggcgccgctgccgctcaacgggacgctcgccttctgcggcaacgccggcgccggggccagctgctgcgacgccgccgccgacaaggccctgcgggaccaagctccaagccgccaacgtctccgacgccgcctgcgccgccgtcctcaagtccctcctctgcgcgaaatgcaatccctaatcgggttgagntgttcgacgccgggccgaagctccgaaaaatccctttcctgtgcaaatccgcctcctcggggaactntggtcaacantccaaggaatcaaaaagtaaaggctaatgnn

SEQ ID NO: 99645 - DNA, 474 bp, Triticum aestivum
  unsure (1)..(474): unsure at all n locations
  Clone ID: PAT_TA_99645
cccgaccgccgccgccgcctcctcgtcctctcggtcccctctccttccttcgagtttgcttcagccatgggtaaggagaagactcacatcaacatcgtggtcattggccacgtcgactctggcaagtcgacgaccactggccacctgatctacaagcttggaggcattgacaagcgtgtgatcgagaggttcgagaaggaagccgctgaaatgaacaagaggtctttcaagtacgcctgggtgcttgacaagctcaaggccgagcgtgagagaggtatcaccatcgatattgccctctgggaaagttttgagacaaacaagtactaactgcagcgtcaatttgatggcccctggtcacccgtggacttcaattaaagaacatgattaaccggtacctcccaagctngactgtgcngttctcaatcatcnactccaacnactgggtgggttttgaggctggtaatctccaaangg

SEQ ID NO: 99646 - DNA, 446 bp, Triticum aestivum
  unsure (1)..(446): unsure at all n locations
  Clone ID: PAT_TA_99646
ggagctcatgggcctcaaaaccgccgtctttctctccgtccccgccgccgtcgcgccgctacctactacactccgccgccaccacctctactcctcctccaggggcagcagggcggccgcctcccgaatttcagcagcggtgatggccacggcggtgcagccggcggtggtggtgggcggcggccgggtcggccaggcgctgctctccatgggcccgcccgccggcggggacctcctgctccgccgcggcgaggcgctcccgcccgccgcgccggccgggcccatcctcgtctgcacccgcaacgacgacctcgacggngtgctcgacgccaaccccaaatcccggtgggctgacctcgtcttcttccaaaaaggggatgctggaccccgtgggtggagaagcaagggcctgggccggggccaaacaagtgctccgctaatttccg

SEQ ID NO: 99647 - DNA, 439 bp, Triticum aestivum
  unsure (1)..(439): unsure at all n locations
  Clone ID: PAT_TA_99647
gcagagccgaaatgaggcgccccctccccctactcctctcctgacaaacctctcccccctcccctccccttggttcgtccgcccgtctcggactccacggccgccccgccccgccccgccgccccaccggtgcaggggaggatggatttgtccaggttcgcgtctccgcgccccccgggcctgcagatcggcgccgccgcctccctccggggggcctgctcgctgcgccgaccccggnacanaggcggantccacggcggncggggcgggaacctcatggtcgcctcggccctccgcggggtcaaagcaagcggnctcttctacgccgccccggaaccaagcccgtctccggggtcaaacggaacgggtcggcgccgcttgcaaggcaaacaatccctnccctaagtngacggcccctgggnggggaacaaaggcaaca

SEQ ID NO: 99648 - DNA, 448 bp, Triticum aestivum
  unsure (1)..(448): unsure at all n locations
  Clone ID: PAT_TA_99648
gcttgctctgtcactccaagcctcgcgttcccagtcacgacacacgacggtgaaaccaattatctccgatctctaagaccgaaaaccaagagcaatcccgtttgcaaatggcgacccccgcgatcgcgctgcttgatcagagcctgccgttcggcggcggcggctcggaccggctcagcaaggagatcttctccatcctcgagtccaacttcctgttcggcgcgcaggcgctggagccggccggggcgtgctcggcgggccgcgtgcgcgtgctctccatcgacgggggcgcggacggcggcgcgctcgccgcggncgcgctggtcaggctcnagcgccgggtgcaagagctgttgggcaaccccgaaggccgcgtcgcgggactacttcgacgttgcnggccgggtccgggcgccggngggttnctccccggccgccctgttccccg

SEQ ID NO: 99649 - DNA, 446 bp, Triticum aestivum
  unsure (1)..(446): unsure at all n locations
  Clone ID: PAT_TA_99649
gcggccaggccgtccccgccgtgcccgccctcgtatatacgcagctgaggtgaacccagcgccgctgagctccccgcccgcgcgcgcattgcacggactgatctatcttccaccgcccccggccggccgcccgaccacaccgacttggcagaagcagcaatcctgccgggccggggatcaatctctggtgtatctttggggttgggacggaaggcgacccggccaagaggtcgaggagccaccgtgccggagcgagctgccaccggccgcgtgaggcgtcgtcgatcgaacangcatttcgatattcttgagcttaactgcgcnttgcatggagaaattgccgtncctgctgccgatngaatncaacaactgggattgctcctgggaantaaactaatctgaactggnccgccggggaanaacttgctgttccctccaatggttcn

SEQ ID NO: 99650 - DNA, 456 bp, Triticum aestivum
  unsure (1)..(456): unsure at all n locations
  Clone ID: PAT_TA_99650
gccaccaccaacactgacgatgacatgacctgccctccggccttactttcgtttccactttcacttttcgactagcgatgcgataataccctggccccatcttcactctcgttcactacccgcacatcatgcatttctcgccctcacgccttgtcataggcatcgccgtctttgttgccgtgagcttcttctacacaataaactcgatatcaagcacgcgaccctacatccgtcttcttcaacccacgaaaaggctatgccccccgctactccgccattanacgacagcaagccgagtccttcatttcgtcctacaatccccgcaaatgtgaccaagggctgggtggtgagaaagcaagcgaaaaactaatngcgtggggcaataccttcaataacaagcggggacnggggctcaataacctggcaaaaangccgtggggctncntttgctgggac

SEQ ID NO: 99651 - DNA, 451 bp, Triticum aestivum
  unsure (1)..(451): unsure at all n locations
  Clone ID: PAT_TA_99651
gactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcangtgcctcaaagagcctcgccaacagcatcaagtccatcaacaatgggcaaaggtctccggcgtgcccgggaagttcggggtcaagcgttcccttccccatcaacaattccaacaacttgcaacaaatgtcnactagttcaatntt

SEQ ID NO: 99652 - DNA, 447 bp, Triticum aestivum
  unsure (1)..(447): unsure at all n locations
  Clone ID: PAT_TA_99652
gagcctcgctcggcctaggtttctcgatcgagctagggatcgagatcagacgacccgtgcacgcctcgagcaagcaagccagcctcgctcggcctaggtttctcgatcctcccgccgccgtcgtcatcctcgtcgttgctgtcctcgtcggtggccggcaatgcagaggggcaggtcgtggttcggctgtgtgcccatgagcacggcggcgctgcccgtggagagggattttgatcttcctgcggtgaagccgtcgtggncctcgtccgcctcagatggaggattcgcanagggcagcatcgacctgggaagnatggaggtgcgccaagtcaccaacttcgccaaggtctggtccancaacgcaagggcgggcaagacgggctcgggggcaacttcttcaagccgggngcctgtcccgggcgggantccaacgcgctcgggacaatt

SEQ ID NO: 99653 - DNA, 443 bp, Triticum aestivum
  unsure (1)..(443): unsure at all n locations
  Clone ID: PAT_TA_99653
gccgcctccttcctccgccctctcctccctcccaaacctttcctctccactcccaaaccacaagtccctatcaccccnatcantgacgtacgctgcaccgcggcgcccaaaccgaccaccttcaccccaaagcccgcccagcaagagcgcaaccaggacgaggagcaagaacccactcccgacgaggccgacgccaacccccaccgcatccccgacgacgagaccccgccgtcggcgacggcgaccacctccttctcggtgngtccggcgcgttgcccgtcggtcatctcgacggncgggacgcctccgcccggacggcgctgacgcaagangagccgcccaacttcgaagatcgggtgggaagcggcaccaaanaatctcnccctggggaaaggcaagggggtggggccatcngacgnaanttctgggggnaanttgggggg

SEQ ID NO: 99654 - DNA, 444 bp, Triticum aestivum
  unsure (1)..(444): unsure at all n locations
  Clone ID: PAT_TA_99654
gcaaagtcccccttcaaacccgctgagcttgcaatggagagcagcggcatcattgcgacatgtgctccccaatgattgatcctctcattcccatctaagctagatcttcttgaatcttgagaccaccacagcctcatccccagtcgtgctcgtgcgcccttgctcccatccgctccgcccgatgaccaacggcggccacagcatgagcggcgccagcatcgcgagcggtgctggcggctggctgggtttctcgctgtcgcctcacgtcgccatggaggcgggcgggccggctccggcaacgtccgacgtggnccgggcaacaaccaagcgcagcacgggngggggtctaatatcaaccctgaacgcggtcgnctcctcccccaattgtccttnctacttccggtgggggaggcgacaattgttcgggcggccgccnagcggggg

SEQ ID NO: 99655 - DNA, 366 bp, Triticum aestivum
  unsure (1)..(366): unsure at all n locations
  Clone ID: PAT_TA_99655
gtttggttgagttcggtcgggagtcggtacccttcttccttgctgtccaaaggccgaaaccctcgaccagtgcggcggccactttcccctccgtccttctcgtctccggcgattgcctgcccgccgtcagcgctctcgcgatgtcgccctcgaggccgcgcccaaccatctccagctccggtgacctgcccgcggacgcgctgtacgaggtccttctccgcatcccggccaaggacctctgccgcctccgcgctgtctgccccgcctgggngcgccctcacctccgacccgctcttcgtcgcggnggaacaantcccggccaacggtactggcgncccccgctcctcgccatggggttntcgngac

SEQ ID NO: 99656 - DNA, 349 bp, Triticum aestivum
  unsure (1)..(349): unsure at all n locations
  Clone ID: PAT_TA_99656
gcacaaaaatggcgcatcgattggtccagcgcgaatgaacagctttcgctttcctttttgcaaaggaagaagaagttcatcgcctgaaaaaacattcatgggaacaagcaaagaataaatctactcaacagaagagagaagaggcacggatctccagaaacacccaccaagcttgttccttctcgtgctctccgcgctgttccccgggccgccgcgtcgctccaagaagccaagcggcaccaaagccctgtgccgagtgaagttgaggggataacaagagcaangaagcgtccccgttgaaagcctcctgggggcccgaaggaaagcngtgggcctcaagctccngaaa

SEQ ID NO: 99657 - DNA, 449 bp, Triticum aestivum
  unsure (1)..(449): unsure at all n locations
  Clone ID: PAT_TA_99657
gagcgagtgacacaagttcttgcaccgatcagatccaacttctgcgcaagatgctggacaagctgtgggacgacgtggtggccgggcctcgcccggagacgggcctcgacaagctccgcagggcggccgccacccaacctctcgccatcaacacagntgcaggggaggcgattaagcagtcgccgtcgatgccgacgaccccgaccacgccggtgacgccgtcgtcgtcgacgcccccgcgncggnggcagcgtgtggcggatcgttttccaccccgggaagcaannctggccaccaaaagcctcggcgccaancctccttcgaccgccccgcanccccaaactccccccaaccgttctacgactggnttttacagcngacgangaccaatgnccaagggagnaaccaaccggcctaaataaagaagncgttcgggcngaaagaataac

SEQ ID NO: 99658 - DNA, 450 bp, Triticum aestivum
  unsure (1)..(450): unsure at all n locations
  Clone ID: PAT_TA_99658
gtgccagcccgaggcagtgaacaggcgcggtaatacagtcactcttctttacttgtcacacacccccttccattgttatattataccccaccccgcagtcccggcacctctgttccgccgccatgtcnacactcctccgccgctcaggcaacctagcgcgcctatcccgaccctgcctcaacgctgccacgagggcaccacgcacattacgcacacgaagcaccgataccacaatgtatatatacccaagcaacgggtgcggagattttgcgaccgggcccccggangagcccaaggagaanaaggatgacgaancagcgaangaagggacnggaagcctcanaagccctgaagttcaaaatttgtctggaaaaagaanggaagggaanagcctcaaattggccaaaactttaccgccaagagggagggnnaaagatccnggattcaaac

SEQ ID NO: 99659 - DNA, 468 bp, Triticum aestivum
  unsure (1)..(468): unsure at all n locations
  Clone ID: PAT_TA_99659
ggtgganggncatcnacnacatggacggcttcaaggacttcaccctggaccgcgtcaacttcaccgccgccgagctccggccgttcgtcgaccgtcttcaccggaacgcccagaaatacgtcctcatcctagacccagggatccgcatcgacgcgacgtacgggacgttcgtccgcgggatgcaagcangacatcttcctgaagcggaacggcaccaacttcctcggcaacgtgttggccgggcgacgtctacttcccggatttcaatgcaacccgaacgcccgccngaagttctggggcgcggggaagatctcccctcctcccggccgggancaatcccccgtncgaacggggctggtgggattcgaacaattgnaacnaagattntccaaactttcctaacnaacccgggagnccgattgaaacgcgctccgaacnaacccngccgtnaccggnttaaacaaacaa

SEQ ID NO: 99660 - DNA, 294 bp, Triticum aestivum
  unsure (1)..(294): unsure at all n locations
  Clone ID: PAT_TA_99660
gcacatttctccgcctattcttttttccccgtggtctttcaaactcctcgcctctccccagccagtccagcccacgtcggcaccgccgcccagccaagcaggcgccacttggactccccgcccgtccgtcccgcgccggcgtcgccccaagcccgtggcgggccccgccagctggagcgcctcgccttgggcgtttcgctttcgcccgcgggccgcccctgcctgcccgcccccanatgcgcgttggcctggggaaggggaagaggataccgcggtggtggtgattggaggcga

SEQ ID NO: 99661 - DNA, 400 bp, Triticum aestivum
  unsure (1)..(400): unsure at all n locations
  Clone ID: PAT_TA_99661
gccaaactcgcgctcgccggccatcctccccgtccgccgccgccgccgccaccgaccagccgcacccgcgctaccatcccctccccgttcctctccgagaagcagcccaagggcagccgcctgccgctcggcacgaacgcggatgcggtggtcgaaggggaagcggcgctgctttggcgccgctaagcgccaccaccccccgtcccttcgtcccccgccgnccctctgctcgtcccttcccggcaaaaacttctcccttcccctggngccgtttgcgctgnttnctccaactggggtacgantttcaatggngggtnccggggattcaatggcctccggacnttngtgttcttanccgtnaancctncgggggtttttagaaaattgncaaagggaattt

SEQ ID NO: 99662 - DNA, 343 bp, Triticum aestivum
  unsure (1)..(343): unsure at all n locations
  Clone ID: PAT_TA_99662
gcaagcttgtttccacggtcatgcttcgaggagggtctctccatacaacaggcttacaatgagttgtactcggccattgccagggacgagacgtggntgaagagcattgtggaggangcttgtccatgttgacnactttgttgcaaaattatgggaagacccatctagaggttangaaagaaggntacgtgcaaggatctctcgttgggactcttcccgctcaaactacatgggacatcaaagacccttcgnaagtcaaatccaaantccggtttgaaaacaagtcnatgtnaaaaccaattgcttcntcntttgggcggacctatcgggntcaaggtgtccg

SEQ ID NO: 99663 - DNA, 447 bp, Triticum aestivum
  unsure (1)..(447): unsure at all n locations
  Clone ID: PAT_TA_99663
gcttcccggagctacctcttactatcaacgctaccccagattcatatcgacgacagtcgccacttgacttgctcccaacaaccaacaacctcactaccanacaatcaaaatggtcagcttccacatcaacgagcctcacccatccgccggtgcctacatgtactctggccgcggcggagccggcaacnccatgcgcatcaagcccactgaggtcactcccggccccacagcctcaggtccancttcgcgcaccangctgcctcccccacccaagcancgnctttctacgccaccggcccgtggcggtgctggcaacatgaaanaaagactgagncgcggcatctttaagcttcgacgagggaactccaacaagnaangattgccttgggcaaaccaaacaangganccngttttaccaaaattnnggttcgccgggcggttcccgga

SEQ ID NO: 99664 - DNA, 454 bp, Triticum aestivum
  unsure (1)..(454): unsure at all n locations
  Clone ID: PAT_TA_99664
gccaattctcataccatctttcgagagtancagaataatgaacaccaacagtatctacattatggatttcgaaaccagcggtttcaagttgtttaatgtaccagtataaaggagtggangcatcagcaccagggaaaatatatttagccataaacaaaccccaaatgaagtcttcatattgccaaggtggctcttaatccaagctacttgcatgtataaaanaccatcatcttccaagagtttcacggtaccntcatgaagggaaaatatggnaacgacnnaancgactgacggtgtttcaanccatttcgacaaggaagtaaatcttatccgaatttttggagaactttggaatatcacngtaatccatgccagagaaangttangccttaatcccttnanacccccattccttcaagtnccgnttttccgccaaanancaacttgnanttct

SEQ ID NO: 99665 - DNA, 436 bp, Triticum aestivum
  unsure (1)..(436): unsure at all n locations
  Clone ID: PAT_TA_99665
gctcggcccctccccccattccattccaccagaccccgcgacaggccgcaggtgcacagccacttcacccatgccatagcgaggatccagcgccaccgtcttcgctccagggccttgtgccggagatcccgcgaggagaggcggcgcctcagcgagggtgggggttccgccccgcagccacctccccccacggagcaattcgtcccgaaggtggagattgaaaagttaactgaggaggagattgaaagggcataccaagaccgtctttcaacttgatgaggagtatcgggaacgtcataattgaggaagctttttatcaatctgaaatcaaagatgctacaaagncnaaaaagggctctaatgatgacaaggctttcaaagctgaaagnaaaaagacaaaggnngcccgattcaagcaagtttaaaacatttcaag

SEQ ID NO: 99666 - DNA, 443 bp, Triticum aestivum
  unsure (1)..(443): unsure at all n locations
  Clone ID: PAT_TA_99666
gcccaatcccacagccgccatggccctcgccgccggcacgcgtcccgccaccaacaccacccagagtcgccgcagcctccaccgtcggtgcgcccgcagcgaccaccacctcccacctttcaaagctggcatggcccccgccgcaagcgcgcaccccgccaccaccaccttccgcagccgccatggctcccgccggcggcgcgcgccccaccacctcccacttcccacggccgtcgtggtccatgccccaagccgctcctgccccaacggagtcccgtcggacgcagtgaccgttctccccgcaacccaagcaagcgccgccggggcttaaangcaatcccctgaactggcaagcggccgcccggtgttccctgctccttccccttgaacaaacggccggggtccntccccggggcgaaaacccttctcttccttccggcgaa

SEQ ID NO: 99667 - DNA, 402 bp, Triticum aestivum
  unsure (1)..(402): unsure at all n locations
  Clone ID: PAT_TA_99667
gatgaacggctttaatggcacgaccgacgctggcggcatgtacgtcaaggcgctatacgactaccaggccgacgaccgcaccagtctgagcttccggacgggcgacataatacaggtcatcacccanctcgagagcggctggtgggacggagtcatccacggggtgcgcggctggttcccgagcaactactgcgccgttgtacaagcgccccanccgaggacattgangaagcgacaagagacggcatcgatgcccgacgaccgaccatnaagactgangtccggcaaggcggcgctgaattcngacaacctcaanatggncgaagtncccttgagcggttggnaaacnaacaaccaatactggccccctccgaggcngcaatcaattgcaacnggcaacaa

SEQ ID NO: 99668 - DNA, 242 bp, Triticum aestivum
  unsure (1)..(242): unsure at all n locations
  Clone ID: PAT_TA_99668
gcaagatcaagccacagagtcacacaagcactancttcagctagccagcctcaagccactccgggcattttcttgcatccacgacggnaatggccaccgctgatgtccaaaacccnacggccgcgctgacggaggaggcgcccgcggtggagacgccggtggccgccgaggaggcccccaagacggaggaggtccccncgccggcggnggccnaggtctaagggtctgnccccntctaagtt

SEQ ID NO: 99669 - DNA, 413 bp, Triticum aestivum
  unsure (1)..(413): unsure at all n locations
  Clone ID: PAT_TA_99669
ccaccccaagctcatcaccatggaggtcttgctaggaatcaccggcaaggactttaccctcatcgccgcctccaaagccgccatgcgtggcgccaccatcctcaaggcgtccgacgacaagacccggagtactcaacacacacacgctgatggccttctctggagaagccggcgatacggtccaattcgccgaatacatccangcaaacggtacaattatactcgatgcgcaacaacatgggaggtgtcaaccgctgcaactgccaacntcgctcccgaggagaaacctggnggtccggcgcctggcnattaaaggaaaanccaattcnacnggtccaaacctttgctccctggggggtgnggataacgaacaccgatttgccggacaanncccaaaacctctnctaactggg

SEQ ID NO: 99670 - DNA, 455 bp, Triticum aestivum
  unsure (1)..(455): unsure at all n locations
  Clone ID: PAT_TA_99670
ggtcgggagcgaggggagcgagccaccatatgccactgtgagctgccagcgctctgcgatataaaggccgccccggccggccggccaccgtccaagatccctgtggtgtgggcagctgtgagtgaccgggagcgacacgacgcgcgcgaggggatgagccacggcgtcgcggcgaggaagcggttcggcggcgtcggcttcgcgctcggctgcggctgcaaggaccccaaggccgtggcggtcgcggcggcggcggtggccgcctcgtcgccgcgctccggcacggaggcgtccacggccaacacggccacgtcccggacggccagcaaggacgcacccgtcggcgtccacgtccaacgggcacgctcaacgttgccctccgcctcctcctccttccttgtgggaaggaccccgaccaaggtccgagttgcaagcnggccgaagctccnccgacc

SEQ ID NO: 99671 - DNA, 458 bp, Triticum aestivum
  unsure (1)..(458): unsure at all n locations
  Clone ID: PAT_TA_99671
ccgccgcacaccgccatggcagcgcactccgtcgccgccgcgcacgccaccatcgcggcccgcgcgggcgccgccccctcctccccggccgcggccccggctgagcgcctgggcttccgcctcagctcactcgccggccgcgccctccgctcgccgctcccggcgcgccggggctccccagccgccgccgcctccccctcctcccgcaggagcggcagccagcgcgtgcgcgcctccgcggccgtcgagaccgtcgaggcggccgccacggggcgagctgctcgacaagtcggtcaacgcgatncggttcctggccatcgacgccgtcgagaagggcgtgtccgggcaacccggcctgcccatgggctgcgcgcccaagggccacatcctctacgaagangtcatgcgctacaaacccaagaacccctactggttcaaacgcgaacggcttctcctcn

SEQ ID NO: 99672 - DNA, 237 bp, Triticum aestivum
  unsure (1)..(237): unsure at all n locations
  Clone ID: PAT_TA_99672
ggccaagccttctccccgaagcctttccggaaaaaccctcgcccccttccttctcccccgccccacacccccaccccggcaggcagcgatcaagccccgccatcgccatggtcagcgactacgactgctactactaatatngactgacgatagctatccncgaangtggattatgagnacggacaatccaggcaggtcgactnggacngcctgtcggtgaggggnggannaggacga

SEQ ID NO: 99673 - DNA, 443 bp, Triticum aestivum
  unsure (1)..(443): unsure at all n locations
  Clone ID: PAT_TA_99673
gcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggnacccacgaggccgtcctcagctcctacgagtacgtcagccagggactcaagaagtncgacttccacaacaccatgggaggnttttanatcgctcctgctttcaagggcaagcn

SEQ ID NO: 99674 - DNA, 458 bp, Triticum aestivum
  unsure (1)..(458): unsure at all n locations
  Clone ID: PAT_TA_99674
gctcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcaagctcggaccgcangatagcgtgcaggtgcctcaagagcctcgccaccagcatcaaagtccatcaacatgggcaaggtctccgggcgtgcccgggcaagttgcgggcgtcagtgttgcccttccccaatcancatgtccaaccaanctggcgaacaacttgtcaaactaanttcaatnn

SEQ ID NO: 99675 - DNA, 250 bp, Triticum aestivum
  unsure (1)..(250): unsure at all n locations
  Clone ID: PAT_TA_99675
acgactataaggttcccacttagaagttanaacaagtcgcaacacagcacgccccaacaaccccaccgcccaanaacacgccacaggaaagagaagaatctccggcccgtcctgtcctaatcgcaccggcgagaacgcgggcgggctanctagctaagctccggtgaggccggngacnggatacgcccatggagtacaagaggtcatcncatgtggnggatggacnangaactgnagnttnttctttnct

SEQ ID NO: 99676 - DNA, 272 bp, Triticum aestivum
  unsure (1)..(272): unsure at all n locations
  Clone ID: PAT_TA_99676
gggcgtcgcgattgctgaccagatccaaagccctagcgctcgccgccgcccgcgccgacttcggtcgcgccgtcgcngctcgncgccgcctggggcgnncgcgcgctctccgccctcccccgcgatccggcggccgcatcccccgcctcntcnnctcggtagcnggcngtggtcttcgccgctcggcctctccaagattctancgangatgaagcangcctctnnactcngtgggacaacacgtattccctcncatggtttttccacatgga

SEQ ID NO: 99677 - DNA, 188 bp, Triticum aestivum
  unsure (1)..(188): unsure at all n locations
  Clone ID: PAT_TA_99677
gnacaccacccnccgcccagtgataagcagtgcntgaacagnttnncaaaaaaaangcntgganacttgatctactttggtacataaaaaatagcatcagtgtgggcatccttaacatcgaacttttcttcngnaaggaacgtgccnggtgcggtgtgcgncgntngaagcnctgcggcgccancccg

SEQ ID NO: 99678 - DNA, 425 bp, Triticum aestivum
  unsure (1)..(425): unsure at all n locations
  Clone ID: PAT_TA_99678
gccgcaaacatgcagatcttcgtaaagaccctcaccggcaagaccatcacgctcgaagtcgagagctccgacaccatcgacaatgtcaagagcaagatccaggacaaggagggcattcccccggaccagcagcgcttgatcttcgccggcaagcagcttgaggatggtcgcaccttgtccgactacaacatccagaaggaatcgaccctgcatctcgtcctccgccttcgtggaggtatgcagatcttcgtcaagaccctcaccggcaagaccatcacccttgaggttgagtcctccgataccatcgacaacgtcaagtcgaagatncaagacaaggagggcatccctccggatnaacaacgcctcatcttcgccggaaagcaactcgaagatgggcgcaacctgtccgactacaacaatcaaaa

SEQ ID NO: 99679 - DNA, 262 bp, Triticum aestivum
  unsure (1)..(262): unsure at all n locations
  Clone ID: PAT_TA_99679
gcgccncctcgnctntcaccaatntcncggntcctaccgccgggcatcgccncccctcgccgctnctgcgtctcgtccccgggctcctgcttctgctgctcatctcgcggccggcncaagcgtctgcgtctacngtggtcacccgcctgccggtattctatnggccgctcnccttncaactcgataccnggtacnttgggcgtggatngangataccnggacngntctcttctactactttgtttaatctnancggtncccc

SEQ ID NO: 99680 - DNA, 202 bp, Triticum aestivum
  unsure (1)..(202): unsure at all n locations
  Clone ID: PAT_TA_99680
gatttccaccgccaccaccaccaccgcgccaccgccggccgcctccagggacagcgagcgagaggggagggaggggcctcgccggagaagatggtggacgtntctcgcgtgcataanganctnatggtgtgcaacngggantcgganatctccggcgtctccatcgngttccacganggctngctccaagcatcacccatct

SEQ ID NO: 99681 - DNA, 336 bp, Triticum aestivum
  unsure (1)..(336): unsure at all n locations
  Clone ID: PAT_TA_99681
gttctccggcgggcagggcatcataaaggacanccgccattancgaancttcgttcggcatggcgaggcaagccctgancaacgggttcctcggcggcttcatgtncgtggggctggtcgctggtgctcctcgcatncctccccgtcgccttcctctgccgcctcgtcnacaggctgcgtnatcanaggcctttncgccggccggcgangacctnccncggnaanggtngttgcttcatcaaccgggcgccctccctcccngcaatctagacgaagcatcttggcgttcntangtttccnctnangaaaagggtcccgtntccntcggncgcctgg

SEQ ID NO: 99682 - DNA, 412 bp, Triticum aestivum
  unsure (1)..(412): unsure at all n locations
  Clone ID: PAT_TA_99682
gccgctcccctcctcctccttgacccgccgccacctctcctcaccgggaagaaaaccctagctagagagcttcaaagtttcccgcagcacgagagatggcggcgaagggcgatgggccggccatcggcatcgacctcggcacgacctactccgtgcgtcgggcgtgtggcagcacgacaaggtccaagatnatcgccaatgaccagggcaaccgcaccacgccgtcgtacgtggccttcaccgactccgagcgcctcatcggcgacnccgccaaaaancaaagtggggaaangaaccccancaacacntcttcnatgccaagcntcacattggccgtanattcactgattcnactgtccagagtgatattaanctgtggcccttcaaggttgttgctggacctggngacaag

SEQ ID NO: 99683 - DNA, 445 bp, Triticum aestivum
  unsure (1)..(445): unsure at all n locations
  Clone ID: PAT_TA_99683
gctcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcattggcccgcaagcagctcggacccgcaaagataaccgttgcangtgccctcaaagagcctcnccaaccaacaatnaaagtccatcaaacaatggggcaaggtcctccgggcggtgccccgcaaagtgcnggcgtcaagtntgcccttccccatcaacatgttcaacaactgggaaacn

SEQ ID NO: 99684 - DNA, 436 bp, Triticum aestivum
  unsure (1)..(436): unsure at all n locations
  Clone ID: PAT_TA_99684
gcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaacaaaggggaagggcatcgtggactccctcttccangcgcccaacggggcgaacggnaaccacgaaggcgtnctcaactcctaagagtaacgtcaaccaagggactcaaagaaataccgaacttcacnacaccaaggggagggttctaaatccctnctn

SEQ ID NO: 99685 - DNA, 437 bp, Triticum aestivum
  unsure (1)..(437): unsure at all n locations
  Clone ID: PAT_TA_99685
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcancacggaggccctcctcaagcaagtcgactacctgattccgctccaaattgggtggcttgcctcgagtttancaaaggttgggtttaatccttcccgtgaagcaaaaaacgcatccccctgggtactatgaatggccggttactgggacaatntnggaaagctggcctaatgttccggggttggaaaccgncg

SEQ ID NO: 99686 - DNA, 352 bp, Triticum aestivum
  unsure (1)..(352): unsure at all n locations
  Clone ID: PAT_TA_99686
ggcacctcctcccctcctgcccccgagcaccgcagccgccgccgccgccgccgccgccgccgactgcagccatgtcgctgatcgcgggtgaggagttccagcacatccttcgtgtgctcaacaccaacgtcgacggtaagcagaagatcatgttcgcgctgacctccatcaaggggtgtgggccgccgcttctccaacatcgtctgcaanaaggnccgacatcgacatgaacaaagagggctggngaacnttcccgccggatgaagatggaccgcccgattngcgggnggtggcacaaccccgcgccaatttaagggtgccgggacctgggtttcttnacaaggnaataagg

SEQ ID NO: 99687 - DNA, 307 bp, Triticum aestivum
  unsure (1)..(307): unsure at all n locations
  Clone ID: PAT_TA_99687
gcgctccacaacaggatgggataggtctcggcaggngggaagtcactttggntcttgacaaattcttactttggctccttcattttccttggtanaaaaattcactggaccgtggtttacgacagatatacggtcgctacattagaatcaacgtactcttttctgttcagcaggttgcctggatgttaggaaaatgacatatctcnatggtccggggtgataagnagtcacccnnactcaacgggggtgananttanaagtcaangtcttanncgagaaaaaactagggntatcaaagttaactatc

SEQ ID NO: 99688 - DNA, 457 bp, Triticum aestivum
  unsure (1)..(457): unsure at all n locations
  Clone ID: PAT_TA_99688
ggccgcggctaactggtgctacgcaaccgtantcgcgccccgtgcccgctcctccaccatcgtcgccagcctcgggacccccgcgccctccanctcctcctccttccgccccaagctcatcaggaacacccccgtccaggccncccccgtcgcacccgcattgatggacgccgccgtggagcgcctcaagaccgggttcgacaagttcaagaccgaggtctacnacaatgaagccccgatttcttcgagcccctcaaggncggccaggcgcccaagtncatgngtgttcgcggtgcgccgaatccccgttgtgtgtcccctcgggtcacccctggggcctgnganccncggngaggggcttcaccaatcncgcanangattgtctaaacatgggtcccctncctactggnaanggaancaaagttngcccggtgtttggnttcgngtcatcngaant

SEQ ID NO: 99689 - DNA, 432 bp, Triticum aestivum
  unsure (1)..(432): unsure at all n locations
  Clone ID: PAT_TA_99689
gcatcctcctctcctccgataatacaataccatggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgccctccgattcagtaaggttggattccgtcttccggtgagcacaacaagctctcccgggtaantacgaacggtcgatactgggacaatgttgaaagcctgcctaatgtttccgggtngaacccgaacgccancgccagggg

SEQ ID NO: 99690 - DNA, 227 bp, Triticum aestivum
  unsure (1)..(227): unsure at all n locations
  Clone ID: PAT_TA_99690
gcacgaacaaaatcacggcgcgatggcaaacgagcgcagcgccggcgaggagcgtggagcggcggacagcgtcgtgtggagggaggaggcggggaagttcnatacgcccgacggnnaggccttcctccattancgcctcgtcgttcaagccactcgcctcctccggngggnggcggcgcttcccctgnnggngatggacatngtgcacacttacnttccagtcgagt

SEQ ID NO: 99691 - DNA, 218 bp, Triticum aestivum
  unsure (1)..(218): unsure at all n locations
  Clone ID: PAT_TA_99691
gcctcgtgccgaattcggcacgagggagagagagaactagtctcgagtttttttttttttttttttaatataatagtcgtgcaacagcaccanactctttacctntccnngtcgtatttgtcacngattacggcctgcccanggaaacctntccacatcccactanttataccatgtnncgcancagctcnccggtanggatnntttttttttnattt

SEQ ID NO: 99692 - DNA, 421 bp, Triticum aestivum
  unsure (1)..(421): unsure at all n locations
  Clone ID: PAT_TA_99692
gtaacatagagatcctgccaccggaagtcctctgctcctacaggccatcatttctctcggcaagccggaaggatgataaaccttgcggcggtgcagaggatctgaatctcgacttggcgatgcccgctagcagcgctgctaaccgattgccctcctcctaaacagcccgtgcaacaggacccgcaaagtcgtagtgtcangtcatactatgtagcantgccaancagaactgcctgaccagctttttcctatttttgtgtgctcgctgtattctttttgtgcctttcgttttcccctccgtattcgccgggtgcatactggccctgttaaattttttttcccacgggccttttttctggngttttaaggaaaaccgtttacaagatntaaanaaccttgcaagcccattgcaacnttgttt

SEQ ID NO: 99693 - DNA, 444 bp, Triticum aestivum
  unsure (1)..(444): unsure at all n locations
  Clone ID: PAT_TA_99693
ggaactagctatcacttatccggttcagactggagaaggtgaagaacacatctcctttgtcaatccttacntncatcnacgtangtagaactaatggngtcanctacncatgcaaccatctacaccgaccggttcccgccggctgagttgcaccggcggccggtggactaccaagcccaaaacctgggactacgactccatttgctccttgcatcaagcaggtgcaccaagacgacaaggtgcatgcacgatcagccaaaaattttcttccgttttttccccttcttaaattttgtttcccgtgtcccggccatggcgaagccacaaggggttggggtgggtcaagcattagggggaagggacattatttccggtgncnaanggganaagggccaaagggggtccaaggatcatccgngtgggcaangtccaattgcctagtgt

SEQ ID NO: 99694 - DNA, 423 bp, Triticum aestivum
  unsure (1)..(423): unsure at all n locations
  Clone ID: PAT_TA_99694
gccacctacaacttcggactattggcatctcaagcctaagcatgaaaagcatcgttatcgtctgcttcgtattgatcatgtcctaggccagaaaggagggttttggaaccgacgcggatcctcctcancantcaactcggcccaatgacactatacgggagattgaaccttttgcccagaaggacttgcttccgcaaggaatctacgttcttgatgccttcctcgaaaatcctacgttatccgtaaggaagtgaggctaagtcctcccgggctgcctgaaatttggcgttctgnctccnccgtccttccccgcaangaatnatngggaataantnaggcggggtttcccccccnaanganccggncccntttttccccaattggggcnatgttttaaanttnggggggnctggcccaaatcct

SEQ ID NO: 99695 - DNA, 434 bp, Triticum aestivum
  unsure (1)..(434): unsure at all n locations
  Clone ID: PAT_TA_99695
gcatccctatcgtatcaactttcaactccagtcacaaatcagctacaatggctcccatcaaggtcggcatcaacggcttcggtcgaattggacgtatcgtcttccgcaacgctgttgagcaccccgacatcgaggtcgtcgccgtcaacgaccccttcatcgagaccacctatgctgcctacatgctcaagtatgattcctcccacggtatcttcaagggcgacatcgatgtcgatggcaaggacctcgttgttaacggcaagaaggtccgcttctacaccganncgtgaccctgccaatatcaangtgggngcagactggcgccgactacattgtcnaagtccnncgggtggtcttcaaccaacaccgaanaaaggggcnaaggctcacttnggccggggggttnccaaanaaaggtccatcantctcctgng

SEQ ID NO: 99696 - DNA, 280 bp, Triticum aestivum
  unsure (1)..(280): unsure at all n locations
  Clone ID: PAT_TA_99696
gaggaaatccactccaatccaatccccacaaaaaatccccatctcaaaaccctagcccgtccgatnccggcgaaatggccaacccgagggtgttcttcgacatgaccgtcggcggcgcnccgggcnggcgcatcgtgatggagctgttacaanggangccgtgnccccggacggttgaaaaatttccgcncgctcctgcaaccggcgaanaaagggcgttcgggnaanaancggnaaagcccactggcactnanaaaggggcaangttccnttccaaccc

SEQ ID NO: 99697 - DNA, 427 bp, Triticum aestivum
  unsure (1)..(427): unsure at all n locations
  Clone ID: PAT_TA_99697
gctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcnactacttgatccgctccaagtgggtgccctgcctcgagttcaagcaaggttggcttcgttttccgtgagcacaacagctcccccgggtactacgatggtccgattacctggacaatgtgcgaanctgcctaatgtttcggggttgcancngncctccaccacangtggccncaaaccgaaggtg

SEQ ID NO: 99698 - DNA, 460 bp, Triticum aestivum
  unsure (1)..(460): unsure at all n locations
  Clone ID: PAT_TA_99698
ggccgttgaaggacaaagaanagatgaccatgttgtcgccggcctccacccacctcctccgctccggctccgcgcctgcggcacccctgctgcctcgccgcgcctccctgcanctctcctgcgtcgccggcggngccgcgcnaaggagtaggagacggagcggccgcctggaggtggtccgcgcggccaccgcggaggtggncgaagccgccggcgcccccgcctanaccangcgaatcctcatcctctactttaaaggcggagggcaccatggacgacgaagggctgttcccaannatcacccatgctctcncaggggatggaacgggngttcactgaacctgggaggttgcttcatccgaacaaatggaatccgganaagntntttgtgtttaacgaancggcgacaaacangttcaaaagcttanctggggggtccccctncaaaaccctaagtntg

SEQ ID NO: 99699 - DNA, 400 bp, Triticum aestivum
  unsure (1)..(400): unsure at all n locations
  Clone ID: PAT_TA_99699
gtgtatctgaaaagccactggaaaacacatcacagtcagagatcgatgaactgaagtagagactgtgcgaactcgctgaagccaaagttcagctagaggtccgtaaccaggaacttctggaggaaagcacgtacgccaagggcctggcctcaagccgcgggtgtcgaactgcgagcgctttctgaagaagtcaccaaactcgtgaagcaagaaaggagaaagctcgccaagccaatttgggagtcaagcgaagaaaactccgactncaacgaaagaagcaaagccaataaccccganggggcaagcnncgaaaaaggggcaaccaacgttcgaaccgaacaacaaancaangtnggttaaaagaaganccccaacctncaaangcnacccaaanagggaa

SEQ ID NO: 99700 - DNA, 425 bp, Triticum aestivum
  unsure (1)..(425): unsure at all n locations
  Clone ID: PAT_TA_99700
gccccaccgctacaggcccgggaccgtcgccctccgggagatccgcaagtaccagaagagcacggagctgctgatccgcaagctgccgttccagcgcctggtccgcgagatcgcgcaggacttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccaactccgcccgccgcatcccgtgggcgaaagggcctaaacccgtcctcccccgtcaaacgccgttagtggatngggagttggatgtgttgcttccggttttnagtttgttcctaattggccgtggccangnccaaacctcctttgggtanaanaaatatngn

SEQ ID NO: 99701 - DNA, 444 bp, Triticum aestivum
  unsure (1)..(444): unsure at all n locations
  Clone ID: PAT_TA_99701
cgccctccccaaatccgatccgccgccgcccgccgttgacgccagccatggccgccgccgcccgccgcgccctgctcctcctcctcgccgccgccgccgtggccctcctcgcggcgcccccggcggccgccgcccgcccctgcggccgcgcgcagacgctgctcatctccttctcctccttctcccgccccaacccggaccccgccgacccgtcgccgctcaccaccaccgtcgtcaccgtcctccgcgtccgccgccttcggcccgcancgcttccacgcccacgaccagaaccgcctcccagatccgccgccccgccgaggcccctcccccgccgttggcacnccccgangcgcgangccgaatgncngaacgccgcctcnttnctttccanggagcgcgccaaaggaaaatcctccgtcggcgntctncggggccctgctn

SEQ ID NO: 99702 - DNA, 440 bp, Triticum aestivum
  unsure (1)..(440): unsure at all n locations
  Clone ID: PAT_TA_99702
gagaaaacaccacatcaaccaaaagaagaagagaagcagatcgcgtcatgggaaagccaggtacaaagtatctccctcaaaaggcgaaggataaggtgaagaaggcaccgtctgcttcgtctaagaagaagaaggtggtgaccaagacgaaacccacaacatcaaagaagaagcagacactgctgtctaagaagaagcccaaaaacaagtgagaccagccacccatcgagctgctcggagatccccattgatgttggcctgcatgaagaagttaaagttgtttttcctgtcaaagttattgttagattaaggttcaataaagtccaagtttgttaactccaatnaataaagttgagggtgttttttggtgtcaaagttagattantttaangggtggcaataaagtnaanttgtaaaactcaaattcnntntaaccccgg

SEQ ID NO: 99703 - DNA, 419 bp, Triticum aestivum
  unsure (1)..(419): unsure at all n locations
  Clone ID: PAT_TA_99703
gcccagaaccctaacctccctctccaccatggcctcctccctcctccgctccggccagcgcctcctccgccaccaccgcggccgcctccccgcggccttctccacggcggccgccgaggagctcatcgatgtgcgcaagctgcccaccgactacganccctccaccttcgacccgaccgcgccgccgtcccgcncgccgccctccgaccgcgtctggcgcctggtcnacgacntctccgccctcaccctcgcagaggccgccgagctctccgccctcttgctccgncgcctcnaaaatccccttccgcgcccgcccatcgcccatcctcaaactccgccggcggggccctcngatngtggntgggcnccgagcggnncgcccngctgcgggtcggcgataaatccggcnggnccgcggg

SEQ ID NO: 99704 - DNA, 447 bp, Triticum aestivum
  unsure (1)..(447): unsure at all n locations
  Clone ID: PAT_TA_99704
ggcaagctatatacctacatagtacagccatggcccccaccgtgatggcctcgtcggccacctccgtcgctcctttccaggggctcaagtccaccgccggcctccccgtcagccgccgctccaacggcgctancctcggcagcgtcagcaacggtggaaggatcaggtgcatgcangtgtggcccatcgagggcatcaagaagttcgagaccctgtcctacttgtccaccgctcagcanggatgccctccttaagcaggtcgactacctgatccgctccaagtgggtgccttgcctcnaagttcaccaaggttgggttcatncttcccgtgancacaacgcatcccctgggtaactaacnanggcccggtnctgggacaanttnngaacgctgccntatggttccgnnntgcacccgaccgccaccgcaaggtggatttaancnaat

SEQ ID NO: 99705 - DNA, 303 bp, Triticum aestivum
  Clone ID: PAT_TA_99705
gggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataaagtacaatctgtcgactatgtatttgggtaattaatgagaaacatctttgccaccgcaaaaaa

SEQ ID NO: 99706 - DNA, 392 bp, Triticum aestivum
  unsure (1)..(392): unsure at all n locations
  Clone ID: PAT_TA_99706
gctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcaagcgtcagcaacggtgtgaagggatcaggtgcatgcanggtgtggcccatttgaggggcaatcaagaaagttctagaccctgtcctnctttgccaaccgctcaagcancnggagggccctccctcnaggcaagggtncgactacctgattcggctccaaanttngggtncctttgcctcgagttcaagcaaaggttnnggtttantctttccgttgagcncaaacncatccccctnggggtt

SEQ ID NO: 99707 - DNA, 213 bp, Triticum aestivum
  unsure (1)..(213): unsure at all n locations
  Clone ID: PAT_TA_99707
gccgagatgttctggctaccgttagatgtgacgccgctaccgttccgtgttacctgttccgtccccgttggctatgaatgaaatgaaaaatcagagcaaagtttgttcgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaann

SEQ ID NO: 99708 - DNA, 426 bp, Triticum aestivum
  unsure (1)..(426): unsure at all n locations
  Clone ID: PAT_TA_99708
gcagctgtcctactgtcacatacacacacacacaagtgctagctagctaatcgatcagccagccatgtcggaggagaagcaccaccacctgttccaccacaaggagggcgaggacttccagcccgccgctgacggcggcgtcgacacgtacgggtactcgaccgagacggtggtgaccgccaccggcaacgacggcgagtacgagcggatcaccaaggaggagaagcaccacaagcacaaggagcacctcggcgagatgggcgcagccgcggccggagccttcgccctctacgagaagcacgaggcgaagaangacccggancaccgcacaagcacaagatcnangaggaggtggctgccgccgcaaccgtcggcgcccnggcggctttcgtcttccacgangcaccacganaaagaaagcaggnn

SEQ ID NO: 99709 - DNA, 345 bp, Triticum aestivum
  unsure (1)..(345): unsure at all n locations
  Clone ID: PAT_TA_99709
gcaaagatcaccaaggtcattgaaatatcgcaatccgttgcaataacattataagcaagatgagatctattgttctgtctgcccttcttcttgccggcctcgctgcnaatgcncctccttactganaancgtttggctcgccgtgccgctggcactcgtcgctcaagcccaccatatgtccccaaattcgtatggtgtggaaaaatttgaacattaacaaactccaaagaatgttgaagtaaaagtcaagaaactggggccnggtggtgttcttaattggggaaccgggtnaaacgccgtnaacgcaaaattcaatggccctaaccctaacgggcccaatnatgg

SEQ ID NO: 99710 - DNA, 375 bp, Triticum aestivum
  unsure (1)..(375): unsure at all n locations
  Clone ID: PAT_TA_99710
gcctcgtgccgaattcggcacgaggcgtcccccagttcagtcaacacagtgcacactcagcacctcgaccatcgccaatcgacaacatgcctgctaagggaaagaaagttgccgccgcccccttcccccagggcaaggctggtgccaacaagaagaccaagaancctctcttcgagtcccgtagcccgcaacttcggtattggtcaggatgtccangcccaagccgcaactttgtcccgcttcgtcaagtgggcccgagtacgttccgttcttccagcggcaagaaagaaanattcttggaaccctccngttctcaaagggtcccctccctngccaatttgncccaantttttncaaaaaacccctcngaatcgg

SEQ ID NO: 99711 - DNA, 425 bp, Triticum aestivum
  unsure (1)..(425): unsure at all n locations
  Clone ID: PAT_TA_99711
ggcaaggttgttgaggtctccacctccaagactgggaagcatggtcacgcaaagtgtcactttgttgccattgacatctttaatggaaagaagcttgaggatatcgttccttcatcccacaactgtgacgtccccatgttgaccgccaagattatcagctgattgacaataactgatgatnggtaatgtcaancctcctaaactngagaagtngnaaacaacgaagggtnacctgaaagcttcccaactgatgatgttctgcttgggcaanatnaagactggatttgctgatggcaagganctgattctgtctgtgatgtccgccatggggtgaaaaacaaatttgcgctgtnaanggaatccgtgggggnaaattaacaactgtgcgtgggtgcccaactgcgaanaccttgggaaccaanngc

SEQ ID NO: 99712 - DNA, 409 bp, Triticum aestivum
  unsure (1)..(409): unsure at all n locations
  Clone ID: PAT_TA_99712
gcctcgtgccgaattcggcacgagggaaggccacaatcagcaactgaccctgtaataccttacctaactnaggtgtggtttgtttgtttgagccangatgttggcggtgttcaancggcgaagtggtggaggttgccggcggaagctggtggcggccgggagccggacgccgtcgcccaanacgcgggcgtcggagctggtgaaacgcttcctcnccgggggccgagccgggcgtggtccgtgggagctgggattgctgggcaaactcgcctaatcccangccaaacantccctcctcctgccaagggtccttcccttgcaaaaggatganatnttctgcctgttccaagggantcctgggacaacntnggggcggntgagccaacaataacggctctccaaagggggg

SEQ ID NO: 99713 - DNA, 443 bp, Triticum aestivum
  unsure (1)..(443): unsure at all n locations
  Clone ID: PAT_TA_99713
gcacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgaagcccccgaaatgtggcgctgcgcgggatatgaaatccaccgtcgacgggcaacctggcnggtggggaccctgcaaagaaagtaactggattcgggttcaatggccgggcaatnaatattttcccgcccnaaaataaaaaataaaagctcaaggncangattaacaacgtcatccgtgcc

SEQ ID NO: 99714 - DNA, 430 bp, Triticum aestivum
  unsure (1)..(430): unsure at all n locations
  Clone ID: PAT_TA_99714
ggagagacagagcttgagagagcgcgcgcgagatggcatcctccatgatcacctcgccgattgtggcgccgacnagcctgccgtccctctcccgccggggctcctccttcgccgtcctctgcagcggtggcaagaagatcaaggtcgacaagcccctcggactcggaggcggcttgacagtcgacatcgacgccaacggcaggaaggtcggcaagaanggcgtgtaccaatttgttgacaaatacggggccaaacgttcnacgggnaaaacccaatntaaaancccggggggaatgggcctgnaatcctggtnaaccggctaacccnggggggnaaagnaacggggctnttaatctggggccttcaacctccnccgggctcctncggggggggggtcctnctccntctaaaanaacaacgctctccccgg

SEQ ID NO: 99715 - DNA, 442 bp, Triticum aestivum
  unsure (1)..(442): unsure at all n locations
  Clone ID: PAT_TA_99715
gagacaaatagcctcgggttgaaatgttttctcctagctgtatcgtcagaattatttcatcatatttctcataatgtctcctgctcgggttgtcgaatcttcccacaaagataatgactttcagacactaacctccgcactggatgcgttgttggtgactgtccaccaagctgagcttgagggagcaagagctgcaacggagagtcacactggctcacgacgagtataaaaagctagccgatcgagtgggaaggaggatttaccaaatgttaaaacaaagtgtattggnacaagattcgtccaaaacgactctcaaactcctacccgaaaactagacccaatcnccttaaaaaccnttaagaccgtccgttggataaacctncaaanaaacaaccgggcaatntncaaacgtcangttantttgaatggtcctnagtnacca

SEQ ID NO: 99716 - DNA, 416 bp, Triticum aestivum
  unsure (1)..(416): unsure at all n locations
  Clone ID: PAT_TA_99716
gcacccattcccctcgccgccgccgccactccgccgccgccgccgccgagatgggtcgcgtgatccgcgctcagcgtaagggtgcgggctccgtcttcaagtcccacacccaccaccgcaagggccccgcccgcttcaggtcgctcgacttcggcgagcgcaacgggtacctcaagggcgtcgtcaccgatgtcatccacgacccggggcgtggtgcgccgctggccaaggtgaccttccgccacccgttcaggtacaaggcaccanaaggagctcttcgtcgccgccgaggggtatgtacaccggccaatttcgntctaactgcgggccgccgcgccaaccctctccgtttggtaaacgtcctccccgctccggttccgtgcctggaagggaaggngttaattcttncaaacctt

SEQ ID NO: 99717 - DNA, 408 bp, Triticum aestivum
  unsure (1)..(408): unsure at all n locations
  Clone ID: PAT_TA_99717
ggctactcccctgncctcccccggagctcgttagggttttctgttttttcgggggagaaatctcaagaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgaggggtggtggtgacgatgaagggtgtccaatgaaccaaggccgttgaaanggtgggttgaacaattgtttgaacaacctttccgtncttcaaaggagcnaaacttgcttttttgaanaagnaaagcaattttancctccccaaaatgaaagccggctnaaattaaannaaccccca

SEQ ID NO: 99718 - DNA, 359 bp, Triticum aestivum
  unsure (1)..(359): unsure at all n locations
  Clone ID: PAT_TA_99718
ngcacacactctccacatcaatcaaactactttcaactcttacccacccaaccaaacccaccaaaccaccaccatcaagatgcgtttctccaccattgccaccgctgtcatcgccgccggcgttgccaacgcccaggtcgactccatcatctcccgtgtcacctctgccgtaggcggtgtcccctctgacatcggctccgtcgtcagctccatcacctctgaacatttggctcccgggttttgcatncaattaaccaagcngaacgcccggcctnctgggngcttnaatctggncncctnctttcaatccaagaagcgaanccctcctctggnctcaagaaccntngaatccgnnggct

SEQ ID NO: 99719 - DNA, 328 bp, Triticum aestivum
  unsure (1)..(328): unsure at all n locations
  Clone ID: PAT_TA_99719
gctggggaagagcacacaacacagtcaatttgatctttcctttgaatctctccgctctaatggcctctaccactctcttccgcctcgcgacgcgatccattcgcccggcaagctttgtcagagcttcgtcgtacgctcctcgttccagccttcctgtccgctcttcgttcgctattgccaataacttcagcacttctgccaagctccgtagtggccatgagggaaagagacctacgaaggagttctctgcccgatacgaaaaagggaatncgnattgccgttnaangatgttttcgnactttcaagcgaanccttaaaaaagcctttt

SEQ ID NO: 99720 - DNA, 445 bp, Triticum aestivum
  unsure (1)..(445): unsure at all n locations
  Clone ID: PAT_TA_99720
ggtttgataaagagacagtaaagaatgaattgaaggcaaaaaaatacaaatcaaaagaattggaacttgctatccgtcaagcactggatcctagtttgaatgaagagaacataaagacaacgaaacgtaaagggaggacgataaagaaagaagatgacaaaagagaggttggaaagaagaggttgagtatggaaatagatttggaagagacgaagaggtgtaaatcaatagaaaatgaatccgatgatgactattgacgtactgaaaggaacaccccgaattttaaaaaagtctatccgaattccgacataaacctcaaaaaattagntttatgaaaaaaanaancaagggaanngatncccaaatgnangatttntggcgaagnaattnccannccatcaatgaacgaaaatccgaaaagggttaacccatcannaccccgatt

SEQ ID NO: 99721 - DNA, 380 bp, Triticum aestivum
  unsure (1)..(380): unsure at all n locations
  Clone ID: PAT_TA_99721
gcctcgtgccgaattcggcacgaggctccgctcctctcccccgccgccaccccttccccgcatcgtctcccacgccaagaccgccgccgttcgtcaagatggtgctgcagaacgacatcgacctcctcaacccgccggcggagctcgagaagctcaagcacaagaagaagcgcctcgtgcagtcccccaactccttcttcatggatgtcaaagtgccaagggctgcttcaacataacgactgtgtttaagccaactnctcaaaaccgttggtgggtnttgccctngggctgccaanacgggtgctcttgcaaacccaaccnggnngggaaaggcaaggnnncaaccaagggaangcccctncnnccgggaaagggggaat

SEQ ID NO: 99722 - DNA, 442 bp, Triticum aestivum
  unsure (1)..(442): unsure at all n locations
  Clone ID: PAT_TA_99722
aaanggccnttttgttgaaggctaacagcaaattcacaacatcctccctcatcaataaatcatctagtcaaacacgtgcttatgccgatgttactgatggtagacaaggtgctttagaagaagctattacttctattttgaccaaccaaaacaatgaatttgaagtttccaaggaattagcttttgtcacttcaacagtcaagactgaagaagattttgctcaagccatgagacttgcttctagagttggtgggtagactcacttatcaaaggataccaaagatgttggatacaatgcaaaaagaanncaagttgttccgtgtttgccaattaacnggngctgccngggccaaattgccttacncncccaatccaanaattgcccantggngaaaatgttggggcaagggtttaaccantccaanattgtcnttgattgnnn

SEQ ID NO: 99723 - DNA, 372 bp, Triticum aestivum
  unsure (1)..(372): unsure at all n locations
  Clone ID: PAT_TA_99723
gcaacaacacagagcattctaccaccgcaccgcacgagtgaagtgagagctttgcacgaaaacttcatcagaaaccatgaagggcaccaagctcgcggcgatcctgatcctccatccgtcctggtcatgggactcctctcacacgtgaacgccgattttttcccccaagtgcagcaacaactgcaggtccttctcgggggtcgacgtctgcgacgacgcccaccccaagtgtccccaagggctgctccngcgtncccgcgtgggtgttcaacgatccccgaaatgttggcgctgcgccgggntnatganatccaaccntncgacgggaacctggnggggggaacccngcaaanaaagtnnctggttncgggt

SEQ ID NO: 99724 - DNA, 362 bp, Triticum aestivum
  unsure (1)..(362): unsure at all n locations
  Clone ID: PAT_TA_99724
gtctgctttgtggaaggagaagaaggagaagcctcgttcataaacaacctaaaacgaaggctggggtttaaggaggaaaacatattgagaacgattccaatgatatgtacgaaggggtttacgaaaaaagcatatacccctttctggaattggacaaaaattcaaccatgatgttgcattcaggcataaggattctgtatgcacaagaattttctcttttanaaaggtttcaaacgtttcacaaggatggcgncatgacttgtacgggannggttgaaaatgcntatctactacatgtttgacttaatgtggtaancagtgttttgactgccaaaataccaattnattaatgggttcatcca

SEQ ID NO: 99725 - DNA, 443 bp, Triticum aestivum
  unsure (1)..(443): unsure at all n locations
  Clone ID: PAT_TA_99725
gcctcgtgccgaattcggcacgaggccgccgtcctcgcgtcttctcctgcgcatctcggaggtgcttcctagtttccacgatgaagctgatcgcagcctaccttctcgcctatctgggcgggaactcttccccaagtgccgctgacgtcaagaacatccttgactcagttggtgctgaggctgatgaagaaaagcttgagttccttcttgctgaactcaaagggaaagggacatcaacaagaaagttgatttgcatcctggaaagggaagaagttttgccgctgttgcccttcaaaggtnggggggtggccaattggctgtggggaagcctccaagcttgcctgcatcctgggtgggntggccgcaacaacctngcttgctngangtccaaaanaaagggaggganaaaangntttaaaaaaanaaaaggnanaaatctgatt

SEQ ID NO: 99726 - DNA, 367 bp, Triticum aestivum
  unsure (1)..(367): unsure at all n locations
  Clone ID: PAT_TA_99726
ggagctccagcggcggaggaggcggaggcgattgcttcagttcatggcgattctgagctcatccaccgcaggattttgatttcttctccctcttctcttcgttcgccggctgccctggtagtatctcaatgggtagagtgcggaaagtctgtcgcaaggatgttcccctaagtttcttcaagtcgaagagtactgattctttgaaagacccttatgtgcctaatgattttgctgatgatggttctaatgcctaatgtcctttgggttgttctggtgaatgaatgaaagagttttgataaaagcaactttaaaattttccaatgtgaatnaattaaagtcnaagntaccctaagggagaaaaaattat

SEQ ID NO: 99727 - DNA, 242 bp, Triticum aestivum
  unsure (1)..(242): unsure at all n locations
  Clone ID: PAT_TA_99727
gcctcgtgccccactctggcctccgcccccttcctcccgtcgctccccagtccaaaccacaggcgcctctccctccgctaccccgctcgccgtctcggggtggccgcctccgcggctcctaagggcgcggcggcgtcggaggcggcgagggagcgccggcgtttcctggagcgctacggcctcaaccctgacgacttcgaggaggatgccgaagccggattccaagggaaagaganggagga

SEQ ID NO: 99728 - DNA, 244 bp, Triticum aestivum
  Clone ID: PAT_TA_99728
ggtctcccattcgtcacccatctccacgtttccatcccgaagttgtgcgctagcaatggcgacatccgatcgcatagaatgggggctctcgtttggatttctgggatgttgctggtgtctgcattacaatttgtggtggccactaggtctcttcccttcggtgtctcaggtgttctttaatatgggcaatcaagacttcatctcctagaaaaaaaaaaaaaaaaaaaaaaaaaaaaaaaaaaaa

SEQ ID NO: 99729 - DNA, 470 bp, Triticum aestivum
  unsure (1)..(470): unsure at all n locations
  Clone ID: PAT_TA_99729
gaccgtcttccctcgcaaacaacacaccccgcgtaaatccacaatgcatccccatctccacaccgaagaagtccaaaagaactgcgcagacgtcgtcgcggcgctggaagaatgccataaccgcggcttcatctggaaagtaacagggaattgcaccgacgcgaaatacaaagtcaacatgtgcctgcgcggcctacgactcgaagcggaacaaagcagaatcgcgaggcggccaagggagaaagaggggagaaagattacaagaaagggtgtgggaaagggagtttnggttnagaaacnaaattgaagttttgaggggaaagaagtngcaaccaatngggccaagccgaaagaanacatttgcaataccggatgggggannttnacggggtnacgaaacnaacaaccgaagcttttcggggcnnccttgtattaatacnaaatgttggaantcaaggcntttaccggga

SEQ ID NO: 99730 - DNA, 436 bp, Triticum aestivum
  unsure (1)..(436): unsure at all n locations
  Clone ID: PAT_TA_99730
ggtgccaattccagaaactattctatgctctaagcgagcagaagcgagagaaagaagagtaactaaactgcccagcgctgcaagctcttcgtcgccatggtcagccacttcacgccgcttgaccaaaattgaccaacaccaactatctanggttgatctccaaaccaagcgggttgtagccatnatccttggcatgtacgactccaaaagtcntccaaaaactccanttccatccncttcgttcctancctggnccaattgcngcacggggaatcaacgtttatatctccaatctcnaatgggacggggaaacnggattccaaagtcaaaagaatgggnatggatacantatgggtggaagnttttcccaatncgctcccnaaaagnnttgtccgtntnaactcaacggcaangggnaattnggnaaaaaaatttt

SEQ ID NO: 99731 - DNA, 431 bp, Triticum aestivum
  unsure (1)..(431): unsure at all n locations
  Clone ID: PAT_TA_99731
gcctccaccccccaacccatctgctcgccgcatctggcatttcgcgcggcggcgtcacccccagccgccgttctgccatcgccgcgcccgccgtcctgctcaacacagcgcacgcactgcgcttcgcacacaggcagcacgttggcgccactgcaccgcaccgtggcagcccgttgcacccccaattccttccgcggaaggatataaagattgcacacgtggttgccaggcactcatcagagtcaatcgtctacaagaagtggtttcctttccccctcatggtgcacttcctaagaaggatggagataaaggcagatcacatttggaatgctggctaatggctgctggctggtttcgattcaacacatagctcctaatgggtacttggagaaagcaaggggaaatgataattttatcaatncttcangggg

SEQ ID NO: 99732 - DNA, 413 bp, Triticum aestivum
  unsure (1)..(413): unsure at all n locations
  Clone ID: PAT_TA_99732
gcctcgtgccgaattcggcacgaggaacacacgcgcttttcaaaaaatgcctcaatccaccaacacgaccgcgactgaggagagatctcagccatggcaggcgatgcaggaagtccaaaccctgttcgaaccggagatgcctgccgccgctcttggtgccaatgccgagtccaacaagattgaagaagaagagcctttgaagcccaatttgttcaagaccgtcgtgaattccgcgactaccaacattgcgaatgtggaggagcactgagaaccatgtgatcatcaatactcgggactgttgaagggaggatttggcctgaccgacccattagtcattcctttgctatatacgtatactaactagccttctccctctctcctttgtagagaggacaatcaatcatttctgactn

SEQ ID NO: 99733 - DNA, 415 bp, Triticum aestivum
  unsure (1)..(415): unsure at all n locations
  Clone ID: PAT_TA_99733
gcaacgatcggcttgtcctctcaaggtcttggagcgaatcatgtctgaatgcacctccaagcagaagattaatacagacttacatggctttcttttctgtgtcaaaggcttgattgatgctctatatcatttaattctcaatgcatctcaggaggagccccaagttgttaattataagaagcgcgtatctggagcagagacattcataccgctcgtccaatacgtcagtagactgaaaccagttatgcacatcgtaaatcctgttggcgaagatgaggggaaggacataccaggtggtgacaagaagaaggcaagcgcctcatggcttcactcatcaaaactctgcatgatttccacanagctgggaaagtgcccccaagcaattttgcccatcagacattgncgtgacatctac

SEQ ID NO: 99734 - DNA, 416 bp, Triticum aestivum
  unsure (1)..(416): unsure at all n locations
  Clone ID: PAT_TA_99734
gaggacatcaaagtgtgggaggttgcagccttgcaggagattagccttaccttggcaaattagcttgcggccctaaagctgtttatgcacttttcccatggtataatataagaaacaaaatcaatttattggatcacaatcatatctcggagtatctgcagcactgtaagtgatcttgtatagttggaatgttacatttcactttaattgctttgctgaatgtgcggactaagaaaatttcagtttctcctgtcatcaataagtgttataagatttagattattaaattcaggaaaaattcaaaatatatgagagcactaaccatgtttcggttccttgactgagggacgtacgaacttgcaaaaagcacgaagcatagaagcgaaacaaaggagantattgaaaggggantaagc

SEQ ID NO: 99735 - DNA, 402 bp, Triticum aestivum
  unsure (1)..(402): unsure at all n locations
  Clone ID: PAT_TA_99735
gccaccttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaaagcaggtcgactacttgatccgctccaagtggggtgccctgcctcgagttcaagcaaggttggcttcggttttccgtgaagcanaaacaagctccccccggggtacnacgatgggccgaatactgggacaaatgtnggaaagcttggctatngtt

SEQ ID NO: 99736 - DNA, 431 bp, Triticum aestivum
  unsure (1)..(431): unsure at all n locations
  Clone ID: PAT_TA_99736
ggtcctttccaactcgcttggctcaccgacgtcgcgacggctatggccacgtcagctcggatctgcgtccctccagtcctagctcgccggcgttgcggatagcaatcacctcaccctcctcgtggtttgctccgccgcctaccctgctctgtacatctcaaagcctcccgtttggtccgatccaacgattgtgggtccggaggcagtgccaccctccgacggcaggtgcagccccgcccaatcgccttccgacatggtggctttgactaaatgcgggcttcctcaaccttcactccaanaaaacggggggctatggggaattgctcaagcccttcgggccgggggtgaaatccctgcccgggttgcccggtgctgggaaacnggcgggcgttctggcgggatgttcgtttaatcntccttaaagaacgttg

SEQ ID NO: 99737 - DNA, 364 bp, Triticum aestivum
  Clone ID: PAT_TA_99737
gcgtcagcgagcagcggcagccatggcttcagcaagcatcaggaaataggtggctcagactgagatggggagcaacaaatccatgccgttctgtacctgctcgccctgtttttaggaatctctgtagctatcccctgtttttatttttatttttgcgagaaatcccctggttaattggtacccgcccatcgatccaggaagttattgtaaaaaaaatatatccaggaagtttattgtacagcttctctgtcttccaagatgtaaccaagatgtttgtcttccaggattatgaagtaaacttcctggctcgactaagatgtattttcttttttgaaatatataaccaagaagttggatattaagt

SEQ ID NO: 99738 - DNA, 413 bp, Triticum aestivum
  unsure (1)..(413): unsure at all n locations
  Clone ID: PAT_TA_99738
ggaagattcggctgcggacccggaaagagcgttggaattgtcggagtcggcggtctcggccatttcggagtcctcttcgccaaagcccttggtgccgacaaggttgtaggaatcagccggaaagctgagaagcgcgacgatgtgctcaagctaggcgctgacgcctacatcgccaccgacgaggacgaagactgggctaagcacaacgccaacacactcgaccttatcatctgtactgtctctaagcgcgaagatgcctcttactggctaccttantatgctcaagaaccacggtgatttcgtccaagtcggagcgccanatggngggngagttgccccctatcaacgcnttcaccctgctcaatgaagggcatcaagattggcggtantggtatcggtgcgccttgggaaaa

SEQ ID NO: 99739 - DNA, 421 bp, Triticum aestivum
  unsure (1)..(421): unsure at all n locations
  Clone ID: PAT_TA_99739
gccaaaccgccgagtctctccttcgttactctctcagagacaagcagcacaacaccgcaaccatggcggataacgacgctcccgttaccctgcgaactcgcaagttcatccgcaaccccctgcttggccgcaagcagatggtggttgacatcctccccccggccgtgccaacatctccaagactgagctcagcgagaagcttgccagcctgtacaaggcccagaaggagcaggtccaaggtctttggcctgcgcacccagttcggtggcggcaagaccaccgggcttcgccctcatctacgactccccccgagggctctgaagaagttcgagcccaagtaccgcctgatcgggtcgggactcncctacaaaccccgagcgtgncaanaagacaacaagcgcaaggcagcgcaagaaaccgg

SEQ ID NO: 99740 - DNA, 419 bp, Triticum aestivum
  unsure (1)..(419): unsure at all n locations
  Clone ID: PAT_TA_99740
gctcgctttaataaactttatttataatgcttggtcgtggaggagcagctgatggagatcctgattgtactgaagttttagaagataattctaaaagtattcttatgggtattatcagccaattgagaaaagacatggatttacacagagttactttacccacctttgtacttgaaccaaggtcaatgttagaaagagtgacagactttatgagtcatcctgacttattattaagaagccagtaaaaaaacagatccaactgttagatttcttgacgtccgttcgttatttcttaacaggatggcatatcaaaccaaagggagtgaaaaaaccatacaatcccgtgttgggcgaagttctttccatgcaaatatcaataatagtaatggggactggaagccaatatntaaaagccngaa

SEQ ID NO: 99741 - DNA, 434 bp, Triticum aestivum
  unsure (1)..(434): unsure at all n locations
  Clone ID: PAT_TA_99741
gcaagaaatggcttcccgggcaaccgacgactccccctcctcctctggggaagagtcggatgcgcatgacggtgcaagtgggggcggcattgatcgtgttccgcacctggccaagggcttagcccgatacgcgctatcgtgtgagcattcgcgaaggcccattaaacgtcangacattaacgaaagagtgcttgtccagcatactcgattgttcaaacaagttttcgcccacgccaataaccaagctcatccatgtctttggagtgcaactagtcgaagctccccanagcgggagaaagtgacactgcggcaaaaagcgcgcggcanccggcaacggnaacaacggcttcgtcaaacggtccggaatctcaanaccaaaatcatcccaancgcaatggggtcctggcaananttgttcctaacccggatnaatn

SEQ ID NO: 99742 - DNA, 414 bp, Triticum aestivum
  unsure (1)..(414): unsure at all n locations
  Clone ID: PAT_TA_99742
gcacatttcatctatactgtctttctcatgtctactgatggtttctcttctccctttttccacggcttatatcgatgaagctgcatcactcgtgaagtcttctggttttctttccatatcagagagctgtttgatttctatgtatatgtagtcattctctttctacctatactactttgaacaaagggcacaatttgtattgacgagttgaatccatcatgagtcgccagcccagattggatacttcagtacgccagcaggtctactcttatgtcgaaactcccatcgaattgagtccgcctgggtttccgccgttcaagattctagagacatcaccacagagcangccactgtctctaatgattaaaacttcgactactaaccccaagtcaacaggggaaactccacacatng

SEQ ID NO: 99743 - DNA, 415 bp, Triticum aestivum
  unsure (1)..(415): unsure at all n locations
  Clone ID: PAT_TA_99743
gctgcctccctgctcaacaatcattcagcatccactacagtagactgcaacactgcatatttgctactgcaattaatggcaccgcacgctactgacgacggcaacaacatgagctctgaagcgcctatgaccaatggcgagacgcccacctccaaggctctatcgcatctgcactcctaccctgtagttcacgacagtgttgagaccttcaagtccaacccctatggttcgcgcgccttgaacctcgccaacaacacctaccagtccatcgtcgcaccctttcacccatacttgcgcacaccctactcctacatctcaccctacctggcacgcgccgaccagctcggggactctggcctatccactctagagacacacctacccattgtcaagggaagacacttcaaaactgang

SEQ ID NO: 99744 - DNA, 311 bp, Triticum aestivum
  Clone ID: PAT_TA_99744
gcctcgtgccgaattcggcacgaggattaaattctacccaatcatgtatcttatctgcacaagagagatttcgaacgggtctgccaagcatacttgaactgcaataaacactcgacgaaaacgtttctgggactcagtgctacagtacaatttgcataactgtttatccttagtgctgcctgttagaacagggttgtgctgtgtgtgtagttatcatattgtataggggcttctttgcttatttcccttcatgtatatgtgctggcctgttggcccgatggaatataggctcacttcataaaaaaaaaaaa

SEQ ID NO: 99745 - DNA, 410 bp, Triticum aestivum
  Clone ID: PAT_TA_99745
ggccaatatgaagtacagcctgttttttgtcgcggctctcagccttttccaactcggctctgccgttgatcaaaagaagtcagccatcatttggtttgatgacgcctccactccagattcgtttgtcaaccaggtcaaggacaatatcctcaaagctggtggcaaaatcacacatgtctacacgatcatcaagggctttgctgtgatcgcgccggaaaaggcactctcgacggtacaagcaatgggatcggagcactcgattcgcgtggaggaggacgagatcgtatcatccctataaataatacgggtgacgttgtcgcagagttctgggcgcctgtgcctatctatgttcaacagcgagggataatactgctacagtcttgtcgggggcgtatggcgcgtatctaatt

SEQ ID NO: 99746 - DNA, 414 bp, Triticum aestivum
  unsure (1)..(414): unsure at all n locations
  Clone ID: PAT_TA_99746
ggattcatccagtcttaagtagactcgtcttctttcttcccttcttctctccttgcttcctgttaatattcccattattccaatctaacatctacgataccgtcgtattcatatcctcaacatgagctggcaaaagaccgtcctcaagcccggtaacggagctgatatgcccgcagtcggcgccaacgtcaagattgactacaccggctggctcagagaccccagcaacccggaccatgagaagggaaaggaattcgattcctccaaaggccgcggtccattggctacacccatcggcagaggtcgggttatcaagggttgggatgaaggtgttttgtccatgaccctcggtgaagaggccattttgaccattgactcgagctatngcctatggcgacaggggtttnccaaggg

SEQ ID NO: 99747 - DNA, 447 bp, Triticum aestivum
  unsure (1)..(447): unsure at all n locations
  Clone ID: PAT_TA_99747
gctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcaacacggaggccctcctcaagcaggtcgactacctgatccgctccaaatgggtgcctttgcctcgaagttcaagcaaaggttggggtttaatcttcccgttgaagcaacaacgcaatccccctggggtaactaacgaatnggccgggttactgggacaaatngtgggaagcctggcctaatgtttcggggtggcaaccgnacgcccaacan

SEQ ID NO: 99748 - DNA, 410 bp, Triticum aestivum
  Clone ID: PAT_TA_99748
ggttagattggaatccccttttcacaacctgcgaccttacgaattttcacagcacttcaagatgacagactaccgttacgagaaactgcaaaatgacttggatgaggacgaacgtcaacaaaattcgactgcaccttcgagcaaccgcaaggattcgtatcgtatacggatcctgatttcttgcggaattattttcataattactatggctttcttgatactgtgctgaagaaaccggcacactctggttgccatctaatgtgtcaaatgaggttgtaatatcttcaatgctcaaagtcgtggtttcgtgatgtcgtcgtgtttttgatgggttaagagaagactttcctatctcattttattgaagaatctgcagggtcatttacggtttatgcaattgcagagaagtt

SEQ ID NO: 99749 - DNA, 411 bp, Triticum aestivum
  unsure (1)..(411): unsure at all n locations
  Clone ID: PAT_TA_99749
gcctcgtgccgaattcggcacgaggtttttttttttttttttttttgtcaaccactagttgcggcactaaacaaacttaacaagaggagcattaatttgacaaatttcaagacatcaaaattaccttactgtagaaagcataaagaaatcgatcaacaaataacttcttatgcaccagagcttcatcctctgctcctatgcataagcttgcaacttcaactttctcagtggatactatgattcgacttcctttcttgttgtttgggaaacatgttttaatgcaatcccactcttcaatggtggtgtatgccattgagtacaattaggtaactcttgaaattcaaatatnccttgaaccaagagccaaactatcttctttcatcgttgcatcatcctcaaaacttggggccc

SEQ ID NO: 99750 - DNA, 383 bp, Triticum aestivum
  unsure (1)..(383): unsure at all n locations
  Clone ID: PAT_TA_99750
gcctcactcttaatttggcccctctctctttctccacacgactgatcactgcgatatcaccactgacgagatggcaccaaggtcctcgtcaactcgctactagatcgtccgaggcaggcacggccggccgtcaattgatctcccatggaggcgagcaagggaagcgatgggagctcgggcgcctcggcgagcaacgatgacagcacnggtggaggaggaaggacccggggccgtnnnatcgcacgangacgcctgcanggggaactctttgtcgtcctcgtccggtgcgcccctacgttcgctccaataacccgcngccctccgctggganggccgggggctccancactncgttcntcccgtgcnattncataaggctccgg

SEQ ID NO: 99751 - DNA, 416 bp, Triticum aestivum
  unsure (1)..(416): unsure at all n locations
  Clone ID: PAT_TA_99751
gctctctcccccacagctccctcgtcatccccgccactcctgccgcttcttctcctctcccagaccgcgtcagtcgtcagcgtcatccggatccccgccaggagctcgcgaccgagcaatccgaggagaatccacccagaaccaggaaaaattcggaacacaagtacaaagcagagacccgcctggagagacctcagggaccatccacatccatctcgactccaagcaacaagaagaaacacgaaagccagttgaaagagccagatcacaagcatggataggacatcaaatgtggtattggatatcgagggcctgcctcagcaacctgataaatgctgcactgggaagtccaaaaatgaccagagccctgtcgcgtaagggtccaaaccgccctgaaaagaggggcggtgaaaanc

SEQ ID NO: 99752 - DNA, 431 bp, Triticum aestivum
  unsure (1)..(431): unsure at all n locations
  Clone ID: PAT_TA_99752
gcctcgtgccgaattcggcacgaggcacaccacacctgcgcctctgctctatccaccaccccaacccatcgtcgcccagcagcccagcacccttcaccctcgcacccaccacccaccacccagagacaacatggcccgattctctcaccgaggagcaggtctccgagttcaanggagcgccttctctctgtttgacaatggacggcnatgggccaaatcactnacaanagaagctggggcaaccgttatggcgctccgctcnggccaaaaatcccagccgagtctnagctccaaggacattgattaacngagtngggtnccngacaacaacnggaacaatggcttcccaaaatttctgancatgatggnnccgcaanatnaaaggcnccgactccganggangagattcgggaaacctttaanggccttct

SEQ ID NO: 99753 - DNA, 415 bp, Triticum aestivum
  unsure (1)..(415): unsure at all n locations
  Clone ID: PAT_TA_99753
gccaacatgtgttgtctcctcataaaggccggggagatgtccaagcagctcaaccaggtggaccagagtatatccagtataaactctgatgtgtcggttgccatcatggtctgcattgcgccgcacaccaagccacttaaactctaccaagtaccggatggacatggccgttcgctccaactggacaaacgaacacggagtgtaccacatacaatttctgaagttgccattgagatcaaggtagcgttggacaaagttcagaggaacaaggcaaagtgtaatgaaattgaaaagcgtgtgaatggagtcaatgccctcctttcacantttgggaataaaagaactcatgaagggaccatacatgaaggctttaataaaaaagctacaatacaaccctttgcaatgctcccacact

SEQ ID NO: 99754 - DNA, 468 bp, Triticum aestivum
  unsure (1)..(468): unsure at all n locations
  Clone ID: PAT_TA_99754
gcatacttccagaaactactgaatatcctcttagcgaccaatcatggcgacaatgaaggatgagaagctgagcttttctgagaagcaagagaagctggcggtccacattagatcggtcgatatgaccgaggatatgcagcaggaggccattgaagttgcaacggaagctatggagaaatttcacatggaaaaggatatcgcacaatacattaagaaagagttcgactcacgcaagggcgctacatggcattgcatagtcggtcgcaacttcggcagttttgtaacccatgagacgaaacatttcatctacttctacctcggncactgcgctatcctccttttcaaaacccaatgatatcccgcaccgtcaaacttccgaacccgaggngattggcgattggtaaaaaaacctggtaagaaatacgggccatgatggggacgggaacgaaagggaattataagtggcnt

SEQ ID NO: 99755 - DNA, 490 bp, Triticum aestivum
  unsure (1)..(490): unsure at all n locations
  Clone ID: PAT_TA_99755
ttttnttttttttttgcggatagaatctctatattacgtctttctattgtanatgtatgtaaatgtaaatgcaacangaanagaatatagagctccatttactgcgtcctcatctccttatcctcctcaacagtctgtactgaggggtcctcngcgagcgagtggactgtgccctcagggtactcaacggnaaaggccttgatcagggtgtactcgngggtgatcttgccgccggcatccttagccttctgcttggctgcggcaagctggtcatcggccacatcgtccttgagggtgacaatgaaagaaggcatcttgaatatggtaanacnttgataggtgtaagttgttgtgaatgtggatcctcctncccaanntccgcacnaagggnctgaatngnntcctccgcaatcaaaagtgcattcanggncnaaggatgacctggnttaataaaaannaacnaaggatggcaaatnaaanggaactccnn

SEQ ID NO: 99756 - DNA, 476 bp, Triticum aestivum
  unsure (1)..(476): unsure at all n locations
  Clone ID: PAT_TA_99756
ccactactaactaatccttctatacaagccaatagtcaatatgcctaaggagaagactactcgcaagacgaagcgcgctgccggtgagggcaagagaaagaaggaccctaatgcccctaagcgcggtctttctgcctacatgttctttgccaatgagaaccgtgagcgcgtccgggacgagaacccaggcattgccttcggcgccctgggtcgtaagctcggtgagctgtggaagggattgagcgactccgagcgaaagccatatgaagacaaggctgctgccgacaagaagcgttacgagggccaaaagggcaactacttggctgggggggacgacnaagaaaaatcttcccaaanccttttccttttaaccttccttccttccgaggctcaatgggaaagaacaaaaaggggacaagaatcaacccncaagggaaggataanatttggntangggaantttcnaatccgccggg

SEQ ID NO: 99757 - DNA, 377 bp, Triticum aestivum
  unsure (1)..(377): unsure at all n locations
  Clone ID: PAT_TA_99757
gagtcatcgaacacccaacgaccgcaacctacaacttcgaacgactcatcacacccatcaacaaccgccaatatgggaaaggttcacggatccctcgctcgtgccggaaaggtcaagtctcaaacccccaaggttgagccccaggagaagaagaagacccccaagggccgcgccaagaagaggctcacatacacccgccgtttcgtgaacgtcaccatgaccggtggcaagcgcaagatgaaccctaacccaacctcataagccaaacactagaggaagggcgaacgaaacgagcactatgagctagagaaaacggtcatgaattccgtttcttcaaggatggctatgactctgggatnaaagggaaatgggaatca

SEQ ID NO: 99758 - DNA, 343 bp, Triticum aestivum
  unsure (1)..(343): unsure at all n locations
  Clone ID: PAT_TA_99758
gccgcgttcccatttccagtccaccgacagaccaatcaatcatggagttcccgcatcgccacggncacggccacggtcgccgcgacgacgacgacgaanaccgccgcgcccccgccccctacggtcgccacgagcccgacgcgtanggcgcccctcccccgtcctacggccgccgccccgacnacgacgccggtgatgcctacggncgccaccctcccgccgcctacggcgctcctcccccgtcctacggtggcccgcctcccgcntacgggggcggncgcgaggacnaantatngcggccgcgccccggnatanggtgnaccccggtccccgggctaanggt

SEQ ID NO: 99759 - DNA, 460 bp, Triticum aestivum
  unsure (1)..(460): unsure at all n locations
  Clone ID: PAT_TA_99759
gcgaacgccaacaccgcacatcaggagccatgggtatcgatttggaccgtcaccatgtgcgcagcacacaccgaaaggcgcccaagagcgagaacgtctaccttcagctcttggtgaagctttaccgcttcttggcccgtcgtaccgatgccaacttcaacaaggtcgtcctccgacgccttttcatgtcccgcacaaaccgacctcccgtcagcttgtctcgcatcgtctccaatgtgactgaggaacagaagggaaagaccgtggtcgttgttggaactgtcaacgacgacaaccgcatgttgactgtccccaagctctccattggcgcccttcgttttactgctaacggccgcgcccgtntccaaaangncggtggggagaatctcaatccttgaacaantcgctccccggtggtcctaacggntccaaaaatccccntggtccgtngnaccaaana

SEQ ID NO: 99760 - DNA, 475 bp, Triticum aestivum
  unsure (1)..(475): unsure at all n locations
  Clone ID: PAT_TA_99760
tgaaaaaggagcacattcgagttttgcaacaattcaatcaagaaacggctacgtgaacattactaccaccgaagactacaccatggatgaatcgccgcgccgaataaacgacgatcttcagtttattacggccctcatagacggcagatagacgagacaactgatgcgagcgacacctatacatgctgagtggtcgccaaatgctagaccgcacctgcgtacatactgcacatatggagttcaaggagttcaataatttgcgtttcgggatggacgtgacctgggctattaattattcaacctcctaccttctatccggtcaaaccttttccgatngatggnaagcactcctccgggctatcaacatccggcaatanatnaagcgggggcgantattcctaagggaaggncaaatnccacctccngccggggtnnaaatgggtcaaaagggcattttggggggaaanattaacgg

SEQ ID NO: 99761 - DNA, 473 bp, Triticum aestivum
  unsure (1)..(473): unsure at all n locations
  Clone ID: PAT_TA_99761
gaaatccccagccaatctcgtctccgatcgactccaggctcgtcggatcctcctcccccaccgcctcaagatgcaagatcttcgtgaagaccctcaccggcangaccatcacccttgaggttgagagctccgacaccactgacaacgtcaaggccaaagatccaaggacaaggagggaattcccccggaccaagcaagcgcctgatnttttgctgggaaagcaacttggngggatngggcgtnaccctcccccggactnaaacaattcaagaagggagtccaacctccaatcttggcctngggtntggggcgggtgggnattgaanattttccgggaagactcccancgggaagaacaacancccttggggggtgggagntccggcaacaaccaaaatgnnaagggcaaagnttcaagacaaaggggggggantnctccggggcaaanaanggcttntnttncctggggaaag

SEQ ID NO: 99762 - DNA, 471 bp, Triticum aestivum
  unsure (1)..(471): unsure at all n locations
  Clone ID: PAT_TA_99762
gcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcaacacggngggcctcctcaagcaggtcgactacctgatccgctccaantgggtgncttgcctccaagttcaacaagggtgggtttatcttcccgtggagcaaaacgcatncccttgggtactaacgatgggcgggtactggacaatgtgggaactgnctntgttcgggtggaacgacgccaagcaagtngatcaaacganggtgggnggaggncaaaaaaaggggtaacct

SEQ ID NO: 99763 - DNA, 471 bp, Triticum aestivum
  unsure (1)..(471): unsure at all n locations
  Clone ID: PAT_TA_99763
gttccgatacagcgcaaccgccgccaacaccactcctagcgagtcctcgccgccggagaagcagcaagaagatggccggaaggaagggtggcgacaggaagaaggcggtgacccgctccgtgaaggctgggctccagttccccgtcggccgcatcgggcgctacctcaagaagggccgctacgcccagcgcgtcggctccggcgcccccgtctacctcgccgccgtcctcgagtacctcgccgccgaggtcctggagcttgccggcaacgcggccaaggacaacaagaagacccgcatcatcccgcgccacctgctgctggncgtccgcaacgaccaagagctcggcangctgctggncggcgtcaacatcccccacgggggnggtgatccccaacatcaactnccgttgctgctccccaaagaaattcggccgccggccgcccnaagaaaggagggcaagntcgcccaaa

SEQ ID NO: 99764 - DNA, 463 bp, Triticum aestivum
  unsure (1)..(463): unsure at all n locations
  Clone ID: PAT_TA_99764
ggaggagtgccaaaagagggtgcgtcggccgcatgatcgagcttgtacacactaccgcagatcgagcggctggttgcgtatttgtatttatccggaggaattaatggaatgaattgcactacattgattgcaaaagtaggtcgcgtgcgtgtgagtagaagtgccgaaactccatctccatctccacaaattgtacacaagccgctggtgacacacaactggtaacgtgcggcaaccaagggaactatgacggggcaaccgccaagggtcgtgttccggttcaaccaagcggnggtcgccaaagatgggggnggncctccgtgggctccaagccaaagnccaaacgtcctgtcatncaagggctaatccatnaattnaaancctccccgggncggctcaaagggancgggaagggccccctccaatacaatcaagngngggaattgntccaaaaacgggnggg

SEQ ID NO: 99765 - DNA, 463 bp, Triticum aestivum
  unsure (1)..(463): unsure at all n locations
  Clone ID: PAT_TA_99765
ggcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcaacaaggntgggttcatcttccgtgagcaaaacgcatctcctgggtactacgatggnccggtattggacaatgtgggaactgcctaatgttcgggtgcactgacgccacaaaagtgatcaacnaaggnggggangncaagaaaggatnacctgacgccgtt

SEQ ID NO: 99766 - DNA, 466 bp, Triticum aestivum
  unsure (1)..(466): unsure at all n locations
  Clone ID: PAT_TA_99766
ggntttttttttttttttttttttttgaanggaccgagtaatgtcttttttttgttcttcggattagaagacccaatctatatgcctagcgttccatttatacccatgacgcgatttggttcgcccgatcgatgtcctcgtacgtctcccgcttctcggtttcacctccgcttggccgcctcaacctttttcaagctcttccttgagctgattcgaaaagtcatcgcttgtgtcgtcgtcgtcccaagctctcctcccacaggtgcttggtttcgccgttgcgctgggcggcttcggtttggtcggngggccaatccgtcgaatgggaaaagcttccaattcntcggccctcncctanggnaaggggnttctggtcgggcttctgctgntccgtttgaggggggactgntcaaaggtccgngaacttggggcnccgggggggggtgaagccaagggngggaggggg

SEQ ID NO: 99767 - DNA, 463 bp, Triticum aestivum
  unsure (1)..(463): unsure at all n locations
  Clone ID: PAT_TA_99767
ggcgagacacgcgccgctgccgcctctgcggcccggttgtccggtccggggggcaacgggccgccggcgccgcaagcaaccggagccggaggcggagccatgccattccaccgggcgcacggtttccggagctcacggaaggaatgtaagaaacaaaaagcggcagtgcggcgcacggaaattccttgcatttcggctcacgctggcgcgcgtcagctggtttccggccgtggagggcatggaatggcatcgtcgcagcaccccactctgaggccatgcctctgctctgttctgctgtgctggtaatgttcgtgacttgccgagcgcaacgggaagccgctactttggcttgggttcgcaaggcatcccatggcgtgcgcngctggctggctggctggntttncgtnggngcccgtgcaatcgctccantaatgttttgccaacgcaaagtccaacaaattcg

SEQ ID NO: 99768 - DNA, 462 bp, Triticum aestivum
  unsure (1)..(462): unsure at all n locations
  Clone ID: PAT_TA_99768
ggtcctattttctgtgtggtcgaacaggaaagctaaatgtacagtttatttgctcggcaccatttattgtgccacatagaagtacatctttttcttattttttctaatgcaatcatcaatacagtaccttagttaaccttcccaatttttgttctctttttggtcatacattaggattattgtggattttctgaaggtgttggcgggggttgcacggcatgttccgtctggtttcaggagtgtgtgctgcacctgaaaaaatttctcgggttgtctctctacatatttccacgttagctgtgatattttatttattgctctgcaatcgacaagtttgacctcaatgctaaggcaacctcaaccaagttgcctcttctaacaaaggntgagaatgcaacaacaagaagttttccttttacaattaaggggaataanaaaaacctttccttttccaaaaagggg

SEQ ID NO: 99769 - DNA, 385 bp, Triticum aestivum
  unsure (1)..(385): unsure at all n locations
  Clone ID: PAT_TA_99769
gctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaaagaagttcgagaacctgtcctacttgccaacggtcaanaaggngggcctcctcaagcaagtcgactaactgatccgctccaagtgggtgncttgcctcnagttcaanaagggtgggttcaacttccgtgagcaaaaagnatcccctgggtactaatatgggcggtnctgggcaatgt

SEQ ID NO: 99770 - DNA, 467 bp, Triticum aestivum
  unsure (1)..(467): unsure at all n locations
  Clone ID: PAT_TA_99770
ggtaatcttctcagtcgactcgttcccgatctgaaatacatggatgccgccggcgtcgaccggctgagcgacctgacggactgcctgctccacaccatcctctcccgcctggaggcccggcaggtcgtgcaaacctgcgtgctgtcgtcgaggtggcgccgcctctggctggccgtcccgtgcctcgacatcgacggcggggaggaccaaagagggggaagatgaagggaggagcggcacaagaagctggacgatttcgtcgacaacctcttgcttcgcgtaacaactgcgcctcctcgccgctgcaaaacctgcnggtgagcgtcncctccccgcgggctctgtnggaggnggggccaacaacgaacggcnttcttncaactngggcggccaaancaaatgggttaanccttggctccaatgctccccgggggtggtcnaantaancgggatcaaagctngccttc

SEQ ID NO: 99771 - DNA, 475 bp, Triticum aestivum
  unsure (1)..(475): unsure at all n locations
  Clone ID: PAT_TA_99771
gccatccagcgcaaccgccgccaacaccactcctcgagagtcctcgccgccggagaagtagcacgcaggatggccggaaggaagggcggcgacaggaagaaggcggtgacccgctccgtgaaggccgggctccagttccccgtcggccgcatcgggcgctacctcaagaagggccgctacgcccagcgcgtcggctccggngcccccgtctacctcgccgccgtcctcgantacctcgccgccgaggtcctggagctcnccggcnacgccgccaaggacaacaagaanaaccgcatcatcccgcgccanctggtgntcgccgtccgcaaacgaaccanganctccgcaaggctnntncgcgggggcaccatcgcccaagggggggngtgatncccaaaantaaantcccgtnntnggtccccnaaagaaatccccccgnccgccgcccgantaanggagggcaaanccccccaat

SEQ ID NO: 99772 - DNA, 454 bp, Triticum aestivum
  unsure (1)..(454): unsure at all n locations
  Clone ID: PAT_TA_99772
gattttttcaaaatagtttattaaatggctcctatttccaaacccgagattacttcaaacattcagtgggttgctcaaatgaatgttgatgttgagccaactcacggtcgtaaaacatccatcattggaaccataggtcctaaaaccaatagcgttgatatgattactcaacttagaaacgctgggttaaatgttgttcgtatgaacttttctcatggttcttatgaatatcatcaatctgtcattgaaaaactcgcaaaagcgttgagatttatcccggacgtcctgttgccattgcacttggacaacaaaggtcctgaaattcgtactgggaaaatatggaagggataatggcccgagaatcctaaatggctattggncnaccgaaaatggacctttagtggtttgacggancaatatggctggatgaagggaaaccgaaggaaattattnn

SEQ ID NO: 99773 - DNA, 468 bp, Triticum aestivum
  unsure (1)..(468): unsure at all n locations
  Clone ID: PAT_TA_99773
gcacgcacaagcagcggcgaagccttctcagctgccttcttcctcctccctctctttctgccatgaagccccctcacttcaccggggaggccgccgccggcgcctcatgggctcacgaggtcaagcaggccctccgtgacaagctccggtgggcacccgccgcgggcaccacgggcaccggcggccacggngccgcgaggccgccgacggcctcctcggctgtgaccgccgagccggcggcgcagccggccacggtgcccgactgccgggggctttggnggccgccgaggaccccatcangagggttcatgttcttgggccccctggggggccaaaacatnnaacggaaaaagcaangttgcacgcaccgcaacgggncaatgccctgtcccgggacccttggnaattggcaacctccaanccaaaaantatgggncttacntanaatatataataatgtnggnccng

SEQ ID NO: 99774 - DNA, 633 bp, Triticum aestivum
  unsure (1)..(633): unsure at all n locations
  Clone ID: PAT_TA_99774
gcctcgtgccgaattcggcacgaggcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgcttgccttgagttcagcaangtcgggttcatcttccgtgagcacaatgcgtctcccgggtactacgacgggcgctactgggacaatgtgggaaactgcctatgttcgggtggaacgacgccacaaaagttatnnaacgaaggtggagganggcaaanaaggagttacctgacgcgtacgtncgcatcatcggattcnaaaacatncncaagtgcaantgggtcagnttnattgcttcaaancaaccgggttggaaggagtccgggaaaggctanaaactcaatcaccaacgggccaaattnaaatgccattg

SEQ ID NO: 99775 - DNA, 614 bp, Triticum aestivum
  unsure (1)..(614): unsure at all n locations
  Clone ID: PAT_TA_99775
gtagtgacaccacacacaccacacacaaggagctccaccactttgatagaagaagatggccggcgcctcccctctcctcctgctctccttcctcctccttgtttcgatggcggtggcggaccagtgccacgacgacgaccatgccgccttggttgccatcgacaccgccatgggcagcccctaccacttcgcgtcttggacgcccgactccgcctgctgcgactggtacgacgttgactgtgatgccgacacgggccgcgtcgtcggtctccgcgtctaccaggacgccaacatgtccggcgccatcccggacgccatcggcaacctcaccttcctcgagaccctcaccctccaacacctcccgggcgtctccggtggcatcccggaatccctcgccacgctttcaacctctcggagctcacaatctcttacacgggtgtgtccggccggtccttccttctaagggcgctcaacgnaatcaacctcctcgactctcctanaaaacctcaacggggcatcccgcgtccctcgccgnnctcaacaagctctccaagaacaaactccggcgnaaaccgccttccgggggaaccggnggtcctnctccccaagcnccn

SEQ ID NO: 99776 - DNA, 446 bp, Triticum aestivum
  unsure (1)..(446): unsure at all n locations
  Clone ID: PAT_TA_99776
gcttgctgccatccatccatcttgacacattctcagcttgccatatctccgtgagagtatttcttttcatatagaggcctttacagaactagcacaacatgtttattgcgcgatcagaatacgaccgcggtatcaacaaccttcncccccggaaggccgtttgttccaaggtcgaatactccttagaagctatcaagcttggttcaactgccatcggagtagcaacttcagaaggcgtagtcctcggtgtcganaaacgagtcacctccaccctcctcgaaacgtcctccgtcgaaaagattgtcgaaatcgatcaacaatattggctgtgccaatgtccggtctacaagcccgatgcccgattcaatgaatgaaaattgcccgcggttgatgtcaanagccaccaattccaattttggcaaaaatccccntcngggtccangagn

SEQ ID NO: 99777 - DNA, 630 bp, Triticum aestivum
  unsure (1)..(630): unsure at all n locations
  Clone ID: PAT_TA_99777
gtgcattaaatagtgtcgtctagacacacagactactctcctctcactagatcaatctccactccattttctatctaattaattcagacagcatcgcatctcgcctccgttccccaaacctcaacaatcacttccaaccttttcaaagaatcaatcaatcaaaatgtcatcctcccgtgtcggtctacgattcctcgccaactcgcgcgcagccttccgcaacttccgtcaaaatgtcagcaacaacagcaaaggattccgattccagagcacggatgctagtgccgcggctgcagagcaacagagtaccttccaagaggatgtggaatagtcctgttggtgtgaagacggttcatttctgggctcccgttatgaagtgggtctctcgttatcgcaggtatctccgacctagcccgtcccgccgaaaaactctccctgaccaaaaactcgctctaatggcaaccgggggaatctggactcgatggngttcatcaattaagcccaagaanatgtattgggcgcngtaacttctccntgcttgaacggggttcnacaaagtantagaatnttcatctgggngacgaaccaaganggtnggccgctgaancngcaaggtatgatgaaaaagtt

SEQ ID NO: 99778 - DNA, 568 bp, Triticum aestivum
  unsure (1)..(568): unsure at all n locations
  Clone ID: PAT_TA_99778
gctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgaagcacaatgcgtctcccgggtactacgacgggcgctactgggacaatgtgggaagctgnctatgttcgggtggaaccgacgcacaaanggtgatcaacgaagtggaggagtcaaaaaaggggtacctgaccgttagtccgcaacaacgggtttcanaaaaatggncaagtgnaatggntnaagttcattgcctnaaancaaccgggntggaagngtcccgnaanggctaaa

SEQ ID NO: 99779 - DNA, 286 bp, Triticum aestivum
  Clone ID: PAT_TA_99779
gctgtaagacaataggctttggggggaaccagcacaaccctctaggggtgacctatcatatatatatatataatgaggtggtatacaacgttacaatatacacatgtaaatacaatctaacaccctccctcaatcttagccactttctaatgaatctagaagggtaagattgcgcctgcaagtctcaaactgtggcaaaggcaatggcttggtgaagatgtcagcaagttgatccttggaagaaataaacttgatctgtagttgcttcaaaaaaaaaaaaaaaaaa

SEQ ID NO: 99780 - DNA, 620 bp, Triticum aestivum
  unsure (1)..(620): unsure at all n locations
  Clone ID: PAT_TA_99780
gccagcgctcccccctcctcaacaacctcccggcgcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgggagatccgcaagtaccagaagagcaccgagctgctcatccgcaagctacccttccagcgcctggtgagggagatcgcccaggacttcaagaccgacctccgcttccagtcctccgccgtctccggccctgcangagggccgccgagtcctanctcgtggggctcttcgagggacaacaacctctgcggcatccacgccaagcgcgtcacatcatgccaaaggacatcaactcgcccgncgcatccgtggagaganggctaagtctgttcgtcnnctctgttatcgtcgtcntaaccanntggggtcaagggtgaaatgngcgtgtttgnntgtcntttctggcaaggggggngtagggtcctgtttgaggtnaccnccttgtgccacaatancggnatgaaangttgtttctgtctaaaaaa

SEQ ID NO: 99781 - DNA, 628 bp, Triticum aestivum
  unsure (1)..(628): unsure at all n locations
  Clone ID: PAT_TA_99781
gcggtggcagtactacaagcgagtgacacaagttcttgcaccgatcagatccaacttctgcgcaagatgctggacaagctgtgggacgacgtggtggccgggcctcgcccggagacgggcctcgacaagctccgccgcgccgccgccacccaacccctcgccatcaacacagctgcaggggaggcgattaagcagtcgccgtcgatgccgacgaccccgaccacgccggtgacgccgtcgtcgtcgacgccgccgcgtggcggcagcgtgtggcggagcgttttccaacccgggaagcaacctgggcaacaaaaagctcggcgccaanctcntcgancggccgcaagccaactccccaaccgtctacgactgggttttacagcgacgaagaacaagnaccaaggagcaancaccggctnaattataagacccgngggccaaganaattgaaaaaaaggaanttcctgcgaacgccgncaatgnttggtgctcntttggntatctaaacctgcataacgtacgttgctgtctgaggntgcatgtanttgtcttgagcttcgtactacttatctacnaaggggcttggaaactttcttttcttgctccgnctannccctgcatgnnangg

SEQ ID NO: 99782 - DNA, 403 bp, Triticum aestivum
  unsure (1)..(403): unsure at all n locations
  Clone ID: PAT_TA_99782
gcaacttaaggtggagagatcgttgaagattggtgggttttatgccatgcactggccgagatacttggaagagaagatggctttgaagccagtgaataaagagatctttccaggaagtccatgggtaggcatgttgaaggagtatcagagagggaccgagagccggaatccttgggttaatactgaggatggaaagggggatgtcccgagacgcacggacttcncctgatctccccaaatctttacattcttgatttccccgttctggcgattctgctatttcgtttttccatgtaaggtgcgtccctaggtgaagaaacacactgggtcccgaagacaggtccacggttcggacactcggaaatgcttcttcttggaattgtcgagatataaccgacacaan

SEQ ID NO: 99783 - DNA, 643 bp, Triticum aestivum
  unsure (1)..(643): unsure at all n locations
  Clone ID: PAT_TA_99783
ggttttttttttttttttttatttttaagggtattttattgttttacaatgagctcgatggctcacgaaagaggaaaggttcttagaagcactttctgtggacgatagcgggaccagactcgtcgtactcttccttggagatccacatctgttggaaggtggacaaagaggccaagatagagccaccgatccagacggagtacttgcgctctgggggagcaatgatcttgatcttcatggtagaaggagcaagagcagtcaattccttttgcattctgtcggcaataccggggaacatggtagtancaacaagacaagacgactttcccgtagangtcctttccggatatcaacgtcncacttcaagatggagttgtaaggaagtttcgtnggatgccaagaaggactcccatacccaaagaaaagangggtgggaacaaaggcttcaagggnaacgggaaacgttccgttaccggatnggngatgannttgaccttaagggaantccttagctccttcccaaattgnnaaaaaatggaaacngnttgaatttcttgttnaaaggnccaaggggannttaanaaangnttccccngggggggccgggancaaattcccccanangggtnccnttanccccncc

SEQ ID NO: 99784 - DNA, 237 bp, Triticum aestivum
  unsure (1)..(237): unsure at all n locations
  Clone ID: PAT_TA_99784
ggcgtcctcgactctcgcgcccaatccatcgacttcaagccaccggcgatcaacaaccagctcaagactctccataaaccgtcaatatggttctcgcagttgaccttctcaaccccaccccggccntgnnggccgcaagcanaagctcaagancctcntggccaacccccgntccttcntcanggncgtcaagtgncccggntgnttcaacaacaacaacgtcttcncgcaagccaa

SEQ ID NO: 99785 - DNA, 640 bp, Triticum aestivum
  unsure (1)..(640): unsure at all n locations
  Clone ID: PAT_TA_99785
gatttttttctgcactaaaatacagaattactataactagttgttgaaaataatcgagttatctgaaccaatgcaagttttcgtaaagtctcttgaaggtaatactattaccttggatgtttcttccaacacctccattgctgtcgtcaagtctttgattgaagagcgtgaaggtcttcctgtcaattctcaatgcttgtcctatgctggtaagcctctcgttgaaggtgaacttgctctttatggcattgctaacaacaacaccttgcacttgaacgccgagttgttgggtggtgggtaagaagagaaagaagaagacctacactacacccaaagaagatnaagcataagcgcaagaagggtaagatgggcaatttgaagtactacaanggttgatgaatctggcaagattactcgtcctcgtcgcgaatgtcctaaacgccaacctgngggggctgggggcctttaggggcaaancanaaaggancggccaaanaatggngggaaaatggcaacttgacttaagtcctccaaaaangggggaaagtggcttaaagaagggactttcaaanaaacctccntttnttngaanaangaaaacngnttgtttttnnttaaaaanaaaaaaaaaaaaaaaaaa

SEQ ID NO: 99786 - DNA, 348 bp, Triticum aestivum
  Clone ID: PAT_TA_99786
gaaaataagtctggtcaacatgcgtctctcaaccatcgccctcttcatgacctatcttgccgctactacaactgtagctgccccaattgctgatgccccttcttcccccgaaaccgtcggcgtcgatgggacacaggagcatcatggcaatcttatttatgcttacgggtgtaacccaataatttgcaaaggtggtacggcagaggaggagtgattgtttccgcaaggttattattgatggagatgggtttggaaagggggaaggaggttgcttggatatctatcagctacttagttacctaggtagatatacataagtacccattgggatacatggacattcctgaa

SEQ ID NO: 99787 - DNA, 651 bp, Triticum aestivum
  unsure (1)..(651): unsure at all n locations
  Clone ID: PAT_TA_99787
ggcgctcggccgcgacatcaatccgccggcgcggcgatagatccaacatcgccgccggcaatccaatcttatcggtgtgtgtgctactccatcctgtgctggaagaatcaggagcacaccagcgcccgagcagtaatggtggcaagccgagcgacggcggctgggcggattccgatacgggactcacgccggagtcgagagtagctgctttcgcccggatccaaggccatggagtgccttgattgcaagaacccgtatgctgtgtgtagagatgtcgagggaccaagttgccacatatctgttccaatgacaactttctattggtttgaatctgtaagaccgagtcatcacgatgttgctctactgcttttcaaccttgacaaactgccatgcttttggtcccatcatttgcggtttgttccatgctgcaacangcaagttcttggagcatatattgaacaatatgcaatccgttgcgacaaaagaaaataagcctggtgggtaacccaaattttcncaacaaagannaactactgggggttatgaaanttatgtcggacaanggngataaaagggacaanaattaatgaaatccggttggnaaagggttcttgannantatcaatgcggcttggganaatgggnaaatnn

SEQ ID NO: 99788 - DNA, 610 bp, Triticum aestivum
  unsure (1)..(610): unsure at all n locations
  Clone ID: PAT_TA_99788
gctagtctcgagttttttttttttttttttttatttttcagaaccgtgttttgtttattttctctcatagtctctgacccctctcacgtcatcaaacatggccgaacaaattcctacctttaagcttgtcctcgtcggtgacggtggnactggaaagaccacattcgtcaagcgtcacttgactggagaattcgagaagaagtacattgccactttgggtgtggaagttcaccctcttggcttcaccaccaacttgggtgctattcagttcgatgtctgggacaccgctggtcaagagaagttcggtggccttcgngatgggatactacatcaacgggcagtgcggtatcatcaagttcgacgtgacgtccccattacctacangaacgttcccaactgggcaacgtgaacntggncccgggnccngggaaaanattcccaaatgntcccttnggggtnaaaagggccnacgtntanggnacganaggcaatggggaaaacnatcaaattccacgncaaagaagnacctttaatanaangaaaccccgcaaatcaattnaatttcnggaancccttctnggggttgtccgnaaacttttngtaaccaann

SEQ ID NO: 99789 - DNA, 409 bp, Triticum aestivum
  Clone ID: PAT_TA_99789
gcctcgtgcccgagaaactgcgcttttaatcagagaaatgttcggctatgcacgcgatcaccaattgttatttctagccatgcattatcttcatggatgaaatcgatgcaattggtgagagaagatttagtgagggaactagtgatgaccgtgagatccaacggacactgatggggcttcttattcggttagatggatttcatgatcttggcaagattaaattagtgtgatggtacaattaccaacattcatcggatgccacaatcaggggcggacctacattgagctacatacacaacattgcactcagaatttatgcttctcttcatggtgactcagctttgagtgcctccacgtttgaagatgatctcacaggaaacatgaattgaatgatgatagtacagattca

SEQ ID NO: 99790 - DNA, 572 bp, Triticum aestivum
  unsure (1)..(572): unsure at all n locations
  Clone ID: PAT_TA_99790
gtttcttaaagcctcttatttgattgtatgacctcttattgcactacattccatctttccaagttgattctcaaacatgtctaccatcacggaaaccaagaaaaacaccaatggccaagaccaacggagatgagagtctttctataagacttactgctccggtgaagaccgtgccactcaagctatctggagccctagatggttacgcccgcaaggagatctccccagtgatagggactgagttccttgatgctaacgttgtgggacatgttgcatgctcccaacgctgatgaactcctccgcgatcttgccatcatggtttcgcaagcgtgggttctgcgtcttccggngccaatccaacctcaagcaattgctgatgagaagctgttatgccaccgcattgggnagatcantacgggggcgtataactcttgccggntttatccaaccaanttttcaacaagggnggnggtgggnaggccggnaancccgatnctgaagncaatgtcncaancgcgcaanaattaanaacaaactgtattcccgnnaagggggtantccaaagggaagcg

SEQ ID NO: 99791 - DNA, 450 bp, Triticum aestivum
  unsure (1)..(450): unsure at all n locations
  Clone ID: PAT_TA_99791
gcaaaaacaaacaccacagcaggcatatttttataccttgtatttcatttatgcttttatagctagccgatctatatccagcaccttattgaaactcaatatgacctacctgtttaggcctcagaaccctttgggcgatgcccgcagggagccaaccaacggttctgttgatgatttactcaacattattgttatgcagaaaatttccgaacccgcggaagctgtatcttgcggctacttcgatcacaatcccagnccaaataanacgtcagcatactgccccaaatcaattgggccgacttagatgtctcgggatgatggaatttaaagacacttacaacnaagttggcaacaccaaanggtgcccatnctcctcaantncttgcatcccagccanggaaanaccccgaaggtggcaaaccttttggtatcangccaagtgacnaanac

SEQ ID NO: 99792 - DNA, 451 bp, Triticum aestivum
  unsure (1)..(451): unsure at all n locations
  Clone ID: PAT_TA_99792
cggctccatcccactcaccctcccctcttctcctctgcctcggtcacacatggaagggtgaggggggcggctcggcaggctccctggctgattctgcccatgggcatgcagctctgcccacgcgagcgtgcaactcgaccaacggggccttgcagttcggcccacggcaccgacggntttccgtcnaactctcgcttggacggcgacgcgacatgcagttcggcggccatatggttgcggtgcagtgcgccattgtgggcagttctgtgggcgtgtgcgcggcctccccctagccgtcgtgcgcaactgctatccttcgcggggcccgggcgcaccgtcgcaaccctttctcttctgtgcggcttcctccacaacatgcaacgtggatcgaatagattcccgggccgccgggagaacggtccgccgcaatggctctcggtngcgttttcnc

SEQ ID NO: 99793 - DNA, 449 bp, Triticum aestivum
  unsure (1)..(449): unsure at all n locations
  Clone ID: PAT_TA_99793
gacgacattgaccgtgccaagcaccatggtgtcgatgccatgagcactgatgacttgaagaagctcaacaagaacaagaagctcatcaagaagctcgcgaagaagtacgacgccttcgttgcctccgacgccctcatcaagcagattccccgtctcctcggacccggtctctccaaggccggaaagttccccacacccgtctcgcacgctgaggacctcgccaacaagatgaacgaagtcaagtccaccatcaagttccagttgaagaaggttctgtgcatgggtgtcgctatcgggcaacgttggcatgactgaggacgaagctgattggtaacatcatgttggggcatcaaactacctcggtcctcgcttcttaaagaaaggggctgggnaaaaaacgtggggctcctttgancatcaaagggncaaccaatgaagnccccccaagg

SEQ ID NO: 99794 - DNA, 618 bp, Triticum aestivum
  unsure (1)..(618): unsure at all n locations
  Clone ID: PAT_TA_99794
gctttctcacttctgcttcctggcccatctcaacgcgcattgggtcattgttcattgctcttcttcgagttgacaccacactcgcttgtcagaacagtggttatagtcttgttctctgcttttgcgctgtcgtcatcgattttacaagcccgcaaagaggacacaccacatctactgcttgattcactgtcctctcttcattcagaatgaaggctcttattctcgtcggagggtttggaacccgtctacgaccctcacactcacctcccaaaacctctgggcgaagttcgggaatcgcccaatgatcctccaacaaaggttgagaagcttggccgccgccggtggttactgaaattgttttggctgtcaactatcgaccggatattaatggccgcagcgttgangaantacgangaacaatataacatcattatcganttctnagccgatnctgngcccctgggtacggcgggtcccctgaaattggaanggaaatcccccggaaaggntgacncccaattttcgncctaaatccgacgtcanttggaataccnttcaaaaagctggttgatttanaaagccnaggnganaagggaaatttntcaccaaggcnacnan

SEQ ID NO: 99795 - DNA, 432 bp, Triticum aestivum
  unsure (1)..(432): unsure at all n locations
  Clone ID: PAT_TA_99795
gatcgatctttgagaaaagtcaatttgacagatagtcataatcgacgcttaagcaagatggttgcagacgctttggtgtaccacccctcggtggctcattatctacgctttctcgcaacaacactcggcagagacaaagccctccgaacaatccaatacttcgcccgcttctacgcctggtacctctttcgcaccaacaacccaacctctgcaatcgcaccctgggatgccctgaaaaaacaattcggcncacccgcaaaatcctgcgagctggtaaatttgtcgaacacatcaaagccgcctccgtggcctttgacaataaaagtccccgccggacgccgtgctgaagaatctgacggttggtcgccattgngggtatgccggttattnaccttggattctaacacgctcgttgatnccgttgggatttaa

SEQ ID NO: 99796 - DNA, 621 bp, Triticum aestivum
  unsure (1)..(621): unsure at all n locations
  Clone ID: PAT_TA_99796
gctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcangtcgactacctgatccgctccaagtgggtgcctttgcctcgagttcaacaaggttgggtttcatcttccgtgaagcacaaacgcaatcccttgggtactatgatggcggtactggacaatgtggaagctgctatgttcggtgcaaccgacgcaaaaaaagttgattaacgaggggggnggaggtcaanaaggagtaccctgaccctttgtccgcaataatcggattcaanaaaatgcgcaaggngaaatgggttaatttaaccnccttaaaccaccgggttgnaaggatncgggaanggctnaaaagtcacccacnaaaggcaatnttaagggcattgattttttaaacccnaatntt

SEQ ID NO: 99797 - DNA, 638 bp, Triticum aestivum
  unsure (1)..(638): unsure at all n locations
  Clone ID: PAT_TA_99797
gtggttcctttcttttctttcataaatctctcttgttttcatatttgtgtatattttccatcatcaaaacaggcttcacaattccttgatttcatggctaatggggttgcatgctgtaaaaatcagccgaagtacatattgtactctcattcttagtcttgtttcgtgtggaattacagagagcggtcggtgcagatgtggcttataaagttttatacttcaaatccagtacttcataaaaaaattcaaagtgtgcataggtttattgttttgtgttgtattcctggacttggtgtggtacgagctgctgaattttttttgggttttgggtttggctgtacctgcaaaattttgggnatggttaacactttagttatgctcttgagtancantgggaagggtcccaaactaacttcctcctatgacagacttggcaaanaaaaggnggaagctngacgaaanggaggacaacaaccaangatgagccgagaaccggtgccaacgggcctcaaggatgaaaagnaacgaacaaanggggcaacaaccnaaanaagcggcaaaaanggggntaancccngcaatccccccgggcaatgaaaaaaagggcctnaaaaaanctgnggggccccccgcaaaaa

SEQ ID NO: 99798 - DNA, 406 bp, Triticum aestivum
  unsure (1)..(406): unsure at all n locations
  Clone ID: PAT_TA_99798
gcctctctctcccctcgatccagagtacaccggcgcccaccccacctcgcctgtcggccccgcggcctcgctggccgccacctcgaccgccggnacacggnctcgcccgncgtccccggcccccgtcgcgccggctaccaagccacccgtcgccacggctgacctcagcgaccctaccccgtcgcccccgtcggccgccggtgccggccccttccctcgtcgcccccgtcggccgctggccccgtccccgttgcccccgcaggccgccggcaccttccctctccgcctctagcgacgcaaagcccgccccgttccgctttggccccgctgaatncaagccctaacaatgtngcccccngccgggccccaagtcccaatncctntaatgctngnttatgggcgcacn

SEQ ID NO: 99799 - DNA, 634 bp, Triticum aestivum
  unsure (1)..(634): unsure at all n locations
  Clone ID: PAT_TA_99799
ggaactctttggtactactggctctgtcaccatcaccaaggaagacactatcatcttgaacggtgctggtagcaaggactctattgctcaacgctgtgaacaaattcgtggtgctattgaagatcctagcacctctgaatatgaaaaggaaaagcttcaagaacgtcttgctaagctctctgggtgggtgttgctgtcatcaangttggtggttcctctgaaagtcgaagtcggtgaaaagaaagacaagattcgatgatgccttgtgtgccactcgtgctgctgttgaagaaaggnattgntcctggtggtggtgttgctccttttgaaggccgccaaanagncttgataaccttgaagggggntaactttgatnaanaactccggtatcaanattatccgtcaaagccaattcaaaaacccttgtcgtaccaattgttgataaatgctgggggggnaaaggttccnncccttgctgggaaaatttttnttngaaaaacccccctgaaaaanaacagggggggntaanggntcctccaacaaaanaatttnttaacaatgtttnaccgcggtattggccattccaacnaaaggttgtccgaacngccttgatggatgccncngggggtgccnc

SEQ ID NO: 99800 - DNA, 386 bp, Triticum aestivum
  unsure (1)..(386): unsure at all n locations
  Clone ID: PAT_TA_99800
gagaccgtggccgagttctcgcccaaggagcgngccctcttcctgcgcttcgtgtcgggccgcgagcggctggcgacgtccaagtcgcagaacgccttcaccgtgacgcgcctccacggcagcaccgacgccctgccccagtcggccacctgcttcttcaccctcaaactcccggcctacgcctcccgcgaggtcctcaagcacaagctgctcctcgccatctgcaactgcgcctccatcgacgctgacttccaggtccgccagcaatgatgctctcgcgatggatgaccggcggttccttctctcctcctacaccctctcttcttacatttttcaccccatccaaaacacactaaaactgttgtagtgtgcaacctcaaatgaag

SEQ ID NO: 99801 - DNA, 633 bp, Triticum aestivum
  unsure (1)..(633): unsure at all n locations
  Clone ID: PAT_TA_99801
gacaaagcgcaactagcactcaacgtaaccatctccctctccatcaccatcgccatcaccatcaccatgaagttctctttcgcactggcattcttcctgctcggcctggccctggcgttcggccagagcgtggacgtgggcatcggcgacgtcggcgcatcggcggacctgggcgacctctcggcatcggccagtgttggcgacaccggcgctgcggcctcggttgatggtggcgccacaaccaccaccgcgggcatcaccaccattgccgacaccaccgccggcaccacaacggccgcgaccaccaccggtgaagcgaccgttgccggagcgtacaagacagagcccaacgtcaccgtcgttgaatcggccgccaccgaggtggcccgcagtggtcaagtcgggcaacgcgattccgacangcgttgactactgtggaggtcaacgtggccccggtcatcgtgggctctacgcccgccaaaggacaacgtttcgtgggtggcaacgccaacaaaggacaacgtcatcggnggtggccgccaaaaacaangttggncaacgttcgcaacaactcntcggnttcgggctngccgtnccctttttaaactaattttggggaangtncggaatcaa

SEQ ID NO: 99802 - DNA, 618 bp, Triticum aestivum
  unsure (1)..(618): unsure at all n locations
  Clone ID: PAT_TA_99802
gcgacaacaccgccgagatgggtcactctcacggtttgcgcgccggtactcggtatgccttttctcgcgactttaagaagaagggttctatccctctttcgacctacttgaaggaataccgggtcggtgatatcgtcgacgttaagtgcaacggtgccgttcagcagggtttgccctacaagtactaccacggaaagactggtgtcgtctacaacgtgaccaagtctgccgtcggcgtcatcatctacaagcgtgtcggcaaccgctacctcgagaagcgcctcaacgtccgtgtcgagcacgttgcccactcccgctcccgcgaggagttcatcaaccgtgtcaaggagaacgccatcaagaagcgccaggccaaggagcaaggcactcacttgcacttgaagagacangctgtccagccccgtgacgctcangtcgtcgcctctgccgacaaaattccccgaganaattaacccattcccttaagaaaccanaatttacctttanaaacntttgcggattaatggtngggnttctggggggaaaaaaacttaacgggggggtttggtccttttccttaggnttggacccncaaaaacggnggaattgatgataana

SEQ ID NO: 99803 - DNA, 303 bp, Triticum aestivum
  unsure (1)..(303): unsure at all n locations
  Clone ID: PAT_TA_99803
gcaacaacctgttaataacgttatcgaagttccantgactaccttgactcctccttcttatcctgaaaacacaatgtctaccnctgctaccaatgancagcctacnacagaaacagaacaggatcaacgttctatgcncagattaangangtggnggntgtattactgactgtttggctgctatcggctgctgttgtatttgtgaatgaatgctgctgtnaaacttanttattaananacaatanaattactntgttattaattttaccctaggaataaatgngaagcaaacaattatttcat

SEQ ID NO: 99804 - DNA, 402 bp, Triticum aestivum
  Clone ID: PAT_TA_99804
gctctaccgccatgacaatggctggtatgccgccctggcgccaatggtctccacaatggtcgcggacgcatgcttctcggcgcgtccctcggacatcgtcattgccacaatgccgaagtccggcacaacgtggataaaagcaatgctttactccacggtgcacagaagagagcaccccgcagacggccccgaccacccgctcaactcactcggcccacatgagtgcgtcaagctcctggagtaccagctctacatacggaacaggatcccgaacctcgacgggcttcctgaccctaggctcttcgctgcgcatgccccgttggtgtcgctgccgaggtctgtcatgaggatgggctgcaaaatcgtgtacgtgtgccgtgaccccaaggacgccttgatctc

SEQ ID NO: 99805 - DNA, 242 bp, Triticum aestivum
  unsure (1)..(242): unsure at all n locations
  Clone ID: PAT_TA_99805
gatcatgcgacataaaaagaatgtagcgatggaaaaaggtttgtacatatcatgcgactgaactgatggaagggcagtgcaatgtttttgatgcttgcacttgcccctgtagaaaatcaatgtgtgcatacttgtaattgcaatgatacaggggtgtattataaggtttgagcccagctcatatggtggacctgggttttggtcaaaaaaaaaaaaanaaaaaaananaaaaaaanaaaant

SEQ ID NO: 99806 - DNA, 463 bp, Triticum aestivum
  unsure (1)..(463): unsure at all n locations
  Clone ID: PAT_TA_99806
gatcatctctgccttcaaacacgattctccaagcatttgagaacttcttcgatactttggatactacgccagtcggaatgacgaacaaaacccgcgactatggtgacttgagagtcacgcttaccaaggacctcgtatggaagtggaatgagaagggtacaggtgctgcccggtatggagagttctatcttgcgaactctcaaggtgcaatgcgtcctgtgggatcttttggtcaagacaagtgggatgacagaaagataagagagctacgctcttagttggaaacgttcctgggagttctgggaagccaactgttgcaaagcccctactaagttacgactggggtggtggggaaccaaccggggggcgggcnggcnggcaactatggatggnnacaagtnctgggcgaacctggttgccnccttcctggggtaatgttctncgcctgggggggaacgtccgg

SEQ ID NO: 99807 - DNA, 247 bp, Triticum aestivum
  unsure (1)..(247): unsure at all n locations
  Clone ID: PAT_TA_99807
tgaaagggtgtttgttttcaaagacttattggcttagggacttaaagtgggcatttaggacttataaaataagactctcaagcagggacttatagggacttatagttgtaatatggtcatatagggacttataagttccagggaccaaacaggtacggattttttagggacttcagacttataagttgggactaaaaaaagtcctaggacttatgaaccaaanaaaaaaaaaaaaaaaaaaaaaaat

SEQ ID NO: 99808 - DNA, 445 bp, Triticum aestivum
  unsure (1)..(445): unsure at all n locations
  Clone ID: PAT_TA_99808
gcctcgtgccgaattcggcacgagggagatcctcatcaccgccgaggagggctccatcggaggcttcggctcccacgtggcgcactacctcagcctcaacggcctcctcgacggccccctcaagctgagatcgatgttcctgccggaccgatacattgaccacggcgccgcggaggaccagatggaggcggccgggctgacgccgaggcacatcgccgccacggtgctgtccctggtgggtcggccagtggaggcgctccgcctcaagtgaatcaatcaaccaaccaagcatgtgttagtgttacacacccacgttcacaatatggcaagtgctacgggtcggctgccgcgcatgccgncatggtattttgtcgatgattccggggaggagccaatcctgtcaattcgttggcgcaagtggntctttttacgtaaaaaaaaaaaa

SEQ ID NO: 99809 - DNA, 273 bp, Triticum aestivum
  unsure (1)..(273): unsure at all n locations
  Clone ID: PAT_TA_99809
gagcagatcnatngccaccatcncancaggaatncacgatcgattacggtactgatnagngccancacggccatggcggcgacggcgatgcngtagagtggtagaangtggnggagctcagggaggtcgtcgnggcacangacccctctgccaaggaggangntgactttgcgcngccgnggttcctacgtgcccgggaccaaaacaccancacagcagatngagcgccaccgtctcgccgccgccaccaccgccgcagctagataagaagaa

SEQ ID NO: 99810 - DNA, 511 bp, Triticum aestivum
  unsure (1)..(511): unsure at all n locations
  Clone ID: PAT_TA_99810
gaacaacgaccggagaagtcccgtgagcttagctctccagctagcgacggggcgccggccggcgggtgcgcgggctctcggtagtagacggtgggcggcggcgcgtcagcttgatcagtacagacatggggaacgcgctggggtgcgccgggctgggcgagcggctggcggcggcggcgcgggacggcgacgcggcggaggtgcggcggctgctggcggcggacccggggctcgcgcggtgcacagccaccttcggcaacctcagctcgccgctccaccgcgccgcccgaggacgaccaccagagcatgggcggcagcggcagcctgccctgcgcgtgcgcgcgctgccangaccgccacggcagcccggaggatgaggangacgagaaaaagcaaatgccggtcctccgggcaaccggagctacgggcgggaagcggcttggaccggcccggaggccgccataantccccctctactgngccccgttcaacgggccctcccggcancttg

SEQ ID NO: 99811 - DNA, 406 bp, Triticum aestivum
  unsure (1)..(406): unsure at all n locations
  Clone ID: PAT_TA_99811
ggttgatccctggaacacaatctccagacttggaaaggcaatcttcaaacgtatataccaattcagtccccatggatccattgaccagcgccatcgcgattgtnacgctctccgcgcacagctgcaancaancattcaacctcatttctggnctaaccaacgctcctcagagcatcacacacacgcgccaactgntcatgcaanccgatgaatgtctcataagcgctggaacaattattggtgaacaanaagacntcaagcgttctctactcggccttgcgacagagcagtttggacaaggccctcaaatcgacgcgtgatatttgcagngantttggggcccgctgttncaagatgtcactaaagcattcagccgacncggaagattnaagtactncgggatatg

SEQ ID NO: 99812 - DNA, 549 bp, Triticum aestivum
  unsure (1)..(549): unsure at all n locations
  Clone ID: PAT_TA_99812
gaggatctgaagcgtgggtttgttgcatccaactccaaggatgaccctgccaaggaggcggccaacttcacctcccaggtcatcatcatgaaccaccctggtcagatcggtaacggctatgccccagtgctggactgccacacctcccacattgctgtcaagtttgctgagctggtgaccaagatcgacaggcgatctggtaaggaagctggaggcgctgcccaagttcctcaagaatggtgacgccggtatcgtgaagatgattcccaccaagcccatggttgtggagaccttcgccaactaacctcctcttggccgctttgctgtgcgtgatatgagacaaacggttgctgttgggtgtcatcaagggcgtggagaagaaggaccccaccgggtgccaagggtaccaaggctgccatcaagaagaaatgagtgctctgggtgtctggcatccaagttatctaacanaagttttagngtcaagtcctttttggngaaacttaangnatggtaaatgttaatnccggggcnttgttggacttngactcc

SEQ ID NO: 99813 - DNA, 409 bp, Triticum aestivum
  unsure (1)..(409): unsure at all n locations
  Clone ID: PAT_TA_99813
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaaagaagttcgagaccctgtcctaactttncaacggctnaagaanggagggcctccttaagganggtccgactaacctgatncggctccaagtggggtgccttgcctcnagttcaacaagggttgggttcaacttccgtgagcaaaacgcaacccctgggtactacgatgggcggtnctggncaatgtggaagctncctnatgttccggatggaccg

SEQ ID NO: 99814 - DNA, 403 bp, Triticum aestivum
  unsure (1)..(403): unsure at all n locations
  Clone ID: PAT_TA_99814
gctctgatcagagtaggactagcttcagctagccagcctctgccactccggtcattttcttgcatccacgacggcaatggccaccgctgatgtccagaacccgacggccgcgctgacggaggaggcgcccgcggtggagacgcccgtcgccgccgaggaggttgccaagacagaggaggtccccgcgccggcggaggccgaagtcgaggcgcctgcccccgtcgaggttgaggcgaccaaggaggaggcaccggccgccgccgagacggaggaggccaaggaggccgagccagcagctgccggnccgagacggaggccgaggcgcccaaagagccanccgtggtcgaagacagagaccaagganggcgtggcaaaggcanagccggcagtcgtcgaggagggt

SEQ ID NO: 99815 - DNA, 400 bp, Triticum aestivum
  Clone ID: PAT_TA_99815
gctagccgcaatctgcctcgacttttttctcaaccacatccatgtatttctgtttatccattcatctattttactggtgtatgacaggggggatagcttgtgatgattcaggtccgagaggatcttagcggatttcggtgaggcggattcatccgccgttgatcgattcatgttgttacacacgctgaagctttcccctcgattcggttgccgattcgttgccttctctggtgatttattttagtttgtcgagccgctgatcgattcatgctcctacaaacgctgaggcctttttctccgacgcttccgttttagttttcattcgctttttgttttcttccatgatgcgaccctatgatgattcatataggttttcgggcaagtggtggcatctgtcacc

SEQ ID NO: 99816 - DNA, 399 bp, Triticum aestivum
  unsure (1)..(399): unsure at all n locations
  Clone ID: PAT_TA_99816
gctgcagctgctgtataccccccgcttgaccagcgcccggtcaagaacacagtcctactcttcgatgttgacgacacactcacaaagccccgtcaactggtgagccctgagatgcttcaaatgctctcggaactcagacacaaagttgctattggcttcgttggcggctccaacctggccaagcagcaggagcaacttgggggagcagtcgatgtcacatcgctgttcgactattgctttgctgagaacggactcaccgccatccgaatgggcgagaccctggccagtcagagcttcattgcctggattggtgaggacaagtataaggcgctgaccaaagtggattcttcactacatcgccgacctcgatatncccatcaagcgtgggacttttaatcg

SEQ ID NO: 99817 - DNA, 200 bp, Triticum aestivum
  Clone ID: PAT_TA_99817
gctgggatgcggcgtaaagtcgcgcgtttagagacattgattgcttcttcatcccacggaaacagttcggcgacgcctcttggctacggccagcctaagtagtatctgagcacggctagccccgccacaggccgagacagtcaaagcaatccagcattcttaccttaaaaaaaaaaaaaaaaaaaaaaaaaaaaaaaaaa

SEQ ID NO: 99818 - DNA, 426 bp, Triticum aestivum
  unsure (1)..(426): unsure at all n locations
  Clone ID: PAT_TA_99818
gcaagcgtagaacgttccaccaacctctacacgctcggcaaggagacggcccacatggccggctgggaggagtcggccaagcggtggagcatgatgagccctctcgtgctcagccctctacggggctccactacacactacttgggcgtgtgggcctcgttcgctgctggcgtggcagcaacgagctgggggcttgtcaacatgcacctcgaccaagaaaggaaggcgttcctggggatgggcttcaccttcatgaccgccaacgccttcaccttgggcaaagaccatgcgggacttgcaaagaagccaacaacgtgaagcaccttgtcnagggtggcatcatcaaaacaananggtggaccggaggtgggcgaaaagattcgtgtccaancaattggcggcaacccccgggtnggttgctgcacc

SEQ ID NO: 99819 - DNA, 286 bp, Triticum aestivum
  unsure (1)..(286): unsure at all n locations
  Clone ID: PAT_TA_99819
gcctgcctacacccctgaggnccctgcttcctccaaggaggctgagaagcccaagcccactcccagcgccacccacggttctgacaagcccaagcccaccggcagctncaacaacggtgagcacatcaagaccaacggngacaagtgggccattanctacactccctacgccaacgacggtaactgcaggaccgccgacgaaattgctgncgacatcaangaagatttctgagctcggtttcaacancatccgctcaaaacanaaacttgactggcggngtcctcc

SEQ ID NO: 99820 - DNA, 426 bp, Triticum aestivum
  unsure (1)..(426): unsure at all n locations
  Clone ID: PAT_TA_99820
gaacatatcctggttagaaccgagtctcagggaagaaacttggtgaattttcgcgggtgtcgtgtgatcaaagctcgggagtcggaatggagttcgagatggcgagccagcacggggcgctgctgaaggtggggctgttcgtgctggtgcaggcgctggtgtacctcatcctcgcccaagtcctcctccgtcttctccaccaccaagaccctcggnctcccgccggcgcgctccctcaagcgnccggccggnatggtcgcactgctctccgacctgccgctcgggggggaaaccctcgcccggcgcggtctccgtngaaccgtnctcccccgttcccgtncaaccccaacaaaaaaaaggttaantngcaaagctgggaaggnggtaatngtcaaccaaccgaacgtatgcacgttgttggttccg

SEQ ID NO: 99821 - DNA, 435 bp, Triticum aestivum
  unsure (1)..(435): unsure at all n locations
  Clone ID: PAT_TA_99821
gggaaattcctcgaccgattgaaagccaaggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcagaaggagtccaccctccacctggtgctcaggcttcgtggaggcatgcaagattttcgtcaagaccctcaccggcaagaccatcaccttggaggtggagtcctcggacaccatcgacaacgtgaaggnaaagattcaggacaaggnggggaatcctccnggacaaacaanggctcaatcttcgctnggaaagaantttga

SEQ ID NO: 99822 - DNA, 437 bp, Triticum aestivum
  unsure (1)..(437): unsure at all n locations
  Clone ID: PAT_TA_99822
gcttcaccctcaattctcttgcttcttgtcactcctttcggccaattcagaatacaaataatattatagattgctatcacaatggcatccccccgtgcttcatctcctcttgcatccggcaccgaatccggaccagacagcaaatccgcagtctctggtggcgctgccgtctcatctggctcagccgccaaccgtccttcaacaacctactcccccggggtggtcctcgtactgctcttcgtcgccggggctgctggcgaacaaaaaaaaaacngctggcgttatgggcgaacaanaatntaacccgtnnttgctgggtggccggtggttcttccgggactaagttgaagctctaatactggatgnaaagccctggtcccaagggntgaaccctggtggttggtttgggaattgagttgggaattaacctttttcgt

SEQ ID NO: 99823 - DNA, 424 bp, Triticum aestivum
  unsure (1)..(424): unsure at all n locations
  Clone ID: PAT_TA_99823
gctggcccgacgacgccgtcgtgttcacacttccacattgccggtgctcgagctgcgcggagcaattcctgccgggtattggatgcgtcttcaccccgtccggctgaccgtcctggcagttttggggaacatggtgcctgtgccattcatcatcctctacctgaagaaactcgcaaccttcctctcgcagagaagtgcttgggcgacccggataatggacctcctcttcgagcgggcgcgacggaaggctgcgccagtcgaggagttccaagtggctcgggctgatgctgtttgccgctgtcccgttcccaagcaacggaagcaagggccgggaacatcatcgcgtccgtccttgggaatgccgttctgggcanggttgtccgcgaatttcaatgggaagtggtttcttgcgggggttgctggg

SEQ ID NO: 99824 - DNA, 425 bp, Triticum aestivum
  unsure (1)..(425): unsure at all n locations
  Clone ID: PAT_TA_99824
gctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgcctttgctcgaagttcagcaaggttgggttcatcttccgtgagcaaaacgcatcccctgggtactaagatggncggtactgggacaatgttggaaagctggctaatgttccggtggcaccgacgccann

SEQ ID NO: 99825 - DNA, 423 bp, Triticum aestivum
  unsure (1)..(423): unsure at all n locations
  Clone ID: PAT_TA_99825
gcttctgaatacgaaatagtacattctcaatcgagccctacacataaaacatgtcaacttcaatcaccctttcagacggccgcaagcttgcgtacgaccttcgtggtcctaaagacgcgccaattatactactctccaattctctccttaccgattattcactctgggattacttcgttgaagatcccactttccgagaattccgtttccttcgctataatcagtgtggccatggaggttcatcggcgcccgaagacccgaaccacacgacctttgccacgctcgccgacgacgtaacggaactattgaaagatcttgatattcaaaagttgtatgcatggattgggatttcaatgggtgctggcgaacnggtggttactttggttacgccggaatccccggggggggggaaaagattggggg

SEQ ID NO: 99826 - DNA, 422 bp, Triticum aestivum
  unsure (1)..(422): unsure at all n locations
  Clone ID: PAT_TA_99826
gaccgaatccacctctcgccggagtcccagcaaggagcgagcaagccaggaagatggacgccagcaagctgaagaaggtggccgggaagaagttcggcgggccgaggaagaagtcggtgaccaggtccgtcaaggccggcctccagttccccgtcggccgcattgggcgcttcctcaagaagggccgctacgcccagcgcgtcggctccggcgcccccgtctacctcgccgccgtcctcgagtacctcgccgccgaggtgctggagctggccgggaacgccgccaaggacaacaagaagacccgcatcgtgcccaagcacctgctgctggccatccgcaacgaacaagaagctcgggaggctgctgtccggcgtcaacatcgcccaagggggngtcatcccaaaatcaaacccggtngtggn

SEQ ID NO: 99827 - DNA, 424 bp, Triticum aestivum
  unsure (1)..(424): unsure at all n locations
  Clone ID: PAT_TA_99827
ggcagaccagctaatatctgcgaaatcgattcattcagttcttcgattaacattctaaaagatacatacaaagatgggtgtcatcgagaagctgtcccgcaagtctggcgtcatcgtcggtgatgacgtcctgcgcctcttccagtatgctcaggagaaaaaatttgctattcctgccattaatgtgacctcctcctccactgtggtcgcttctctcgaagctgctcgcgaccaagaaatccccaatcattctgcaaatgtcccaaggtggtgctgcctacttcgccggaaagggtgttgcaaaccccaaccaagaagcctccatcgctggtgccaatggccggtgctcantaaatccgtnncaatcgcccccgcctaagggaatccccgtcggttccttaaaacggacaatgggggccaaana

SEQ ID NO: 99828 - DNA, 439 bp, Triticum aestivum
  Clone ID: PAT_TA_99828
ggcagagcgcattccgatcccgcaccgccgcccacgcatctcgagtagtttccacctcgccggagaagtagaagcaggatggccggaaggaagggcggcgacaggaagaaggcggtgaccaggtccgtgaaggccgggctccagttccccgtcggccgcatcgggcgctacctcaagaagggccgctacgcccaagcgcgtcggctccggcgcccccgtctacctcgccgccgtcctcgagtacctcgccgcaaaggtcctggagctcgccggcaacgcgggcaaggacaaaaaagaaagaaccgcatcatcccgcgccaactggctgctcgccgtccgcaacgaacaaggaagctccgggaagggctggctccgccgggcgtcaacaaatcgccccaacgggggggggttgattccccaaacaatcaaactcccgtgg

SEQ ID NO: 99829 - DNA, 422 bp, Triticum aestivum
  unsure (1)..(422): unsure at all n locations
  Clone ID: PAT_TA_99829
gcgagctctgtcctaacaagctccattttccatctcatcccatccgtcccctccccagcccgttgcgcgaagtcgtcaaagtgcggttcccacacctcgccggtcaatcgtccgccatggatttctcagacatctttcgcatggtgaatttcgccgttgcggtattcgtggtccttggtggtatcgcgaagttgttcccgttcaacgacttctctcacatcattctcggtgtatacctgataatattcggtcttggaaccgctctactcgagttccaagattccccaagcaagtggcacgctatgcctctttcatgttctctttcctcggncgnggnatcttctacatcttcaacggttcggtcaacgggggtgaagcggtggtttcgcaatggtggcaaagcaacaantggccggaatnat

SEQ ID NO: 99830 - DNA, 419 bp, Triticum aestivum
  unsure (1)..(419): unsure at all n locations
  Clone ID: PAT_TA_99830
gcgcgatcatatacacgcaacgagccgcgcatatcatcaaacatcacgagttccagtgtcgcgccgcgctatcaccgccgccatgtcaggcgcagtcgcaaagggcaagaagcaggtgaacaagaacgcctatcgccgggcgaagaagaagcagcagcgttctgagacaccgtcagagaccgctgactctgcgcgtgagagcgaatctcccgcacccgaaagcgacagcaataacgaagcacaggcggtcaagcccgcgaaccttctcaccgttgacgatatcgcgaaccagtacgacctcgacgaccccgcgtttgaggaatacaagagcgtcttcgagaagttcagggagccgaccgaggaggaagcggcgaccaaggacgangagaagccaaaaatctatctctccgacgacgaca

SEQ ID NO: 99831 - DNA, 422 bp, Triticum aestivum
  unsure (1)..(422): unsure at all n locations
  Clone ID: PAT_TA_99831
gccacttcgagcgcctcctcctgtctcgccctcgccccccgtcccctcgtcggcgcccgatctaagtcaagatgantcgtggagggagtgctggtggtggtcaaagttctctgggttacctgtttggagatggtgagcctgcaaagcccgctgcagcaccaagctgcgaagcccgcacctgctgagaaaccagcaccggcagctgctgatgtagccaagcagattccaagctggcattccaggtagccgggcgaacaactactaccgtgcaaatggncaaaacacgggcaacttccttacggaccgtcctttaaacaaggttcaagctgctcctggcggtggctcctccctgggctactttgtttggnggnaagtgatgttaatggatgctggcttaatgaacgaacgaatgaanttggcct

SEQ ID NO: 99832 - DNA, 420 bp, Triticum aestivum
  unsure (1)..(420): unsure at all n locations
  Clone ID: PAT_TA_99832
ggctgaagctcttcggcttccacttctcctcggcggaggaggagaaccacaccaccatggacacgcccgagcacgaggcggccgagccggagaagggcggctccgactcctcctcctcgtctaccaccacgaccacggccacggcggcggctgcggcgggcggcgggggtggcgaagggaggcggtacgagtgccagtactgctgccgcgagttcgccaactcgcaggcgcttggcggccaccaagaacgcgcacaagaaggagcggcagcagctcaagcgcgcgcagctgcaggcggccgcggccgccgcgggacgcgcggccgggggaagcgcgctctaacctcgtggcgccgggggcatgaancccaaggtgtccggcttcgcgcaagccgcggaactcctccgggggggccgggaa

SEQ ID NO: 99833 - DNA, 424 bp, Triticum aestivum
  unsure (1)..(424): unsure at all n locations
  Clone ID: PAT_TA_99833
gaagtgaggagaggccgagctcattctaccatcgacactgaccatacagaatggaatgatgcttagttgcttgcctcgccggggtagtccagcagtggcttcatgctctccggcttgccgctcagcttccaagacatgatccgggagacgaactgcatcccgttgccgatggacgacggcggcgttaggtgaggcgtggagaggtccagtgcaccgaaatcaacctcgagcgagttgtcgtcgcgtgccctcaagaaaacaaacagcagggactctgggctcgttttgtgctcatccatcaggctatggagctgctaggtacgtacagtatataaattagtgatgcaagcaccatttgtcatcgtaaagggtctccttgcacttngaggnaatcnggcggggcnttgatttccctccnacgggg

SEQ ID NO: 99834 - DNA, 421 bp, Triticum aestivum
  Clone ID: PAT_TA_99834
ggttatattcacgtgcttggcggatattcttcctagccccgccattacggcatgagtctatgatatttcctatcttgagacagaaactcccaataccgtaagatttacgcatgtgcacttcgagtggtcggcgttcagtgcacaggacaaatggcataccttcgtccagcggcaaaagaacccgatcaggtatgcaatgacctgagatcatggctaccaaaggcagaattttcctcacaggatgatgcgccacatatgaggttgtgccgtaatgtcccagcacacctcctccaacccttccagaaggagaatatgaagaccaagcttgatacagtttgcgaacggagcatcaccgcgaagaagcttacggtattcttactgcgatccgtctacatgaaaatacgggcaacaagtttcgctc

SEQ ID NO: 99835 - DNA, 399 bp, Triticum aestivum
  unsure (1)..(399): unsure at all n locations
  Clone ID: PAT_TA_99835
gctcctagcangctatatacctacatagcacanccatggcccccaccgtgatggnctcgtcggccacctccgtcgctcctttccaggggctcaagtccaccgccggcctccccgtcagcaacggtggnaggntcaggtgcatgcaagtgtggcccatcgagggcatcangaagttcgngaccctgtcctacctgccaccgctcancacggangccctcctcaancaggtcgactacctgatccgctccaaatgggtgccttgcctcgagttcagcaaggntgggttcatcttccgtgancacancgcatcccctgggtactacgatggncggtactggacaatgtggangctgcctatgttcgggtgnaccgacgccacacaggttnctaancgaagtt

SEQ ID NO: 99836 - DNA, 409 bp, Triticum aestivum
  unsure (1)..(409): unsure at all n locations
  Clone ID: PAT_TA_99836
ggatctgagcaagctttcacgtccttacagcccctctggtcagacttgtatatcatttcattttgactggtccttccatcgaagaatccatcatgagactgcaaaaccgagttgcaatagtgacgggctcgtcccaaggtatcgggcgggagatctgtcatcaagttcttcgttgaaggagccttgctcgtatgcgctgatcttagacctattgggaaagggcgaagacactgctaaacacgaaatgggttaatcngcaaagggngggacgaaccaattttccgttggagaaccggatgtcaagtgttaccaacaanctgggganggcactcnttgcncnaacaatgggagggnatatgggnccactttgataaaaatggggcaaataaagcctgggaatctggancgg

SEQ ID NO: 99837 - DNA, 440 bp, Triticum aestivum
  unsure (1)..(440): unsure at all n locations
  Clone ID: PAT_TA_99837
gcttgcatacagtctgtctctcattcatcctagctgcaaacaaactaccagtaccgaacctgcagaacatttctgcgacaaaccccgcgctatttcaccaagctactcttgagcttaagacattgtatttatcacccataaccatgacctccgaagtcaatcccacacaatactctcaatcgctacaatctcccaccgccatccctccccgaacgaagctccaacggcgccgtaaatgccatgcgaccaagcttgtcccgggcttaangggtctatcctccgaaaagcgaatgggtgtcctcntccaaancnnaaaaggactggagcaaaaacgagcaaacaatgggccgggaacggntcaannatggnttgggcnaaagggttaaanaanggctggtgggccgcaaggaaaaagagagcatcatcatggggcccgtttg

SEQ ID NO: 99838 - DNA, 425 bp, Triticum aestivum
  unsure (1)..(425): unsure at all n locations
  Clone ID: PAT_TA_99838
aaatttcattcttacggctccatcatcctaggttgtcgctagcgacagccccccctcatttatatagccgattcagactcaatcacagcaccatggcatctgctactactttctacgacttttctcctccagacaaaaagggaaacccctacccgcttaccaactacaagggtaaagtcgtcctcgtcgttaacacggcctccaaatgcggcttcacccctcagttcgacggtctcgagaaattatacaaatcgatcgaagctaaacaccccggcgcattcaccatcctgggatttccctgcaaccaattcggtaaccaaggatcccggaagtaacgacgaaatccaagagtttctgtcaggttaattacggtgtgaccttccccgtgctgggcaaagatttgatgttaatgggagtaatgccng

SEQ ID NO: 99839 - DNA, 392 bp, Triticum aestivum
  unsure (1)..(392): unsure at all n locations
  Clone ID: PAT_TA_99839
gcctcgtgccgaattcggcacgaggcgccgttgatgtatacgaaaaagagatgaaatgttgatgagagagtgataaatgatgccaacgcatacgaagcaacacatgtcgaccaggggatcgtcccaggccgtgttgatcttgacgaccttcttttgaattacgacaaccgtcttcttttctaccgatccccttttctggatagggatgtcgaagaactattcttgtttcccgtccatcatatagccgcctgtgtgattgcgttttagtgttgtttgcttattctaagcgttggtattgacgattgatgaaaaagatcaacgaacacttatgaaactggtccgagttgatttttattttncaatgccggtttcnancaatccgctngaaatga

SEQ ID NO: 99840 - DNA, 457 bp, Triticum aestivum
  unsure (1)..(457): unsure at all n locations
  Clone ID: PAT_TA_99840
gcctcgtgccgaattcggcacgaggaccctcccagcgctcccccctcctcaacaacctcccggcgcatctccgactccatggcccgcaccaagcagacggcgaggaagtccaccggcggcaaggcgccgaggaagcaagctggccaccaaggccgcccgcaagtccgccccggccaccggcggcgtcaagaagccgcaccgcttccgccccggnaccgtcgcgctccgcgagatccgcaagtaccagaagaagcaccgagctgctcatccgcaaagctccccttccaangcctgggtgaggggagatncgccaaggacntcaagaaccganctccggttccantcctccgccgtctccggccctgcaangagggccgcccgagtcctaactcgtnggggntcctccgaggaaaacaaactctgngccattcaaagccaaagcggcggnaacaantaa

SEQ ID NO: 99841 - DNA, 444 bp, Triticum aestivum
  unsure (1)..(444): unsure at all n locations
  Clone ID: PAT_TA_99841
gggcgacaacacgttatatagtgtagccaatatgacgttcaatccctctaaacgccaagccctcggccgcagttttgtggcgcgagattcagtggcagcgacgcaatccactttcttcggcaccaaagcccccgcggaggtgacgcaattagcactattattgcccaatacagatcaagctacttttatcaaactactcaaatttgtgttggagtatattaaaggcactgagatcacagaacagcactggacgaagctcaaagagtcagtcgaagagaccaccaccactactactaataataatacaagccgctaataataacaacaacaaaatcaccgccaaaattgccgctccttatttgcggggctctacaaactactcaaaactgcgctgcaacgattcgaagtggacaacgggtgcaantcaaaaaagaacntgagcaa

SEQ ID NO: 99842 - DNA, 455 bp, Triticum aestivum
  unsure (1)..(455): unsure at all n locations
  Clone ID: PAT_TA_99842
gcatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatgggaaaagaagctttgagggatatcgttccttcatcccaaaaactggggacgtcccccatgtttgaccggcaaaganttatcaagctggattgacaataactggatgatggggtattgtcaagccttctcaactgnagaagtgggtaacnactaaaggatgaccttgaaacn

SEQ ID NO: 99843 - DNA, 483 bp, Triticum aestivum
  unsure (1)..(483): unsure at all n locations
  Clone ID: PAT_TA_99843
gaaaaaaatgaagggtcactttttcaagcatttctcgagagacgtcgctcaaagacaagctcttttcagaagtttaaccacaaacttaattaaacatgataaaataacaacaacaatagtgaaagccaaacaattgagaacgttcatcganaagatggttacactttctaagaaaaattcagaacacgcccaaaatcaaatcagatcctatttatatgaanaagaagctgtccaaaaagggctattcaaacctttcccaagaaatgattcaagggaancgaagaaagggggntatacatcaatttggaaaagatttgtgggannaaataagaaaaaggntgacnaatgccaacnaatgggccnaccatttacncttttgggttnctngggaaaaagggctcccanaaatttnttttttggtaaaggaaagnaccgannaaggaaaaagaactttacccccaagcagggaaanttttnaaannc

SEQ ID NO: 99844 - DNA, 441 bp, Triticum aestivum
  unsure (1)..(441): unsure at all n locations
  Clone ID: PAT_TA_99844
ggctcatcatcatcctcgacaccaaagctcatcttcttctccttgaaatctttttgggttcatcagatttggaggatgtcttgcaactgtggatccggttgcagctgcggctcagactgcaagtgcgggaaggtgtaccctgatctgacggagcagggcaagtgccgccgcccaggtcgccgccgtggtcgtcctcggcgtggcgcctgagaacaaggcaggtcaagttcgaggtggccgccggccaatccggcgagggctgcagctgcggcgacaactgcaagtgcaacccctgcaactgttaagctgcatgcactcctaccgtcgtacgtacgtgtgatggngtgagaatatacgtgaataacgaacgtcctgatctgatggaagtccaacaaagggtgcctttgcaagttcntttgggttaantccgctccgctcccc

SEQ ID NO: 99845 - DNA, 455 bp, Triticum aestivum
  unsure (1)..(455): unsure at all n locations
  Clone ID: PAT_TA_99845
gagcgatacctatatagccttcccaacttccaaccaaaccacacaaacaactcactcacaatggttgacgctgactcttctgtccgacggggccaccctgtcatcttcggtctcgtggccctcttctcgctcatcgagatgtgtatcaccgcttacctgacctcgaggtacaactccaacggataccccagcggccacttccagggaaccatccgattcggactgttcgtctccatctggaccctgttcttcagcatcgcctacctggtcatcttcctcaccgggaatngcaaaactttatgagctccgatngcttcccaacggtggttggnntgcctcaacaactgggatnttnctggggtcggctantccggaatcaactcggggcaaaggctcaancgggaccccggaaaggtgggggnccgncgatnaacctctccgcantgggaaccaaa

SEQ ID NO: 99846 - DNA, 440 bp, Triticum aestivum
  unsure (1)..(440): unsure at all n locations
  Clone ID: PAT_TA_99846
gcctcgtgccgaattcggcacgaggcgcatttgttgtgcccacggactttggcaagccattcaatgctccaccaaacgctcatcccttcttcccttgccttctccgcctccgcttccccttcccccgaccctctccccttcgcctcgaaagccgccgccgcgccgccgccgcgaccccccttcgctcctcaagccatgccgtcctacgccgcaacancacaagctctctggacgaagangatggncgccctcaaggncactaagcgcaaggaggnnacntccgaccaaggcgccnccgaanggncggcgggctggggcttcgccgaaaagganggnttctccgtcgagggacctgctggacctcnaaggagttctgcgaacccgataaggaacggggccgacnaaccccgaaggaagctcccggcggcgccggtgaaaaa

SEQ ID NO: 99847 - DNA, 207 bp, Triticum aestivum
  Clone ID: PAT_TA_99847
gcacacagacccggctcaacaacttgaggctctagctagctagctagcatccgtccgttcaaaagaaataactagcaataaacttcctattgaggcaaaaccgaatatatttacagtttaggtgtgattcatcggatctcaagatcattgtatatatatgcgagtacctacctaaaaaaaaaaaaaaaaaaaaaaaaaaaaaaaaaa

SEQ ID NO: 99848 - DNA, 421 bp, Triticum aestivum
  unsure (1)..(421): unsure at all n locations
  Clone ID: PAT_TA_99848
gcatccccgaataccaccgactctcttgaacccgtccgttcgagagtctatacaccgctttcccactcgccctcacactaccacacacacccaccgcaatcatgggtctcacattttcgaagctcttcgacaagctatggggaaagaaggagatgcgcattctcatggtcggtcttgacgctgccggaaagaccacgattctctacaagctcaagctcggtgaaatcgtcaccaccatccctancatcggtttcaacgtcgagactgtcgagtacaangaacatccaagttcaccgttgtggggaatgtccggtgggncaaaggacaaagantccgtcctccggtgggaggggaattattccaagaaaaaccaaagggnatcaaccttcngncgtccaanaagaaatggatttgcgaacgt

SEQ ID NO: 99849 - DNA, 458 bp, Triticum aestivum
  unsure (1)..(458): unsure at all n locations
  Clone ID: PAT_TA_99849
gcatcattttacactttatttactgctcattgatgctctgttcctatagtatcataaccaaaattgccctacactctttagcatgttgctgttaactgttctatgttattcctcacggttttgttctatatacacctcatagaaagagcatataagtatgaataaaaatcttggtttccaggatggcgagccagccagccgcaaacagcgctcgcccagccacggtgcagatacgcgggcaacctgtcgaacagaagacgagctgctgctcttcttgaaatgcaaggcaagccgccatccgtggttacccaaatgggagacgcaaaacttgggccgcgccatcctccgaagtccaatgcttccaacaatagggnctaactaaatcttaacanccttcaattccaattctttccnagtggtacctaattaagctncctggaatccgttggnncntggta

SEQ ID NO: 99850 - DNA, 436 bp, Triticum aestivum
  Clone ID: PAT_TA_99850
gccgagccgtcgcctccctttttctcgttcctccccaactcccccacgcacagcccctgccgccgcttcttcttcctcgcccaacgccgtcgccccgatgcagccggtccatcctccaccagcagcgccgccccgccgctgatcgtcgcctacagcgccaccgtaccgtcctcgatttcagccgagcgcatggaccgtcgtcgggagaaggtcacagtggcaccaccggctcctcctctgttcgccggggcaccaccggctcctcctctgttcgccggggcaccaccgactccgtctctgttcgctgctgcaccaccggctcctcctaatgttcgcaagccgccaaacgggtcctccggccagtcaagcacctggtctttggtaagggagcctaacattgcaaagattaagtatggattccaatgtcaaattttta

SEQ ID NO: 99851 - DNA, 466 bp, Triticum aestivum
  unsure (1)..(466): unsure at all n locations
  Clone ID: PAT_TA_99851
gttcttcttttcttccatcaacaactacatcccttacaccactactctcttgacttgctgcattctctccaagtaactcattgcaacacactcacatacactcacantgnccctcttcaacgtcaccctcaaggagtctgctcctccctctgagcttgaaaaggccaaggagaaagcacgcgccgagggaggaactatcaagcatgaatacacattgatcaagggcttcactgttgaataccccgncgaccatgttnncgttctcgagagcaacgaacaatctccacgttcgaagcnangaccggaaaggntgtccatcccaggtaaccccggccgganccngttgtncaattccgncaagggggggctnccccaanncagaaatcccaaactggncnaattnagttggggagcnacatnccattctnacccgggcttnanacttgcctnccangtccggcaattg

SEQ ID NO: 99852 - DNA, 451 bp, Triticum aestivum
  unsure (1)..(451): unsure at all n locations
  Clone ID: PAT_TA_99852
gtttgcttccgtcacatcgcgtattgctcttcaaacccgttcaacacttgctcaacgcttctatacaacaggagctggcgtcaacactcttttatatgttgaacataaagacggggcaattagtggagccacattgaatgccttgactgctgccaaaaaacttggtggttcaagttactgccttggtagctggtgatgcccctgaaggtgttgctcaacaagttgccaagttggaaggcatttctaaagttttgtctgccaagaacactgcctatgccaactctttgcccgaagatattgctcctcttcttgttgaagcacaatccaagtttggattcactcacttgggtgacaaggncacactgctgtccggtaaggaacattttcccctccgtgctggctgcttttgatgggatgttgctggcaatcctcctggatattaactnggnna

SEQ ID NO: 99853 - DNA, 199 bp, Triticum aestivum
  unsure (1)..(199): unsure at all n locations
  Clone ID: PAT_TA_99853
gctcctccanaccccaactanttacancccanccatatcgantcacaatggcgtcnttggccacanccgcccgtttgaatggtgctcctgcagatcgcgctgttcgtcgtcgtctcagcggtgatcatgagcagctccgtctgccacggagccgggatcggtcgtgantgcttccgaactgntcatttcatcctcttcg

SEQ ID NO: 99854 - DNA, 457 bp, Triticum aestivum
  unsure (1)..(457): unsure at all n locations
  Clone ID: PAT_TA_99854
ggaagaagaagaagaatatcgccctttgccccattcccaaaccttcctcttcccctcccctccgcggcggcggcgagcgagctgttgttcgtttatttgtctccacgcatccccttcccccaggcagaaatattccgcctgctccgtgcttttcttccaccgcgtgcgttcctgctttgacttgacttcaagttgaagcttctctgcctgccttccttcctgggattggggaattcttccgcttcctcggcttctcccgtccacccaccggattgattggggaatcgttgtcggagggttcgaggcggcgcggcggagggattttaagaagaattctnctgtctgttcccgggcggngggatttgggatttgcgggggtttcgggatgggggaaagcccgttcgctcaaagaaagaagaagggcctcctcccgggcaaaggccggncggcgggggaa

SEQ ID NO: 99855 - DNA, 445 bp, Triticum aestivum
  unsure (1)..(445): unsure at all n locations
  Clone ID: PAT_TA_99855
gaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccaagtgcaagtgcggcaccaagctgcggctgctcctgctgcagctgctagatccatcatcgatcatgcatgcaccgtgccgtgcgtgcatcaatcgattgtatcgatctaactactaacatacaatgttaccgcaanctgattcgaagggcnttaatttacgcaactgaactggaatcaacaagtcaaggtggcca

SEQ ID NO: 99856 - DNA, 454 bp, Triticum aestivum
  unsure (1)..(454): unsure at all n locations
  Clone ID: PAT_TA_99856
ggttttttttttttttttttttttttttttttcanaanatccatgncgcaattctgnttaatccgtaacttaatccgtaacacatntnntgctttagcagcaaaaggagaagtgttcaaaaacacgcactacagaagatatgctttcccttattcatttacattgncccggcanagtcgantcccaggggntcctcgctcaagcccgatttcttacgtctgatctcgatgncctgcactatgaggtcgntcttcnaagttccccgcctttcgtcaccancagggcngatggaatanctcgcccgttcntccncccccctcgttcanggaactcgcccaagctccaagctncaatcccacccgtcggccctttgtctgtgnggaagcggggggggcccgggtacccaattccggccctatagttgaggtcgtatttacggcggcncctcanctgg

SEQ ID NO: 99857 - DNA, 426 bp, Triticum aestivum
  unsure (1)..(426): unsure at all n locations
  Clone ID: PAT_TA_99857
gggataccggcgatatagtgtttgatctgaacttcacggacgtgagtgttcggacttttatgtacaatgcttggatcagatcaggcggagacattatgtacggcgtccaagcgaatgcaagccgaaacatcctggccgatgatgaacaaattgaggcccaaatcagcgttagcgaatcggactggaaaccaaacatttacggnggcaatgctactggtgacatgcgggactatcataccaaatggttggaacgattcgtgtggccaacgtttaatatctctgggaaattaaacggntttgcgactaccaatgtttttgccccctgggaaaagcaaattatcaangnccaataggggacgttggcattaaagttccctaagaccttttgcctggggggggaatttgncaaccctggagtcctaagnt

SEQ ID NO: 99858 - DNA, 442 bp, Triticum aestivum
  unsure (1)..(442): unsure at all n locations
  Clone ID: PAT_TA_99858
ggaaccaaggcccagagcttagggcttctcacccatgcatccgcaccaaccctgttactggctggaagtcgctgtttgcgtttgggcatcacttggaggagtttgagggcctgggagatgttgagaatcgcatgatgaaggagtttgtgcagagactcgtcacagaaaaccatcagttgcaggcgagggtgcgctgggagcaggatgacctccgtcatctgggacaaccgagctgtctaccacaagcgctacctacgactacggtgggtattaccggtggcaagcgcatcggtaacccgagtctgtggtgtcnggcgaaatcccctacttggattctccgctcttcggggggcgccgatatgcctttgggcaatggactaccttgctttagaaaattggntggatnaataaaagtccnttagaccttactaatgaaagnttt

SEQ ID NO: 99859 - DNA, 460 bp, Triticum aestivum
  unsure (1)..(460): unsure at all n locations
  Clone ID: PAT_TA_99859
gctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagttgggtgccttgccttgaagttcaacaaaggtcggggttcatcttccgttgagcanaatgcgtnctcccggggtaactaagaacgggcgctactgggacaattgtgggnaagctggctatggttccgggttncaacggancgccaaaacaanggtggatcaaacgaaggnggg

SEQ ID NO: 99860 - DNA, 431 bp, Triticum aestivum
  unsure (1)..(431): unsure at all n locations
  Clone ID: PAT_TA_99860
gacagatcctcttttgttagaagcaaataattttctgttaaaatgcgtgtttccgggatctttgttgctggccttgttgcccttgcctcaggtgctcctgtgaacaatgcccggggtcttggagacgtcgcctatccagacgcctacaagcgtgacgatggcattgcctatccagacgtctacaaacgtgacgatggcattgcctacccagacgtctacaagcgtgacgatggcattgcctacccagacgtctacaagcgtgatgatggcgttgcctacccaagacgcctacaagcgtgacaccagcattgcctatccagacacctacaagcgtgacgccggcattgcctacccagacgcctacaagcgtgacgatggcgttgctancctgatatctactaaaatgcaaagacgcccaatggcatggctgg

SEQ ID NO: 99861 - DNA, 474 bp, Triticum aestivum
  unsure (1)..(474): unsure at all n locations
  Clone ID: PAT_TA_99861
cgctcctcagtacgaggctgcctaccctgctgccagctccgctgctgagtacccctcttaccccgtcgagagctcctctgctcccgcttacgaggctgcctcctccgctcccgcttacgaggctgcctcttcggctccctcttaccctgctgagacctcctcggccgcctacgaggcttccaagcctgcccacgaggcctcttcctcggcccctgcctacgaggcttccaagcccgctgagacccacccggcctacaccaacaacgaggttgtccacgccaacaagctatgtctgcccggagnccaacgtcaatcaaccaagggccccaagcaaccttacaacaatctccaacaagcaacaaccctggaacaatcccctggaagtaaaatggctnatttatgtccaacanccccttgaagcccgaaanatggctttcaaaggccctccaatgacccggggactnccctccggtc

SEQ ID NO: 99862 - DNA, 449 bp, Triticum aestivum
  unsure (1)..(449): unsure at all n locations
  Clone ID: PAT_TA_99862
gtttggtttgggccattgtcaagaacaacaattctttccttgttaagcgtcaaaacgttcaattctcttctgaaccttccaacttgttgaaccttaactccttcaagtactctggtctcgccaactacaagaacgctgccatcatccctgctgctcgtggtgtccgtgtcactttgcgcaaggctaacaaggaacaatcccctgccaagtctgccaacactgttgtcattgccaagactcgtcgtcaaaccgccaagtctgttgctaacttgattgctcgtggtaacaagtacaaacctgaccttccgtgctgctgccgttgcccgttgcttctggcatcatctcctctcaaacaaacccaaagaaaggaacgcaaagggtcgtgaaagncaaagggtgntccgtgctcaaaaaagaactnaattaaaaactccctgggttggcttttt

SEQ ID NO: 99863 - DNA, 455 bp, Triticum aestivum
  unsure (1)..(455): unsure at all n locations
  Clone ID: PAT_TA_99863
gcctcgtgccgaattcggcacgaggcttagccaaccgtcccacctcgatttccacgagcgttcaagcgtccgaccccgacctcttccctgcccaatttccccctgattgaagtttatacgttcccgcgacactaaagcgactgcgacatcatctcgcgactctattctcaacatgcccgtcgagctccgtaagcgcaaggaagcgcccccagcgcctgtgcgcccaacgaagaagaaggcgcccgccaaggagaagaagccgagagcgagaagactgtcctcgagaaagtccaagaaactgtcactgagcaagtccgaggctgtcaagggaactgtttgtccggtaaaaagcaaacggggaagtncggctggncggtgcgaaccgggccaaccaaaggnccnggggaacaanaatttgaacctcnccgnccntttgggngggagnaaattgggna

SEQ ID NO: 99864 - DNA, 456 bp, Triticum aestivum
  unsure (1)..(456): unsure at all n locations
  Clone ID: PAT_TA_99864
gcctcgtgccgaattcggcacgaggcccaattccccacccccaccggcgccgccgcacctcgccgccgttcgctcgtcctccgaagggaagggagggaagatgagggagatcctgcacatccagggcgggcagtgcgggaaccagatcggggccaagttctgggaggtggtgtgcgcggagcacgggatcgaccccaccggccgctacgccggcgacaccgacctgcagctcgagcgccgtcaacgtctactacaacgaggcctcctgcggccgcttcgttgccccgcgccgtgctcatggacctcgaagcccggcaacaattggactccgtccgctccgggccctaacggggggatcctccgccccgacaaattcctctttcgggcaatccggnggccgggnaaaaaatngggggccaaaggggccanttacaaccgangggncgcccgaagctn

SEQ ID NO: 99865 - DNA, 431 bp, Triticum aestivum
  unsure (1)..(431): unsure at all n locations
  Clone ID: PAT_TA_99865
ggaacgacgaactcgagcaacccataaactttaatattcttttcttttttcttgattcttttcttagctttatatacgcacaagatgtcttctcaggattactacggtggtcaacaacctcactaccctcctcaatctcaccctccccaaggcggctactatcctcctcaacaacccggttacggtcctccgcccccccagggctaccctccacaaggataccaagcaacctcctccaccgcaacaataccaacaagaacagcgcggaggccgtgaccatggttgtctaggtgcctgtcttgcgacgatgtgctgctgtttcttgtgcgaggagaactgtgaatgctgttttgattggaantgagtgttgcgaaggatgttnaaatggtttacatctttgatttggaagattaaacggtgcncattgtttt

SEQ ID NO: 99866 - DNA, 429 bp, Triticum aestivum
  unsure (1)..(429): unsure at all n locations
  Clone ID: PAT_TA_99866
gggcagtactacaagcgagtgacacaagttcttgcaccgatcagatccaacttctgcgcaagatgctggacaagctgtgggacgacgtggtggccgggcctcgcccggagacgggcctcgacaagctccgccgcgccgccgccactcaacccctcgccatcaacacagctgcaggggaggcgattaagcagtcgccgtcgatgcngangaccccgaccacgccggtgacgccgtcgtcgtcgacnccgccgcgtggcggcagcgtgtgggcgggngcgttttccacccccgngggaagcagnctgggtcaccanaacgnctcgggcgnacaaacctcttcgnanccgccccgcagnccnaactccccccatcgntctaacgaactggncttttaacacccgnccgangacccaatttnncanggaaagc

SEQ ID NO: 99867 - DNA, 428 bp, Triticum aestivum
  unsure (1)..(428): unsure at all n locations
  Clone ID: PAT_TA_99867
gcacctatatacatacatggaccaattcgcctcctcgagtggacaagcacccctaggaaacagtggtagcccatcacccagacatattgtcagacttggtcgtatgacaaaaataggtgttccgataatcgctgttttgggaatcggctatggtataaccgtagcacggaatgcccaacgacgcattcaacgagtatccatgcaagaagaagaacgactacgtcgaaatgctcaactgatggatgcttatggcgacaagagtagcttggaggatgtgcagagggcgcgggaccaatatcacaaagattgagataggtctttccgatgagattgactcgtggtttgtggcttctgaaataatcccgtgcatttatccggcgttggcgttttcgtgatgcatattttcgtgtgcantttatgggcactac

SEQ ID NO: 99868 - DNA, 448 bp, Triticum aestivum
  unsure (1)..(448): unsure at all n locations
  Clone ID: PAT_TA_99868
gcagtcattcatcaccgatcaccaagcacagccgcgcatccaccgttgctagcaaggtcgaccaagcagcaccgagatggctgctgccttctcctccaccgtcggtgccccggcttctacgccgaccaacttccttgggaagaagntcaagaancaggtgacctcggccgtgaactaccatggcaagagctccaaggccaacaggttcacagtcatggnagcggnaaanctcnacgagaagaggaacacggacaagtggaatggtcttgcgtncgatatctccgacgaccagcaggnacatcaccagagggggaagggcatcgtnggctcgctcttccaagggcgcccacgggnngatcggcacccacngagggccgntctcangctccctacngagtacgtcannccaatgggacttcaatggaagtaccgancttcgancaacact

SEQ ID NO: 99869 - DNA, 428 bp, Triticum aestivum
  unsure (1)..(428): unsure at all n locations
  Clone ID: PAT_TA_99869
gaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtganaactacaggcttctttatgacaccaaagggtcgctttccgccttcactctgtcagggatgangg

SEQ ID NO: 99870 - DNA, 448 bp, Triticum aestivum
  unsure (1)..(448): unsure at all n locations
  Clone ID: PAT_TA_99870
ggaaaatgttaagtcgttggatgggtgatgttttcgatgagccaagttttggtatcacaagagatttctttgacagagacttgtggggtaatcaacaaagaggagttgatttctacagaaatcaattaggttctttcactccaagtactgatgtttcagaaaatgataaatgcatttgcgtaaagtccaatctacctggattgaagaaggaagatattcgtattgatgttgatgatcaagaatagactcttgactttctctgggtgaaactaagagtgaaaagaatgatgagaatgaaatttatcatccgttctgaaagattctatgggaaattcagtagatcnatgagattggcaaagaatgttgatttgggataatatcaaaggcaaacatgtccggaaggggggntccccaagatttcaattccaaaaaacctngaacaannaaa

SEQ ID NO: 99871 - DNA, 444 bp, Triticum aestivum
  unsure (1)..(444): unsure at all n locations
  Clone ID: PAT_TA_99871
ggttgcgtccatggatgttcttcatccccttctctctctagcagccatagatgaactccttccccttctctccccagcagccatggatgttcttcatccccttctctctctagcagccatagatggactccttccccttctctccccagcagccatggatgcactccatccccttctctctccagcagccatggatgaactccatcaccttcgtcgcccatccttaaccatctcttttttccctgcagttgttgaagaagctgcaaccggccatgaaaaaagttgcatccacactccgaggtgctggaaccgactaggaaaaaaagctacgaccacctttaacctganggtggctgggaatcgggcatttttnctttttggctgggaancaatatgttcnttttggcnttcaangaaacactactctaagnttttttgctgatg

SEQ ID NO: 99872 - DNA, 459 bp, Triticum aestivum
  unsure (1)..(459): unsure at all n locations
  Clone ID: PAT_TA_99872
gcctcgtgccgaattcggcacgaggaccctcccagcgctcccccctcctcaacaacctcccggcgcatctccgactccatggcccgcaccaagcagacggcgaggaagtccaccggcggcaaggcgccgaggaagcaactggccaccaaggccgcccgcaagtccgccccggccaccggcggcgtcaagaagcccgcaacgcttccgccccggnaacgtcgcgctccgcgagattcgcaagtacaaaaaagcaacgaggtgntcatccgnaaagctccccttccaanaggcctgngtgngggganatntcccaaggactttaaagaccggactccggctttcaagtcctccggncgtnctccgcccctgnaaggaaggcgccgaatcctaactcnggggggntcttcccaggganaacaaactnctgggggcattccaaggccaaagngcgtnaacaan

SEQ ID NO: 99873 - DNA, 461 bp, Triticum aestivum
  unsure (1)..(461): unsure at all n locations
  Clone ID: PAT_TA_99873
ggtcaaaacatcatttacaatgggtattgacttaaagagacaccatgttaagaacagtaaccgcacagctcctaaatctgataacgtttacttggctttgttagtcaagctttatcgttttcttgcccgccgtacaaatgccgaattcaacaaggtcgtcttgaagcgtctctttatgtctcgcgtcaaccgtcctcctgtcactgtttcccgtattgttcgtaatgctaaggataataaagactattgttgttgttggnactgtcactgatgattctccgtccttcttggaacttcccaaagggttctgttgctgncccttcactttacaaaagactggcaagggctccgtatccttgaaagtctgggtgggcgaaatggtttggaccccttggattaantttggtccnccnttgccccctaactnggntnccaaaaaacaancccnttnatccggttng

SEQ ID NO: 99874 - DNA, 434 bp, Triticum aestivum
  unsure (1)..(434): unsure at all n locations
  Clone ID: PAT_TA_99874
gcctcctctcctccagataatacattaccatggcccccgccgtgatggcttcctcggctaccaccgtcgcacccttccaggggctcaagtccacagccggtctccccgtcggccgccgctccagcggcagcctcagcaagcgtcaagcaatggcggaaggatcaggtgcatgcaggtgtggccaattgagggcatcaaagaaagttcgagaacctgtcttacctggcaaccctatccaaggngggcctcctgaaacaagtccactacctgattcgctcaaaagtgggtggcctncctcnagttcaacaaggnttgggttcntcctncgtgannaaaacanctcccccgggtactaagaagggcgatactgggcaatgtnggagctgcctatgttccggtgcactgacccaaacaaggtgctgnacgaaggggag

SEQ ID NO: 99875 - DNA, 425 bp, Triticum aestivum
  unsure (1)..(425): unsure at all n locations
  Clone ID: PAT_TA_99875
gctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgccaaccgcctcccaacaaggggaagctccggcgggttccaagattggccgggcggggaaaacggggggttgnaactggaacaactgcaaatggcgggaaccgccgtggcgggtggtcctggtggaagctggaactgaacccngggcccaaaganggccgggcggcaaaaggcancaacaagattangaagngaaacaagcaatcatcaacaacatnaacaacaaccaangtttcaat

SEQ ID NO: 99876 - DNA, 424 bp, Triticum aestivum
  unsure (1)..(424): unsure at all n locations
  Clone ID: PAT_TA_99876
gcttatacaatgctcaacctggcatatctgagttgttgtctattctaacatcaccacaaaatgaagtctttcataggtgatagttcttggctagctctaacactccttctgcttcttcacttaatcacatctcctgtgctcagtcagagtacgggtcttgcaattgactactggcagacttctcattgtccacagccttgcaacattgcgggacctgacccatcgcaatggaaatactatcatgatgcaaatgctctgcagaaatgtaacgacaccaccatctttcaaatgaacctgtacaatgctgttgcgggttccaaacacccatgtactatatcgagccctgcactgcatctcaaggtgtgacgagctcccgttcgccattgcaaaggagggaagtttctggntctcaatggcaagtgcc

SEQ ID NO: 99877 - DNA, 465 bp, Triticum aestivum
  unsure (1)..(465): unsure at all n locations
  Clone ID: PAT_TA_99877
gtttgaacggaaggacaatatggtttgcanattgaaggaatatcaggttgttggacgtaagctcccttctgaaactgaagcttctcccaagctttaccgtatgagaatctttgctcccaacgatgttgttgccaagtctcgtttctggtacttcttgaagaaactccgcaaggtcaagaaggctgctggtgaaattgttgctttgaaccaaattcacnaaaagcgccctgaacaaatcaagnaactttgggtatctggatccgttangattctcgctcctggtactcacaacatgtacaaggaataccgngccatgaagccgtgtttggaaacccgttnatacnttgnccaaccaaactacatggggtggtncgtcancgttgctccttttcaaaaatctggttcaaaattnattccntggcttgctggaaaaccaaagggatncctgantgtccgtccgcaann

SEQ ID NO: 99878 - DNA, 454 bp, Triticum aestivum
  unsure (1)..(454): unsure at all n locations
  Clone ID: PAT_TA_99878
gacgtagcaagccatcaatcaaacaccacactaccgaagtcaaaccgcggccgatactttcacacgtcttggccatcacacctaccaacgtcaaacacaaccgcacctgggcacaccaagcgacaagatataagtcgcgccaaaactaccaactcgaggaaccatcaccatactcggcactactttcgccactaccacacaaccatcaacatgtctttcctcctccgcacatctaccctggtacgccaagaggctcttcactacctcaacacgtgctcgcaagtgccatctccatggaaagatgccgccgcaagcacaagatgacatccaaccctgggtgcgaagtgtcctnccaaagggctccggaagggtaagcaacgatngtatctcccggancaatggngggngggtaaccaantggnttttggggttacaatgcaactttacnganggc

SEQ ID NO: 99879 - DNA, 456 bp, Triticum aestivum
  unsure (1)..(456): unsure at all n locations
  Clone ID: PAT_TA_99879
gaccaagacccaacccaaacaacccactccgcttccgggccgagaagaaaaaaagctttcttcttccgccgcaagaagaaagaggccgaggaataaagctttcgtcgaccgcaagcagaagaaaccaaaccaaaccccagctccatggcgacggtggcgatggacatctcgaagcccccgccggccgcgtccggcgacgagtcggccaagggcgcgcgtggcggaggcgaggggttgcgccagtactacctgcagcacatccacgacctgcagctccagatccgccaagaagacgcacaacctcaaccgcctcganggccagcgcaacgaacctcaactccccgagtttagaatgcttaanggaagaagctaaaagtttactccaaagagccctggnctcctaatgttgggtgaaggtggntgaangncaatggggcaaatcaaagggtcctaagt

SEQ ID NO: 99880 - DNA, 345 bp, Triticum aestivum
  unsure (1)..(345): unsure at all n locations
  Clone ID: PAT_TA_99880
ggtttaaataagagcaangcgtaataccacgcatcgaaaccaatactacctgaatagaggtatgtatggttccaatacaacatgatattctaanattgttgcacttcanagttgacataaatgatcaccaaagtatacctctctggatctgcctcaactaaaaaagaaagcctacagcacatattcctcagcancagcactctaggantacanataagcataattctctccgtttcacatccgaaagnagctcataaatggaacagagatcatnanagagccgtccagcacaatttatggatcaaagattccatttatgccctgggtanannatatcatcccact

SEQ ID NO: 99881 - DNA, 450 bp, Triticum aestivum
  unsure (1)..(450): unsure at all n locations
  Clone ID: PAT_TA_99881
gcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccaagctgcggctgctcctgctgcagctgctanatncatcatcgatcatgcatgcaacgtgcgtgcgtgcatcatcgatcgtatcgattctactactaacaataacatgttaacccgcaaaccttgatncgaaggggcntttatgtnacgcaaccttgaacctgcaacaaanaagtcaag

SEQ ID NO: 99882 - DNA, 434 bp, Triticum aestivum
  unsure (1)..(434): unsure at all n locations
  Clone ID: PAT_TA_99882
gaaattataaagaaaaaaatgatccgtagaaatactcgtcttcgtagagaatacttgtataagaaatctttagaaacaaaagaacaagcgacatttgatcgcaaacaaaagatcaaggaagccattgaacaggggaaggatgtaccaactgaattaagaaagatggataaaggatcaaaagaagattttggttacgatcaagcacaagaagctcctacaacacatgaagacgatgaatatgctcgtgctggcgtttatgatccaaaagattttaattacaacctcaagagatcccagtagtcgtctacaacaattttcaaaagaaatgcgtcttgtattcccaaattctcagcgtatcaacccgtggtggtcatgttatgaaaagaaanttgtagaggcttgttagagcaaatgaagtaacaagatctcatcag

SEQ ID NO: 99883 - DNA, 429 bp, Triticum aestivum
  unsure (1)..(429): unsure at all n locations
  Clone ID: PAT_TA_99883
gtggtantgctacaagcgagtgacactagttcttgcaccgatcagatccaacttctgcacaggatgctggacaagctgtgggacgacgtggtggccgggcctcgcccggagacgggcctcgacaagctccgccgggccgccgccacccaacccctcgccatcaacacagctgcaggggaggcgattaagcagtcgccgtcgatgccgacgaccccgaccacgccggtgacgccgtcgtcgtccacgccgccgcgcggcggcancgtgtggcggagcgttttccaacccgggagcaanctgggcaacaagagctcggggncaanctcntcgaacgcccngnaagccaactcccccaacgtctaanaatgggtttnaaagcgacaagaacgaggacaaaggngcaaacaaccggttaattaaaagccgtcg

SEQ ID NO: 99884 - DNA, 434 bp, Triticum aestivum
  unsure (1)..(434): unsure at all n locations
  Clone ID: PAT_TA_99884
gtcgaccctgangaanaatgtgaangctcnaggaggagattcaacctcgcnattatggnaaaaacgccatcgcaacatcttattgactataccattggcgtcgnaatgaacggacgcatcgacatgggtacttgacgacggacaccggtatggatcgcttgtnacgagcaatcggtggtgacgcgcctctcactacgatcaggtaaatgggncaggnccancaggtatgaacgggganagactgggcagaaatgntcgcaggcacatttcattttccacttttctctcttttcagttttttcaatatttgttgnatcaatttatatattctggacttttttcggttgntttangcccaacatcatcangctcgaggggggggggaccggntaaccaaattccgccctannggggagtccnntttaccccgcggc

SEQ ID NO: 99885 - DNA, 337 bp, Triticum aestivum
  unsure (1)..(337): unsure at all n locations
  Clone ID: PAT_TA_99885
gtcnaccctgacnaatanatgtganngctcaangaggnnattcancctcncnattatgggaaaancgccatcgcaacatcttattgactataccattggcgtcgnaatgaanggacgcatcgncatgggtacttgacganggncaccggtatggntcncttgttacgagcaatcggtggngacgcgcctcncactangatcaggtagatggnncangaccatcaggtatgnacggngacagactgggcaaaaatgctcncaggcacatttcactttccanttttctctcctttcagttttttcaaatatttgangtctcaatttatatattctgggc

SEQ ID NO: 99886 - DNA, 186 bp, Triticum aestivum
  unsure (1)..(186): unsure at all n locations
  Clone ID: PAT_TA_99886
gcctcgtgccgaattcggcacgagggttcctcctgctctctgaacctcaggaagcaaggatactaggttcttgtagtcgttataataacctgctctcgtnggntgtcgatggtnatgccgcancgctgnccgcatcacacctgactctcnctgattttgcagnggaatatgnngtctttttgcgcc

SEQ ID NO: 99887 - DNA, 426 bp, Triticum aestivum
  Clone ID: PAT_TA_99887
gctcttcttcatcattaagcaacaaatatgaagcgaattgctcaactattgctcgtcgcacttgtggtcgtgtgctgcactgcgaacaacacggatgtgtgcttgaatccgtccaacccttcctacaacaacatcatcaacttcaaacagatcgatgttactactacttacgtcgaacttcctttccaccgtgaagtcaacgtcacttcgagcaactacaacaactgctggaccttcgagtgggacgatttggacattttccaacgcacttcaaccttgttcgacgaccacttctacggtagattgactggtactttgtacgacacttgcaaccacaaggtctacgaagtcgaagtctacgagcgctgcaagccaagccttggtccacgttcaatcaaaccaaatcgagtcctgtcactaattgat

SEQ ID NO: 99888 - DNA, 460 bp, Triticum aestivum
  unsure (1)..(460): unsure at all n locations
  Clone ID: PAT_TA_99888
tttttttttttttttttttttttttttttttttttttttttaaangcnctgcaaattatggctcgttgtaattaaaaagattagggtttgtatcangtcattatttcgtaaagagaatcctcncaatanaggtcactgccaagtcgncnagaactcntgttgcaccagtcncactttgttgtggaacatccancgttgngcttgagacaanactcnccatagcaagtactgcaactacgttgacgggcaagtttgcaccctgcacatgtcgggccacattcccaacantntctggctcangcctggncccattcnctccgggtggaaaggctccnaagggtgtccgtcccccctngggcctggnttatngaaaanttttatgaaaggggaaaanacagncgnccaactggtttncncccgcgggnaaggggnaaaacaangttggaaacnanaaacaatt

SEQ ID NO: 99889 - DNA, 442 bp, Triticum aestivum
  unsure (1)..(442): unsure at all n locations
  Clone ID: PAT_TA_99889
gatcaaatcacattgtgccttctcctcaaagatgccatcaaaatcctacctatttttcggcttggcgggccatgccatgacagcatgggcagcttgcgcacctggaaactacatgcctatactttcgaatttccaacttcagctgccgtacagcactaacggcggtagccctctttttgtgtctggctcgcagctaagtggttgtgacggcttccaaaatcctacctgggttctactgggaacgaagacaactggtaatctccgtcatgaatgcaacccccaattcttccgggctgcgccaaaaacctcaagnagtcaacaatgtcgcaaccgaatttgcgccgaagcaaaacccatccgagctgggcaacaagcggnaacaacaagatgactgtggagntggnggtcccaacaaccgaccaagggtctcaagggaaggngg

SEQ ID NO: 99890 - DNA, 469 bp, Triticum aestivum
  unsure (1)..(469): unsure at all n locations
  Clone ID: PAT_TA_99890
gtttcccttctcctcctacatactcgacaacccgacaacgaggaccatctcttttccggcaatctttcaagatggtccgttacgccgcacacacgatccctaacgcaaagagcgcccgcgcccggggctcttacctccgtgttagcttcaagaacacccgcgagactgcccaggcgatcaacggatggaaattgcagcgtgctcttgcctacctccgagaatgtcatcaaccacaaggagggccgttccaatgcgccgatatgccggatccaccgggtcgcactgctcangggcaaaggcattcggcgtctccaatggctcgctggcccgtcaagntctgctgaagcaatttgctcccggtttgtttganngaacnccctngggccaacnccgaacaccaaanggtctttgnacaaccaangcaaaccctcnggncngtccaangcacaattcaaggncaaaaccaann

SEQ ID NO: 99891 - DNA, 441 bp, Triticum aestivum
  unsure (1)..(441): unsure at all n locations
  Clone ID: PAT_TA_99891
gccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgaagaagggcgtcggcaagagcggcaagccgctgcactacaagggcagcgccttccaccgcgtgattcccgacttcatgtgccaaggcgggcgacttcaacaaggggcaacggcaacggaggggagtccatctacggngaagaaattcgccgacgaagaaattcctccaaaaagcaaaacaaagcccgggattctctccatgggcaaacgccggggccaaaaacaaacgggtcccantttcntcatcttga

SEQ ID NO: 99892 - DNA, 437 bp, Triticum aestivum
  unsure (1)..(437): unsure at all n locations
  Clone ID: PAT_TA_99892
atcgccatggcaaagccgtatgtgccgcatgacgtccttgacgagacggccaagacttcattggtcggcctgggcagcggcttcttcattgccgccatccaagaatgccctgtcgaancgcaacgtcggcgctatgagcgtctttacgcggggagctcccatcattggcatttgcgctgccggtcccggtgcctatgccttcttctcccggacgatgatgaacctgcgggagaaggangatgcttgggccgccgcctttggaggtttcatgtgngggaagtgttctcggacttcctttccgangcacacccatccgtgctgggnccttgggggctttcgttggcactgcccaagggcttttccaacgtcaccggagggaaagcttggacaagcttctaaaaaggagggaggatgagtttgagcgcaaaggagaatat

SEQ ID NO: 99893 - DNA, 430 bp, Triticum aestivum
  unsure (1)..(430): unsure at all n locations
  Clone ID: PAT_TA_99893
gcggtaatgcatccacgaaccttgactagtcttgcgtgatatgggcattacgatgaatcgagatatccatgcgccaactgttccctccggtccgacgaccgcggggacaggatttcgagacctgtcaaagctgtcgatggtcgagcttatgagtgagaaggaacgtatcgaagcggagttatcagcttatagcaccgtcttgacatctcaaggcgttactatggatacgagtttgacaactttcgacggatttccgcgcgacgacatcgatgtggcacagatccgtactacgcgcgctcgaatcatacaccttcggaatgatcacaaagaagtcatgaaacatctgggagaagggtctacatgcacactttgaagctctccagcaagcacaggcttcctctacgacacccaaccgttnccaaccaaacaa

SEQ ID NO: 99894 - DNA, 430 bp, Triticum aestivum
  Clone ID: PAT_TA_99894
gcacaagctaatctagcggcgtagctcacttcagtccagtcggcatggcggctccgaggggcgcggcactggtgctggcgatggtgctcgcggcgatgctggtggcgccgccggcgacggtgcacgccatatcctgctccacggtgtacagcacgctgatgccgtgcctgcagtacgtgcagcagggcgggtcgccggcccggggctgctgcaccggcatccaagaacctgctggccgaggccaacaacagccccgaccgccgcaccatctgcggctgcctgaagaacgtcgccaacggcgcctccggcgggccctacatcacccgcgccgccgcgctcccctccaaagtgcaacgtcgccctcccctacaagatcagccccaacgtccaactgcaactcgattcacttgaacgaactgaaagcgccctg

SEQ ID NO: 99895 - DNA, 479 bp, Triticum aestivum
  unsure (1)..(479): unsure at all n locations
  Clone ID: PAT_TA_99895
gtggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacancctccagcaggccttcagccaagtacggcgagatcctcgacgccaagatcatcaacgaccgcgaagncgggnaggtcccgtggnttcngcttcgtcacgttccggtaaccangagtcnatgcgccaaggccaatcgaggangatgaacgggcaaaggangctcgaacggggcgcaacatcaaccgtcaaaccgagggcccaatcccccgcccggtcccggncggtngggggnccngccggcgggcnngcttaacnggtnggccaaacnnccggcnggttaancgggaagggcttacgggngggngggn

SEQ ID NO: 99896 - DNA, 427 bp, Triticum aestivum
  unsure (1)..(427): unsure at all n locations
  Clone ID: PAT_TA_99896
cgatgattggcaacacttgtggctctcttgccctgaccggcctggataggtcgcatctacagcttcttcaatgcttcgtctgcaactccttgtcggtcttttaggcgactaccaatctctttcgcctggtagacaacgagaatgtcggcatcgatgactgtgatcatcattgcagtgtctctaggcatcatcgtggtaagctgatgtatactgcaagtctcatacaagccatcaccctcatcttttccatgatcttaaatttcatactacaaatttgcattgtcttcgaagaaaagctctcgggaagncaatgttgagaaaaaaactatctggaacttaaaccctattcaaagctaattnaagctcaaccgggtcnaaaaaaggaagaaagnaaaagcgaccaaaanggggggtcaaaactcctcaa

SEQ ID NO: 99897 - DNA, 429 bp, Triticum aestivum
  unsure (1)..(429): unsure at all n locations
  Clone ID: PAT_TA_99897
gcccactcgatccaaatcgagcacgccccccggccatggcctcgcacccaaccacttcgcggccacctcccccgtcgccactgtaggcccgccggcggccgcggccacctcccccatcgccaccgtaggcctcgccggcgcccgccaccaccttgctagccgccatgtcgccggccggccccggccacgctggccatcatctcgcccgccggccccggcctggtcacccccggcggcctccgcgccccggcgctcgtcaccctcggcagtcttcgcgccccgttgcccccggcggccccgaccccgtcacccccaccggtctccaccccgggcaccggncgcggcctcgaggtcgcgtgctctgcctcgcgagctcaacgcgacaagcaagcggggactccgcctttgcgagcactgccaatccatgac

SEQ ID NO: 99898 - DNA, 460 bp, Triticum aestivum
  unsure (1)..(460): unsure at all n locations
  Clone ID: PAT_TA_99898
gatcataatttgccatcggttttacaagttctgtgctccatttgaatgaaaattgattggtgtagctgcgtagtgagcaaatgcaaccattcatcaatcatttaataaaaaaatggctattcctaattcataacatcaatgagaaatagacttgaaaggaaaagtagatgcaagcaaagaaaaaggacgcggggttagcggcctcgcagtgtagtacaacaaagaagttgccatggagactttgagcgtccgcgtcctcctacgggctgggattaaggtggaggganggccaaccccccccaaacgcaaaggattccgcaagcgccaatccaaaccgaanctgctgggtgggtggggctggctggctcccccaaactccccnggggaaaaaantggggggngaagctccgnaactcccctggaagcnngccctctncaaccaagccaangggttcccggc

SEQ ID NO: 99899 - DNA, 474 bp, Triticum aestivum
  unsure (1)..(474): unsure at all n locations
  Clone ID: PAT_TA_99899
gctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcggggttcgagacggccggggagaccggcggctgcgactgcaccaccttgcaagtgcggcaccgccgttgcgggcttgctcctgctgcaggctgcaaactnaagcccgggcgcccaaggaaggncgggccgggcaagagggcgaacaacnaaggatttaanggagggacaaagcnaagcaaagcaaccaatcaaccaacaagtttcancaaccaaccccaagnggttatcatcancaaanccggccgcaatgcgcttcgcng

SEQ ID NO: 99900 - DNA, 470 bp, Triticum aestivum
  unsure (1)..(470): unsure at all n locations
  Clone ID: PAT_TA_99900
gcagcctcctcactcctcaaagcatcctctcagtccttagctcgccaccacccacccaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggaagctccggcgggttcgaagatggccggcggggaaaccggcggctgcgactgcaccaccttgcaagttgcgggaaccgccctgcggcttgcgccttgctgcaagctgcaactggagccgggcgcccaaagaagggccgggccggcaanaaggccaancaacaaaggattaaggaaggagaaagcaaagcaaccattaaacaagtttaacancaaaccaaanggttccaattttggttaacaagccggctgcaatgcgnccc

SEQ ID NO: 99901 - DNA, 471 bp, Triticum aestivum
  unsure (1)..(471): unsure at all n locations
  Clone ID: PAT_TA_99901
gccatttcgtgtactcatacctattctctctcaggacatctaccttactttctactacccaacaaaattcttaatacaagccaaaatgcctcgtcaattcttcgtcggaggaaacttcaagatgaacggagtcaccgactccatcaagtccatcgtctccaatatcaacaaggcaagatcgtgacccttccaccgaagttgtcattgcccctcccaccatctacctctcactcacccgcgaactagcccgacccttctatcggcgttgcggntcaaaacgtctacgacaaagccaacgggtgctttcaatggggggaaattgagcggttgagcanctcaaagggtacaaaagaatgggttgggctccttggttgggncaacaatggagcgtcctgtttttgttgcgggaaaaatgaacgatttccnttggcgcgcaagaacaaaggntggctaattgatgggngggtttng

SEQ ID NO: 99902 - DNA, 250 bp, Triticum aestivum
  unsure (1)..(250): unsure at all n locations
  Clone ID: PAT_TA_99902
ggctcttcggggcgccgatatgccttgggcatggactaccttgcttagaaattggttgataatagaagtcttagacttactatgaagtttgttttagaccatatctccaggatttcgtctggctatatacgctttctgtttttcatgtccgtaacactcctttcggttggcttatgatagtaatcaggggggggacagattactctgtnctccaatgattccaaagaatacattcgtgtcgtcttctaca

SEQ ID NO: 99903 - DNA, 426 bp, Triticum aestivum
  unsure (1)..(426): unsure at all n locations
  Clone ID: PAT_TA_99903
gctcagccctctactagctcaagcaaattcccacagagacgttctgttaacatactatcaagatgaagttctcagcaactatcattgctctctttgctgctggagctttggctgctccctcgggccatggtctcgctgcccgcaccgaggcacgcgctgctggacgtagccgtctcacccgtcctaagcaacccgcctctggagctctgaacggcgacctctccaccgaagctgccaatgccacttacgtcgactactcctccaattggtccggagctgtcttgacctcccccccccgccgggngccaccttcacctctgtctctgcgcaagttcaacgtccccaacccccangcccgttaaacggccaaggctggntcttcttctgcctggggncgggtatcgattggcgntaacctacgggaaa

SEQ ID NO: 99904 - DNA, 457 bp, Triticum aestivum
  unsure (1)..(457): unsure at all n locations
  Clone ID: PAT_TA_99904
gcctcgtgccgaattcgatatcaagcttatcgataccgtcgacccggaaccaacaaatccccaaccaatctcgtctccgatcgactccaggctcgtcgaatccccaccgcctcaagatgcagatctttgtgaaaacactgacaggcaagaccatcacccttgaggttgagtcgtctgacaccatcgacaatgtcaaggccaagatccaggacaaggagggcattcctccggaccaagcaagcgtctcatcttcgctggcaaagcaagctgggaggatggccgtaccctcgctgactacaacatccaaaaggagtccaacctccaactttgtcctgcgtctgcgtggtgggatgcaaatattccgtgaagaacctcaactggnaaagaacatcaaccttggaggnccgaagaagctcccgacaacaaatngacaaacgtncaaagggcaaaagattca

SEQ ID NO: 99905 - DNA, 431 bp, Triticum aestivum
  unsure (1)..(431): unsure at all n locations
  Clone ID: PAT_TA_99905
ggagctctcccggcgaccggcgcacctcttctcgccggcacttctccccttccggcgcagctcctcgacggatcacctcgctcgccacatcggccgcagatggcagatcccggcgccggcggtgacctttgggcagtccttcgacgcgctctgttcatgttggtgacttccctctctccgatcgcagcgtcgtacagggtgttcttgctgcacaacaatctcaggcggccgaagcaaaagaagatgaaggaggagcangatctgcggcggcacgagcttctccggcgcgaacaagagccccgggcaaangtggccgggctgcanggcgncctttgcctggaagctccctcttgccgttgacggtaaatgacggacgaagtgcttggngtgcccgtgtcaaccggtaacctcaaattgtacccgtttgacaa

SEQ ID NO: 99906 - DNA, 435 bp, Triticum aestivum
  Clone ID: PAT_TA_99906
gctccactccactcccctcgcttctaccatccataccagcgaaatggccacctctccccctcccaccgccaccggcatgcccaaggtcgacgccgcaaaggccaagattggcgcctcggacccaactgcgccctctggtctgggactgtacgcgcgattcgctttcgccggtgccgtctgctgctccgtcacccacggtgccctcacacccgtcgatgtcgtcaagaccaggatacaacttgaccccgtcacctacaacactgggtctcatcggtggcttcaggaaaaccattgccaaacgagggtgctggcgccgtctggactggtttcggtcccaccgccgctggttacttcctccaaggtgccttcaagttcggtggttatgagttcttcaagcaacaaggcaatcaaacatgggtcggctacgaagaccgc

SEQ ID NO: 99907 - DNA, 435 bp, Triticum aestivum
  unsure (1)..(435): unsure at all n locations
  Clone ID: PAT_TA_99907
gcctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcaagcacggaggccctcctcaagcaggtcgactacctgatccgctccaagtgggtgccttgcctcgagttcaacaaggttgggttcatcttccgtgagcanaacgcatcccctgggtactaatatgggcggtaatgggcaatgtggaaagcttgcctatgttccgggtggaaccgacnccnaaacaaagtgatcaaacgnaggtgggaggagggt

SEQ ID NO: 99908 - DNA, 443 bp, Triticum aestivum
  unsure (1)..(443): unsure at all n locations
  Clone ID: PAT_TA_99908
gctgccaccttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgaagttcaacaaagggttggcttcgtttttccggtgagcacaaaaagctcccccgggtactnacgatgggtcgatactgggacaatggnggaaagctgnctatgttccgggtngaaccgaangccaacacaagggggctcaaacgaaggg

SEQ ID NO: 99909 - DNA, 445 bp, Triticum aestivum
  unsure (1)..(445): unsure at all n locations
  Clone ID: PAT_TA_99909
ggtgaggaaagcatctcgaagagaggctcagcgttcaagatgcagatcttcgtcaagaccctcacgggcaagaccatcactctcgaggtcgagagctctgataccattgacaatgtcaagtccaagatccaggacaaggagggcattcccccggaccagcagcgtctgatcttcgccggaaagcagctcgaggatggccgcactctttcggactacaacatccaagaaggagtccaccctccacttggtcctccgcctccgtggtggagccaagaagcgcaaagaaagaaggtgtacaacactcccaaagaagattaagcaacaaagcgcaaagaagaacaaagcttagcggtcctcaaagtactacaagggcccaacngtggacggnaaagatngaagcgnctccggccgcgaagtggccccaaaggccgagtggcnggtgncg

SEQ ID NO: 99910 - DNA, 429 bp, Triticum aestivum
  unsure (1)..(429): unsure at all n locations
  Clone ID: PAT_TA_99910
gggccacgcgcaaagcgaaacgctccccgactccggccaagagctccagcgccgccgccgccgaccgtcgttcgtccatatggtgaggtccaactccatcgacagctgctactcctccatccaggacgtcacctacagctgcgggtactgcggctacgcgctgaacctgagctcggcggcgcggnacacggccaacatcggctccaagtacggcaagcagatcaggaagaagggcatcgtggccttcgtcgccgtcgacgagacgcgcttcacgcaggccgacgaggtcacctgcgcgccccgcctccgcccctggacctggcgcctcttccggcggaggtcgcgcctgctctgcggcaagtgcggggggcgcatcggcgccgcctaagaaggtcnacganggaaggacnaggaaccccgccgggcctc

SEQ ID NO: 99911 - DNA, 303 bp, Triticum aestivum
  unsure (1)..(303): unsure at all n locations
  Clone ID: PAT_TA_99911
gtagaatcaaaaatgctttcgctaggtgtaatgcagaaatgttccagggcatcggagtagtaactattgagaaatcactacgtggtactgtagaacacactagatttagccattcatgtacacaaagtttacaccgtataaaaaaggaggccgtactactttacacgattcccggatgaaaatgttcaaaaaaaaaaaaaaaaaaaaaaaaaaaaaaaaaaaaaaaaaaaaaaaaaaaaaaaaaaaaaaaaaaaaaaaaaaaaatncaanggggnccnggggggccaaatggagcccaaaaat

SEQ ID NO: 99912 - DNA, 416 bp, Triticum aestivum
  unsure (1)..(416): unsure at all n locations
  Clone ID: PAT_TA_99912
gcctcgtgccgaattcggcacgaggccaggccacagttgtttaagccactcactctagcttgcatatcataagcttcaactanccggttcaactcaactgcatattctgcacagncatgaagcatcacgctctgcnanagttgaaaccatcttctgtctgttgccatggcctccttcaagctgacnaacctgtgcttcacacntgtcatgttctttgctgtcttctcctgttgcacanggcatggaggtggtggtgctggatcangancggggaggcgganngggggtcgggcattggtgcgatngtaccagggaacgcaaggactcgggtccanattgtggncgcaagctgctctcctgcntttnacaaacagaccantggctccaccggggtggcctgcaaggcgatggggaat

SEQ ID NO: 99913 - DNA, 464 bp, Triticum aestivum
  unsure (1)..(464): unsure at all n locations
  Clone ID: PAT_TA_99913
ccgcttcagtcatggcaactcgaacagaaacaaaaaaagatgtattaagctctcttgcttcccgcttctacatctgccaacagcgcaacaagctccttaccaccctcactagctggcccttcaattcccaaggcctgctcaacccaagcgcgagcctcatcccaagcgacccatctcaagctaaacacttcccaccacgccaccatgccttgacgttgcccataggtttgcactccgcactacatttcgagtcaatccaaccctccggccatgattgttgggacatgtatgcctgagcgcgattcgcatatagtccaagacaattcgtcacgaatcaagattcacggggttncccanggccggtcgactgatcgccaatatctatcncgttagccatnataacttggattgccttcctgcaataggttgggtttttgccaaaatccgccggtgtttcgccgggg

SEQ ID NO: 99914 - DNA, 430 bp, Triticum aestivum
  unsure (1)..(430): unsure at all n locations
  Clone ID: PAT_TA_99914
ggtttacaatcaaaggtcaaccacagcaananaccttcangcatnactatntacagaaaaggaggtcgcgaagattctaattgacaagatatcttatgcttttcactccagatcgcttcgtgaagaagcttttggataaagttttctggcactcatgagaattggaagaaggcatgggaagcttcagcactatttgaaaagctttttccggctaaagagttggaatataanccttgggttagtggtgatccgtgctaaaatgctgtctatcgagaactctcgtgaatatccattgctgttacaaagtcaaaatctcagattgggccanaaggattcttcntgttgtgaantggctttgcttaccaaacatcgaaatcttttgaatttggggtgcttaaatttccttttttccgagagcgttcaacggatt

SEQ ID NO: 99915 - DNA, 451 bp, Triticum aestivum
  unsure (1)..(451): unsure at all n locations
  Clone ID: PAT_TA_99915
gatcaaaactattctctactaccccccacttgcctttttatttttactcttctactcctttttattttatttactgaatgaatgaattgccctgctgtttacttctgttcttcagttcattgtattttccacnaaattaaagtagctttgattcattctggggtgccagaaattaacntgcttgtagnatgattaaatcacgctctanctaatattttgtttcatgcatgtatggtnaaaataaataaataacanggaagacatggggcagcatccctgatatcaagagtanngacctggngagcaagagggcgacctggttcaaggcccccgggtgcccaataactccaangagnccggctgcttgggccctccgtacncccggtcgncgggccggncaatctnctatgnatggtctcggggnggangaacaancgccatggggaccgaa

SEQ ID NO: 99916 - DNA, 363 bp, Triticum aestivum
  unsure (1)..(363): unsure at all n locations
  Clone ID: PAT_TA_99916
ggcacaattgctatactcagtattccagcgtccccgcaaagtggaatagccattgtacatctcatcgctgaagatgncaactctatttccaacatggnccttcatcctctttgggattttgganccactctccatggtcggtggtactctcgccccgatnatcgacacggataaattcatcgccggtcaaaactctcttgcacaccctcctacnctgccacaccatcccancgttctcgccttgaactaccacctanncaaacatatntggtcttgtangcatgctcggtntgggaatcatctacggcaactcccgagcntctantgctggcacaaatgccgtccgcggggtnctgggnaatc

SEQ ID NO: 99917 - DNA, 421 bp, Triticum aestivum
  unsure (1)..(421): unsure at all n locations
  Clone ID: PAT_TA_99917
gccagcgctctgcccccgacctgagtacctgacgaaccctaagccatcgccggtcgccgcccgacgcccgccgtcgccggtcgccaccaatcgtcgaggtccagctccgtgcaccccggatctccctttccagcaccccccggatctcccccttccagcgcccaccccctccccccggctgcgccgctgtggcctgtggcctgcggntgctgtcctgttcgtcgtgtcccggcgacgcggctagggcgcaaggcggagaacccggntagggcgcgagtggtgcgangctgcaancctgcacgcagctcgggcgtcaagcgangattgccatctattttttaatagatgccaatccttagnaacggncgnaacccngaattttcaaagggttnatcgcnacaacgttaaagggtngtttttg

SEQ ID NO: 99918 - DNA, 435 bp, Triticum aestivum
  unsure (1)..(435): unsure at all n locations
  Clone ID: PAT_TA_99918
gcgcaattcagccacctctcccagacctagcggcactcgagaccttacctgaacggaggaaaggtcggacctttcagacaacctgtgatcatggacgccatggtagcgaaagctccagtagacccagagacagtagttgaagatgtcgagcacctcagcatttccccatacgggcccgcaagatcatcagtcaccgaacatccgctcagcgaagatgaggtgcaaaagatgactgattatttccatgcttctctgtacatgtgcttgggcatgatctatcttcggaggaaacctcttctccgcgaaccactcactctggnccatctcaaagcgacgccttttgggaaattgggggatcagatgctggggcaagngcttcacaaggattcaaaatganaccgtcctatcaaagaaagtacgaatttgggcgccttt

SEQ ID NO: 99919 - DNA, 428 bp, Triticum aestivum
  unsure (1)..(428): unsure at all n locations
  Clone ID: PAT_TA_99919
gagttcaatggcagcaattcaggcagactgctctggcgaagagacaaggacaacttttcacccgactctgtggggtgattacttccttcaaaacaagccacaatcttcagcgcagcaagctcacatgagagaaaggatggaaatactattggagcaagtaagaacggtgatgaaggaggcaaatgaaatccccaaaatactagagcttgtaatcacaattgagagacttggtttgggcaaccattatgagaatgagattgcacaactactgggatgttgttttgaaatctgattatgatgataataatctacacttggnttcgcttcggttttatcttctacgaaaaaatagatatgatgtgtcaacctggntgtattccataaattcgaagacaaacaaaggaggntttggttcaatcggatacaaa

SEQ ID NO: 99920 - DNA, 404 bp, Triticum aestivum
  unsure (1)..(404): unsure at all n locations
  Clone ID: PAT_TA_99920
ggtagattcttcaataagatcttgattggttcttctcatcanaattattcaatggatgacttgttgaacttcttaaacaaggtgcatcgttccatgaaatgttactacattgagcaatcagtagcaactcaagtattaacagaattattgaaattaattggtgtaacagcctttaataatttgctgatgagaaagaacttttgttcatggaagcgaagctatgcaaattcaatacaatatcacacggcttgaagaatggtgcaagagccatgatattcctgaaggagctcttcaantaagagcatttaatgcaaacancaaagcttcttcaattcaagaagggaactgtcngaaagacaaccanaatatttatgatgtttgctgggataataacacctacacaa

SEQ ID NO: 99921 - DNA, 409 bp, Triticum aestivum
  unsure (1)..(409): unsure at all n locations
  Clone ID: PAT_TA_99921
gcctcgtgccgaattcggcacnaggcccattcatctcctctctcgatcacgattaacctgtatatacactatacagtgtcatatcgattgaatatcttctttttctataaaccacctttgttataactgtcgtcatggccgaccctgttggagatttcggcctcatcngtctggccgtcatgggtcaaaacctgatcttgaacactgctgaccacggtttcaccgttgttgcttacaaccgtactgtctccaangtcgaccgcttccttgaaaatgaggccaagggcaagtccatcgtcggcgctcactctatcgaggaattctgcgccaagttgaagaagcctcgccgcattatgctccttgtcatggctggcaaggccgtcgatgacttcatcgaagaacctccttc

SEQ ID NO: 99922 - DNA, 420 bp, Triticum aestivum
  unsure (1)..(420): unsure at all n locations
  Clone ID: PAT_TA_99922
gaaggatcttatggctatcggcaagaataagaaattaggaaagaagaagggtgccaagaagaaggttcaagatcccttccttagaaaggaatggtacgatgttaaggcccctgccccattcaccaagagatacattggcaagacctgcgtcaccaagaactaccggcacaagaatcgccaccgactacttgaagggaagagttgtcgaaacctcctatgctgaattgagcgacaaccaagacagctggagaaagatcaagctctctatcgaagatatccaaggaaagagcctgcatgaccaacttccacgctatggatatgactaagagacaagacnttggcaantcatcaagaaagtgggaaaactttgatncgacgctaactngcgaagncaaagactaatggatgggttatgttttc

SEQ ID NO: 99923 - DNA, 436 bp, Triticum aestivum
  unsure (1)..(436): unsure at all n locations
  Clone ID: PAT_TA_99923
gtttttttttttttggtaccaaaaaagataacgtttcgagcaaaaataatctcagcagtacaaatatgagaaaggcgattgtagcaaataaaaaaggcagttccagcaaaaaaactcagcagcaaacacactagttgattgcagcaacaaaaaaatgtagttccagcaaaaaataatggtaagttccagcaaaaaaatagctggttccaagcaatggtggaccgccgccgtcgccgacgcaacacggtcgtcgccaagttccatcaatttgtcttgctgggttgcagctcccgggacctacacttgtagctccgccgcgcccgaggtttgaggcatcttccgaatgggggttgttcctcctccctacgaacgggagccggaggcgcgcaaaattcgtccgtnccgtggaacaaaagccaatctggtttggggggaa

SEQ ID NO: 99924 - DNA, 407 bp, Triticum aestivum
  unsure (1)..(407): unsure at all n locations
  Clone ID: PAT_TA_99924
ggttagatgtactcatgtttgttgctattaggatcaaatatcaatgctagttgagacatactacttgccatcttgaaatataaaatgtttttataggctaaactagcctacaaaaacgtatatacattttgagactgaggtagtacttgttagttctgaccatgcctagcttaaggactgatcggtattcttcaaaaaaaatcctgcatatgttcgtacattttcctatctgaattaatgttgaatgtattttggtgtgtccatgtgacattcgaggcacatttttgtaatgtatgttagtatatggtgctgtgaaacttctacgattgaacataccacagcaagctttagaagtaactttcttccatctncaaaagctgagaggcagaggggaggggcacatagtt

SEQ ID NO: 99925 - DNA, 415 bp, Triticum aestivum
  unsure (1)..(415): unsure at all n locations
  Clone ID: PAT_TA_99925
gctattcgagactcgcataatgccctcgcatcaacccgttagattgtacaccaaggctaaagttgctggctaccaaaggagcttggctactcaatacaacgatgtttcgttgttgaagctcgaaggtgttcacaccaaggccgacactgacttctacatgggcaagcgtgttgccttcgtgtaccgcgctcgcagaaccaacaagagcggcaacaacaagaagaaaagcaacattcgtgtcatgtggggcaaaattgtgagacaccacggtcacaacggcactgttcgcgccaagattcaagacgaaacttgcctcctaaggctattggtgccaccgttccgtgttatgctctatccttctcgaatctaagtcaacaacacttgtttaaaataacaataaaatacgctcccttan

SEQ ID NO: 99926 - DNA, 411 bp, Triticum aestivum
  unsure (1)..(411): unsure at all n locations
  Clone ID: PAT_TA_99926
gggcgtgtccggctcggccgtcgccatggagacgagccacgtcacgctcatgtccaacgacgtccgcaggatccccaaggccatccggctggcgaggaggacgcgccggaccatcgtcaccaacatcgtcttctcggtcgccacgaagctcgccatcgtcgggctcgcgctcgccgggcacccgctcgtctgggcggccgtgctggcggacgtcggcacgtgcttgctggtgatcatgtacaagcatgatgttgctgagggggggagacggcgggaggggcaagaaatgctgcgcttcttctcaccatggatctcactctcaccccaagaagcatggccattgctcggacggtccgtgcaatttgactggcggctgcgcggattcatctgctggtgggncatgcttgcggc

SEQ ID NO: 99927 - DNA, 413 bp, Triticum aestivum
  unsure (1)..(413): unsure at all n locations
  Clone ID: PAT_TA_99927
gtctcttcctcctctttataacttctccatctcccctctccactcccccttctgttgtgttcaggctttggggttaatttgctttactcattgaatgagtcgcagctctgtctgtcttgcctagagatatcaagatgatctccactaggctctcccgcttgggtgcggtgggcaccaagtcccgagttctcctcggttctcgtggactggccaccgtgtctgattctccccttgacaagaaggtcgaaatgaccaactgggaaaagggaaactacattaactacaagaaattttcaagagaacctcgccaatcgttcgtgggcgtcttaaccgaccacttaccttcgccggagaagatnatctactcccacttggacgaccctcaagggcaaagagattgagcggggggaagt

SEQ ID NO: 99928 - DNA, 411 bp, Triticum aestivum
  unsure (1)..(411): unsure at all n locations
  Clone ID: PAT_TA_99928
gcagaaacatggncaatctggctctgattttctatcttgcatccaccgccctaaggctgcagtaagctctgcatcttgggcgggacgcgcgtcgacccctcgtacaccgtacacatcagctctctgccacggatccccaccgcgcccgtgtacagcacctccaattctcaaaactgtgcagtgcgacgaatacctaaacgtgaagctcatacgtcgtgcgtacaagtgccaaaatgctcgtaaacatacagaaaagacataggagatatcgcaagtcgtaatccaaaatggcaaaatggtataaacagtgccgcaaaaccccgcgtgcacacggaaagatgaagtgaagaatgcaagtgaagcagtgaaatcggtcgccaaagtgatgcgggaacaatagaaaagctctgc

SEQ ID NO: 99929 - DNA, 407 bp, Triticum aestivum
  Clone ID: PAT_TA_99929
gtgcagttgatggcaaacaaattggtgctgtccagagcaaagatctttgcagggctttcttcgatatgtatatcggtgacccgcctgtttcagtggagaccaaacaagacatcgctcagaatgtgggtggactcattagaagatgctagggtaatggctaactaaatagccggcggttggaattatttgattcttctattaggggggaaagagcatatatatagatacgggaaaccaggagaagatcggttgtatgtatagtagtgatagatctgtaacttgtaaactatagactggcagaacttgtaacttgcagaggcttaacatcttctcctgggcaaatgcctccatgattttcatatgggttggcattttgctgtttcctggattgtatcatgtacactgaa

SEQ ID NO: 99930 - DNA, 413 bp, Triticum aestivum
  unsure (1)..(413): unsure at all n locations
  Clone ID: PAT_TA_99930
ggtggtgcagatgttcgatctgctacgccgcacgaacgcaccactccgtgactacctccggtcggtcctcccctccgtgcgcgctctcgtcgtcgacatattttgcgtcgacgccctcgacgtcgccacggagctcggcgtgccggcatacctgctctacacctgcagcgcgagctgcctcgccgtcaacctcaacctcccgcacgtgcaggccaggatcgacgccaccggagatgtcggcggcccggtgctctcattcccgggcaatcgcccgatcaaactcacggacctccccgacggtactttcgaccccaaccacgaagccgttcaaaggagttcctgcacttgtccgcgcggacgctggagttcaacggcgtcctcgtcaacacgttcgagtggctaaangcgaaggc

SEQ ID NO: 99931 - DNA, 410 bp, Triticum aestivum
  Clone ID: PAT_TA_99931
ggaagaagcgaacgtgtctgctggattgatggaggcggataagggaaaagatgtcgactttgttgatgaagacaaggagcaggcggagatccaagccgcggctcggaagtgggacgacattatgcggtcgaggatcgatttaatgcggcgacttggccaacccgtcaggcttttctaccccaacaatccggtggatcctcgcatcctcctcaatcgagagagcaactgcgacaagatcgacacgggcgccgggtatgaaccctcaactctccaagttccttccctcttctttatgcggttccatctctcaggggttgtttggatctcagtttgacctctaaaaaacttgtctgtttagagtctaaattcggagtactactccgattgtttcctcacaagatctgaaattc

SEQ ID NO: 99932 - DNA, 415 bp, Triticum aestivum
  unsure (1)..(415): unsure at all n locations
  Clone ID: PAT_TA_99932
ggaagataacctcgaaatcccctcaccacaaaacgtcctcatgcctcccttccccggcggtaatctcgaaggcgatgacggcaaaacctcaaatctaatcgtctccgacctcctcgtcaaaacgcccaaaatcaacgtctttgcatctctaacccgcgacttccagcctatcgcaagtcgattaaacgatatatcccaaaacacgactgttttggccccgctaaactcagccataaacgctctgccgcgcaaaccgtgggaagatcccgaggattatgaacggtttggtgatgcaaaaggcgtatacggggcgaagaagggcangatanagcgacgagaaatttgcanaggtttgtggaggcgcatttggtgcctgtgagtccttggacggaaggggaaggaggttgaagactgt

SEQ ID NO: 99933 - DNA, 412 bp, Triticum aestivum
  unsure (1)..(412): unsure at all n locations
  Clone ID: PAT_TA_99933
gccgaancagaaaaagcatcgtctcgtctcgtctcgtcgaggaacctcgagaagctgaagggcggnaaggggagccagctcgaggccaacaagaaggccatgaacatccagtgcaagatatgcatgcagactttcatctgcaccacctctgaagcaaagtgcaaggagcatgccgaggcaaagcatccgaagagcgagctcgtccagtgcttccctcacctcaagcagtgatatctgcccaatcagacagagagagagataaaagatagagagagagagaagctgtcataatccacctactattatcatgttccgcaatgactgattgttgacctaagcttggggtctgaactcggtgtgctgctgtcccggctgctttggttgtgtgcccatctactatgtaatcgtcctc

SEQ ID NO: 99934 - DNA, 295 bp, Triticum aestivum
  unsure (1)..(295): unsure at all n locations
  Clone ID: PAT_TA_99934
tagcgtggtcgcggccgaggtacaacnnngaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttgaaaaaaaaaaaa

SEQ ID NO: 99935 - DNA, 412 bp, Triticum aestivum
  Clone ID: PAT_TA_99935
tagcgtggtcgcggccgaggtacagaagagcaccgagctgctcatccgcaagctccccttccagcgcctggtgcgggagatcgcgcaggacttcaagaccgacctccgcttccagagctccgccgtctccgcgctgcaggaggccgccgaggcctacctcgttgggctcttcgaggacaccaacctctgcgccatccacgccaagcgcgtcaccatcatgcccaaggacatccagctcgcccgccgcatccgtggcgagagggcctaggctgcttcctagaatcctagtgtctgatctggtctcgaggtgtagagatgcgttactagtttcttattagcccttgtctgtggtagtaaggttcctcgacagttgtgttatggtgtgatgtacctgcccgggcggccgctcgaa

SEQ ID NO: 99936 - DNA, 294 bp, Triticum aestivum
  Clone ID: PAT_TA_99936
tagcgtggtcgcggccgaggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttgaaaaaaaaaaaa

SEQ ID NO: 99937 - DNA, 447 bp, Triticum aestivum
  Clone ID: PAT_TA_99937
tagcgtggtcgcggccgaggtacaatgatacaggcctcgctgccaatactcagcttgtgcacctaaactactacacatgttgtgtttgtgctgtctggtgctggtaacaactgggccaagggtcactacaccgagggtgcagagcttattgattctgttcttgatgttgtcaggaaggaggctgagaactgtgactgccttcaaggtttccaagtatgccactctcttggtggtggtactccttggggcgcaccacgttaacgtcggcgtagaccctggcctttgacatggctgaagacgatccggatcccgcgggcgggcgacggatcagagagaggggagggctcggaggagtttggtgctttctcggcggcgcgtccgtcaagcggacatcgccggcggcgagatggcgctagggtttcaacacctgcccgggcggccgctcga

SEQ ID NO: 99938 - DNA, 290 bp, Triticum aestivum
  unsure (1)..(290): unsure at all n locations
  Clone ID: PAT_TA_99938
atttaaaacaggtcaaatttggaaaattcggacggaaaaaaccttcccgaagggaacggactttgtctgatcaacnaaacaaaaaatggaacaatgaaatgacatccccttcaaattcaacaccanntccactgttgaggggggaaaggctaaatcccttccaaattnnannnnnaaaaatattggaannaaagaaaaaaaaaatgccaaaacccaaaccatttcctttcaggaaaatttcaacaaannaaatgaaaatgatccaaaaaaaaaaaacctaaattaagaag

SEQ ID NO: 99939 - DNA, 268 bp, Triticum aestivum
  unsure (1)..(268): unsure at all n locations
  Clone ID: PAT_TA_99939
ttccatcggccgccgcgggcnngtagacaggcgtannatcgccgtcacctgtgctatcgtttggcaccagtacagctcccagcacgcgttcccgacctggatgccggcctggccgatgtggatcgagatgcactccctcatggcggcgggtgggggtggttggtgggtgcgccgctggcgaannggggaggaggtgggcggtaggctcggttgcgcggagagaggcgagtacgaagacgcctttcccacctcggtcgcgaccacgcta

SEQ ID NO: 99940 - DNA, 504 bp, Triticum aestivum
  unsure (1)..(504): unsure at all n locations
  Clone ID: PAT_TA_99940
tagcgtggtcgcggccgagggggattttagcctccagcgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcctgaacgctgcccgctggtacgacgccgtcgccgcggccgtttcttcaaggttccctggccaggcctctggggtgagtgcatcctcggctcctgctgcagctgctcctgctgcttccaaggatgaagatgatgacgatgacatggatctgttcggcgatgagaccgaggaggacaagaaagcagcagctgagcgtgaggctgccaagcctgcaaagaagaaagaaagtggcaaatcctccgtcctcatggacatcaagcnn

SEQ ID NO: 99941 - DNA, 502 bp, Triticum aestivum
  Clone ID: PAT_TA_99941
tagcgtggtcgcggccgaggtacatcaaaacaacagacagcggcgagatgcggccattccattacaccgaggaacatgaacactcaacaaccatggctagctagtgaatctggcggcgcgaggtgggttctgcgggaccggcgtggcctagccgccgaatccgtagagggtgcgtccctggcgcttgagggcgtagacgacgtccatggcggtgacggtcttgcgacgggcgtgctcggtgtaggtgacggcgtcgcggatgacgttctcgaggaagatcttgaggacgccgcgggtctcctcgtagatgagccccgagatgcgcttcacgccgcccctcctcgccagcctccggatcgccggcttggtgatgccctggatgttgtcgcggagcaccttccggtggcgcttggcgccgcccttgccgagccccttgccgcccttgccacgcccagacatcgccggagatgagatggaagcagtctaacaggggataatgacc

SEQ ID NO: 99942 - DNA, 412 bp, Triticum aestivum
  Clone ID: PAT_TA_99942
tagcgtggtcgcggccgaggtaccagaagagcaccgagctgctcatccgcaagctccccttccagcgcctggtgcgggagatcgcgcaggactttaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctaggctgcttcctagaatcctagtgtctgatctggtctcgaggtgtagagatgcgttactagtttcttattagcccttgtctgtggtagtaaggttcctcgacagttgtgttatggtgtgatgtacctgcccgggcggccgctcga

SEQ ID NO: 99943 - DNA, 189 bp, Triticum aestivum
  unsure (1)..(189): unsure at all n locations
  Clone ID: PAT_TA_99943
aagcatgtcactgctgttatttattccaaacaatngnaaaccgttcgttcatcaatatccaaagtccattctgcccttgctgacaaaacacttaaccacaaaacaacacaatatctctcaaaatctataaaaccacaatatctgacttaacatcataaacggattagtacctagnacgctaccacacta

SEQ ID NO: 99944 - DNA, 306 bp, Triticum aestivum
  unsure (1)..(306): unsure at all n locations
  Clone ID: PAT_TA_99944
tagcgtggtcgcggccgaggtacatcttggcgatgatggggttgcacagggcctccagctccttcatcttgtcctcgaactcgtccgcctcagcaagctggttcgtgtccagccactggatggcagcatcaatggcatcctcgatcttcttcttgtcgtccgccggcagcttggaggcgaccttctcgtccttgatcgtgttgcgcatgttgtatgagtagttctccagggcgttcttggactccaccttcttcttgtgttcctcgtcctcggacttgtacctgcccgggcggccgctcgaaatcn

SEQ ID NO: 99945 - DNA, 294 bp, Triticum aestivum; identical to SEQ ID NO: 99936
  Clone ID: PAT_TA_99945

SEQ ID NO: 99946 - DNA, 197 bp, Triticum aestivum
  Clone ID: PAT_TA_99946
tcgagcggccgcccgggcaggtacaaacctgtcaaccctctcatggccggggtgcaatgcaatgcatggtgttcgccattaatttgttcatgctgtatgacatcaagtgttaatcgttcttagtctagtccagtccagtcctcctagtagcaccagttccttaattttctagcagtacctcggccgcgaccacgcta

SEQ ID NO: 99947 - DNA, 455 bp, Triticum aestivum
  unsure (1)..(455): unsure at all n locations
  Clone ID: PAT_TA_99947
tagcgtggtcgcggccgaggtacaagatctacatcttcaaggtgctcaagcaggtgcaccccgacatcggcatctcctccaaggccatgtccatcatgaactccttcatcaacgacatcttcgagaagctcgctggggagtccgccaagctggcgcgctacaacaagaagcccaccatcacgtcccgggagatccagacctccgtccgcctcgtcctccccggcgagctcgccaagcacgccgtctccgagggcaccaaggccgtcaccaagttcacctcgtcctaggctcctcgtgcattagttcttgtgtttctttcctcttcgttgtctgatgaattctgtagctagctgtgtgtgttctgacagcgtcatactgtaacaatggtgctgcctgaataaatagtcatgttgctgcaaaaacctgcccgggcggccgctcgaaatcnnnnnnnn

SEQ ID NO: 99948 - DNA, 459 bp, Triticum aestivum
  Clone ID: PAT_TA_99948
gcggccgcccgggcaggtacccatctccccaggtctccacctctgttgttgagccatacaacagtgtcctgtccacccactcactccttgagcacactgatgtctctatccttcttgacaatgaggccatctatgacatctgccgccgctcccttgacattgagcgcccaacatacaccaacctcaacaggcttgtttctcaggtcatttcatcactgacagcttccctgaggtttgatggtgctctgaatgttgatgtcaatgaattccagaccaacttggtgccctacccgaggatccacttcatgctttcctcctatgccccagtgatctcagctgagaaggcttaccatgagcagctgtccgttgctgagatcaccaacagcgcctttgagccttcgtccatgatggccaagtgcgacccccgccacggcaagtacctcggccgcgaccacgcta

SEQ ID NO: 99949 - DNA, 428 bp, Triticum aestivum
  unsure (1)..(428): unsure at all n locations
  Clone ID: PAT_TA_99949
tagcgtggtcgcggccgaggtaccagaagagcaccgagctgctcatccgcaagctccccttccagcgcctggtgcgggagatcgcgcaggactttaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctaggctgcttcctagaatcctagtgtctgatctggtctcgaggtgtagagatgcgttactagtttcttattagcccttgtctgtggtagtaaggttcctcgacagttgtgttatggtgtgatgtacctgcccgggcggccgctcgaatcannnnnnnnnnng

SEQ ID NO: 99950 - DNA, 454 bp, Triticum aestivum
  unsure (1)..(454): unsure at all n locations
  Clone ID: PAT_TA_99950
aaatttttgaattttttcccttaaaacaaaggttacattttcaatttaaaaaaaaacctttattttcttttttaaaaaaacatttaacagaaaacaaatttaaaaagtcaaaaccctttttttaggccttttttgggggggggggctttttgggggaatttngaatttttttgggggatttggggcccttttctttttttttccccctttttttggggagcnnnnccgggtttattttggggatgaaccccccgtgcccaattgggacacccgccaaaaatttttcaaggttcttttttttttttaggggaaaaaacagngggggggggattattcggcttttttttttgtccttgggggggtttccggggaacttcaactttttgggggggaggttccttcccgggggggcggtttaattaannnnccgggncnnccnnggggggggggaact

SEQ ID NO: 99951 - DNA, 205 bp, Triticum aestivum
  Clone ID: PAT_TA_99951
tatcgtggtcgcggccgaggtttttgcagcaactaataataattagagaaaaatttgtgcaggcatgacacctgccaaacaccatactacaggtaataaaagagctctatataacggagtcctctccctcctaatttaccagctcggatcggatctatgcaacaaactgcaatactgacggtacctgcccgggcggccgctcgaa

SEQ ID NO: 99952 - DNA, 448 bp, Triticum aestivum
  Clone ID: PAT_TA_99952
tagcgtggtcgcggccgaggtacaatgatacaggcctcgctgccaatactcagcttgtgcacctaaactactacacatgttgtgtttgggcagtctggtgctggtaacaactgggccaagggtcactacaccgagggtgcagagcttattgattctgttcttgatgttgtcaggaaggaggttgagaactgtgactgccttcaaggtttccaagtatgccactctcttggtggtggtactccttggggcgcaccacgttaacgtcggcgtagaccctggcctttgacatggctgaagacgatccggatcccgcgggcgggcgacggatcagagagaggggagggctcggaggagtttggtgctttctcggcggcgcgtccgtcaagcggacatcgccggcggcgagatggcgctagggtttcaacacctgcccgggcggccgctcgaa

SEQ ID NO: 99953 - DNA, 384 bp, Triticum aestivum
  unsure (1)..(384): unsure at all n locations
  Clone ID: PAT_TA_99953
tagcgtggtcgcggccgaggtaccaaaagaattcaatcaaccaaacaaatcaggattctggacttcaaatccacatgtaacaatatcatgatgtccatctaaacacgccctatttcatactccagaaatgtatttcagaagcaaccaattgcatagaaggcataaagcagaaaactgtgccaaacagaatgggaaaattttgttagtcactctagtttttgccaatttttcccaaacagaattagaacataaattgcacatacgcaaaaaggtcccatctgtctcaatacatgctaggcttaaattgatgcagacttggaaattacctcataaccacgtcgaatggaaatttcnnntcaagtacctgcccgggcggccgctcga

SEQ ID NO: 99954 - DNA, 451 bp, Triticum aestivum
  unsure (1)..(451): unsure at all n locations
  Clone ID: PAT_TA_99954
tagcgtggtcgcggccgaggtacaagatctacatcttcaaggtgctcaagcaggtgcaccccgacatcggcatctcctccaaggccatgtccatcatgaactccttcatcaacgacatcttcgagaagctcgctggggagtccgccaagctggcgcgctacaacaagaagcccaccatcacgtcccgggagatccagacctccgtccgcctcgtcctccccggcgagctcgccaagcacgccgtctccgagggcaccaaggccgtcaccaagttcacctcgtcctaggctcctcgtgcattagttcttgtgtttctttcctcttcgttgtctgatgaattctgtagctagctgtgtgtgttctgacagcgtcatactgtaacaatggtgctgcctgaataaatagtcatgttgctgcaaaaacctgcccgggcggccgctcgaatcnnnnn

SEQ ID NO: 99955 - DNA, 394 bp, Triticum aestivum
  unsure (1)..(394): unsure at all n locations
  Clone ID: PAT_TA_99955
caaaaatgaccccctctccccctaaaaaaaaccacaactcattattattgttgataaccatatgtaaaccattttttttggcaacaaatttacagttgttaaactaagcaaacaggcaggcttttgttcactaaaaaactgaaatgccaaacaaaacaaagcaacccaaagttccactttttcccaggcaaaacaattgcaacccacactggctttatttaaacatttttacaacttgaaacaggctttaaaacaatggcattggcgttgnnggcaatcctgggccaaaggtaaacacactcttttcccacaggtccggggatggcaaatcctttcatctcacccttggggttcacaatcactccaacattgtnntcaannnacctcggccgcn

SEQ ID NO: 99956 - DNA, 471 bp, Triticum aestivum
  Clone ID: PAT_TA_99956
tagcgtggtcgcggccgaggtacccatcaccccaggtctccacctctgttgttgagccatacaacagtgtcctgtccacccactccctccttgagcacactgatgtgtctatccttcttgacaatgaggccatctatgacatctgccgccgctcccttgacattgagcgcccaacatacaccaacctcaacaggcttgtttctcaggtcatttcatcgctgacagcttccctgaggtttgatggtgccctgaatgttgatgtcaatgaattccagaccaacttggtgccctacccgaggatccacttcatgctttcctcctatgccccagtgatctcagctgagaaggcctaccatgagcagctgtctgttgctgagatcaccaacagcgcctttgagccttcatctatgatggccaagtgtgacccccgccacggcaagtacctgcccgggcggccgctcgaatcaattc

SEQ ID NO: 99957 - DNA, 372 bp, Triticum aestivum
  Clone ID: PAT_TA_99957
tcgagcggccgcccgggcaggtacccttcagtcgcctcatactccgactccccctgcctctgctcatagttatcagcctcttgattttccacttcaatcatatcttcagcctcagctttgtcaccgtgcgacgaagatgcagggacctggccttcctctttatattcttcatcacctgatctactcttgcattcttcagaactgatagtgttgtcatagccctccttctcagcttcaaccagagattcagcctgcctgtgagagaccgcagcagatttatcttctttgacattgtgggcagatgagccattgccattgccgcatgcagcctgtcgtttcctctgtaagatgacctcggccgcgaccacgcta

SEQ ID NO: 99958 - DNA, 416 bp, Triticum aestivum
  unsure (1)..(416): unsure at all n locations
  Clone ID: PAT_TA_99958
acaaaaatttcattcaagcctcacaatacattaggataaaacgacacattattttaacaccaacaaacaaaagcccccgacacacattcggatcacaaaacaaaaacagcttctnnccatttttaccggggacccaaaacctaggccctttccccttggatgcggggggcaaactggatttccttgggcatgatggtgacccccttggcgtggatggcccaaaggttggtgtcctcaaacaacccaacaaggtaggccttggcggcctcctgcagggcggaaacgggggaactttggaaacggaggtcggtcttgaaatcctgcccaatctcacggacaaagccctggaaggggaacttgcggataaacaactccgtgcttttttggtacctcggccgcnnccaccctaattaaat

SEQ ID NO: 99959 - DNA, 413 bp, Triticum aestivum
  Clone ID: PAT_TA_99959
tagcgtggtcgcggccgaggtaccagaagagcaccgagctgctcatccgcaagctccccttccagcgcctggtgcgggagatcgcgcaggactttaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctaggctgcttcctagaatcctagtgtctgatctggtctcgaggtgtagagatgcgttactagtttcttattagcccttgtctgtggtagtaaggttcctcgacagttgtgttatggtgtgatgtacctgcccgggcggccgctcgaa

SEQ ID NO: 99960 - DNA, 295 bp, Triticum aestivum
  Clone ID: PAT_TA_99960
tagcgtggtcgcggccgaggtacaatcatccgaagcgcttgcaaagatgttcgtgtcctctgggttaaattttagttcattactattatctgagtgttcttcaaatgtctgtatgcaattccagtcctggtcccagtcccaaagctttatttgcctatcacaccctgacagcacatacggctgggtcggatgaacgtctaatgaacaccaggcaaagacaccatcgtgaactttgaagctcatgaccgtctcgagttccttttcatagtcgtacctgcccgggcggccgctcgaa

SEQ ID NO: 99961 - DNA, 354 bp, Triticum aestivum
  Clone ID: PAT_TA_99961
gcggccgcccgggcaggtacttgggagtggtggcgtccatcttgttgcagcagcagatcatctgcttcactccaagagtgaaagcaaggagggcgtgctcacgggtctggccatccttggagataccagcctcaaaaccaccagtggtagagtcaatgatgagcacagcacaatcagcctgggaggtacaggcacacatcggggggcacacacctcggcttatttcgcgacgaacgagcaccagcaattaagatcatggcttcatcagcgctgcgaccttctggacggacggcctcgccagcaggtcagtccaccaggccttcacatgcgggtacctcggccgcgaccacgcta

SEQ ID NO: 99962 - DNA, 228 bp, Triticum aestivum
  unsure (1)..(228): unsure at all n locations
  Clone ID: PAT_TA_99962
atcaatttttatttttttcttnnnnnnnnnnctttttttgccacaaataatcccaacaaaacaacaatattaaaaaacctttaaaagtctaagttgcctaggccatacaattacacatcacacacacaataactttaacacctgaccagttcccaatttacaattaacttaacttaggtttttggcnnnnnccagnaaatatttnncaataccttcccgggcnnnnnt

SEQ ID NO: 99963 - DNA, 459 bp, Triticum aestivum; identical to SEQ ID NO: 99948
  Clone ID: PAT_TA_99963

SEQ ID NO: 99964 - DNA, 453 bp, Triticum aestivum
  unsure (1)..(453): unsure at all n locations
  Clone ID: PAT_TA_99964
aaatttttgaattttttccattaaaacacaggtttctttgacaacttaaaaaaaaacctttacttcgttttttaaaaaaacacttcacagcacacaaacttaaaaacttaaaaccctttttttaggccttttttgggggggggggctttttgggcaaattggcaatttttttgggggaattggggccctttcccttttttttcgccgtttttttggggaacaacaccgggtttattttggggattaaccccccctgccccatggggaccccggccaaaaatttgccaaacttttttttttttcttaagggaaacaaaagggggggggggataannccgcttttttttttgtccttgggggggttcccggggaactccancaatttggggggnnagtaccttcccgggggggcgtttnnattnnnnnnnnnnnggccccanggggggcgggaac

SEQ ID NO: 99965 - DNA, 542 bp, Triticum aestivum
  unsure (1)..(542): unsure at all n locations
  Clone ID: PAT_TA_99965
ttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactgggtggttttgaggctggtatctccaanggatggccaaacccgttgaggacgccctcctttgcttttcaccctttgggagtgaaagcaaaatgatttngctgctggcaacaaagaatgggacgncanccaatccccaagttacccaaangggcn

SEQ ID NO: 99966 - DNA, 511 bp, Triticum aestivum
  unsure (1)..(511): unsure at all n locations
  Clone ID: PAT_TA_99966
ggacatttctcatccttgccctccttgctatcgtggcgaccaccgccacaactgcagttagagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcaaccatttccgcaagccgcaactaccatattcgcagccacaaccatttcgaccacaacaaccatatccacaaccgcaaccacaatattcgcaaccacaacatccantttcacagcagcagcagcagcaacaacaacaacaacaacangaacaacanatacttcaacanattttgcaacaacaanctgattccatggntgggatttttgtntttgcagcaaacacaaacantangcgcnaagggganatttaaaaatttttggcaacnaaagtttctttcc

SEQ ID NO: 99967 - DNA, 552 bp, Triticum aestivum
  unsure (1)..(552): unsure at all n locations
  Clone ID: PAT_TA_99967
cagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccaagcctcagcaaccacaacaaccatttctccagccccaacaaccattcccccaacaaccacaacaaccattcccccagactcaanaaccacaacaaccatttccccagcaaccacaacaaacccatttccccaagactcaaacaacccccaacaaccatttttccccaacaanccacnaacaacccnatttcccccaagaactccaacaaacccccnaacaaaccaantttccccaagctccaagcnanccnaaaaaaaancctttttncccannccccaanaaaanaaattggcncnaaacccccan

SEQ ID NO: 99968 - DNA, 514 bp, Triticum aestivum
  unsure (1)..(514): unsure at all n locations
  Clone ID: PAT_TA_99968
gatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacantttccagggcagcaacaaccatttccaccacaacaagccatatccgcaagccgcaaccatttccatcacaacaaccatatctgcagctgcaaccatttccacagccgcaactatcatatccgcaagccgcaaccatttcgaccacaacaaccaatatccacaagcccgcaaccacagtattcgcaacccacaacaaccaaatttcgcaagnaacagcaagcaagcaagcagcaaacaaccaacaaccnaccaaccaaccaaatcctaacaacaaanttttgncaacnaaacaaactnatttccctggccangggattntttttttttg

SEQ ID NO: 99969 - DNA, 506 bp, Triticum aestivum
  unsure (1)..(506): unsure at all n locations
  Clone ID: PAT_TA_99969
caagcaagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacantttctagggcagcagcaaccatttccaccacancaaccatatccacagccgcaaccatttccatcacaacaaccatatctgcagctgcaaccatttccgcagccgcaactaccatattcgcagccacaaccatttcgaccacaacaaccatatccacaancgcaaccacanttattcgcaaccacaacatccaatttcanaagcagcagcangcaagcaacaacancaanancaacaaggaancaaacaagatacttncaaccaaaatttttggcaancnaacaaactggattccnatgccatggactnttgtntttgccaacaacacc

SEQ ID NO: 99970 - DNA, 547 bp, Triticum aestivum
  unsure (1)..(547): unsure at all n locations
  Clone ID: PAT_TA_99970
cttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaaggctgactgtgctgtgctcatcaattgactccaccactggtgggttttgaggctggtatctccaaggatggccaagaccccgttgaagcaacgccctcctttgctttcaactccttgggaggtgaagcaanatgatntggctgctgcaaacaaagattggatggncaccaactccctaaattaatccgaaaggntcctttt

SEQ ID NO: 99971 - DNA, 549 bp, Triticum aestivum
  unsure (1)..(549): unsure at all n locations
  Clone ID: PAT_TA_99971
cgcagcagcatcacgcggcggcaggccagcccaccttcctccttgtcgccgcccgcttcattcaccccgctcccgccggtgcgcgccgcccccctccagtttcccacccaaccaatctcggctctccccccctcccccgccccggaggccaagattgcttccatggacgccgccgccgccgccgtcaccaccctctccgcgctcgccgtcttcgccagcacgctccaccaaggcgccgtgcggagcgtgcacgggtacagggtcgtcgcgatgggagggaggtgcgcgtgggaccggtgggtggagcgggaagttcgccttctcccccacctcctggccgcgaggtcccgctccccgccgccgcgccgcgggatactcccggtcgagtggcgcggncgcccggggtaccgcgaaggggcaagttgctggggcgccttgggcgctggcgttcctggccnttcnattccaattcgccggccgntggccgtttccgggccaaagcctnccccccgatttntctggcccccttccggggaacccgggggttng

SEQ ID NO: 99972 - DNA, 544 bp, Triticum aestivum
  unsure (1)..(544): unsure at all n locations
  Clone ID: PAT_TA_99972
gcacaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccaagccccaacaaccattcccccaacaaccacaacaaccattcccccagactcaacaaccacaacaaccatttccccagcaaccacaacaaccatttccccaagactcaanaaccccccacaancattttcccaacaaccacaacaaccattcccccaagactcnaacnaccccccaacaacnattttcccccaggtcccaaggnaacccaaaaanaanccttttttcccccaagcccccaaaaaaaaattng

SEQ ID NO: 99973 - DNA, 504 bp, Triticum aestivum
  unsure (1)..(504): unsure at all n locations
  Clone ID: PAT_TA_99973
cttgccagaaccaaacaaatacacgctatcaagggctcaaagcataagcattgtcaaaacactccgtccgttggaaagaagaaaattaataaacaaatgaaagacaggtagtagctcactgctgattccataactggcccgctctaagcaccttattgaacttcaacaccaacgcagccatggtatgataaagttctttattcgaacctaattagctatttctggatccacacaacaaaaatgggaagtacggaaaatatgcctacaaatgttcaacgatagatcttcaaatacatggaggcaaaagctgaataaccagcagagaaaatgccaagatatcggataagtctcaacctggattgggaanggaatggatttttatcaattttccaaaagcccaaattggnttaatcaaagcccgctntacaaangccaacataacacgacattntttaacaataaattcccggttgntttggcngnctgggttaaattccaggccca

SEQ ID NO: 99974 - DNA, 555 bp, Triticum aestivum
  unsure (1)..(555): unsure at all n locations
  Clone ID: PAT_TA_99974
ctagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgcaacaaccaccattttcacagcaacaacaaccagttttacctccacaacaatcaccttttccacaacaacaacaacaccaacagctgggtgcaaacaacaaatcccctgttgttcaagccatccatttttgcaagcangcttaaacccaagccaaggcttattcctccaagcaannattgcaagcccctnggggnaaaaggccaaaaangtncntggcnagggccccaaatgtgtnng

SEQ ID NO: 99975 - DNA, 514 bp, Triticum aestivum
  unsure (1)..(514): unsure at all n locations
  Clone ID: PAT_TA_99975
ctcgctcgccgccggccgccgcccagcgcctccgccgacccctcgctcccgccgcacgccgcccccatggcggatccctaccgctcgtacctcccgtcctcctctcacgacagagttccactgggcggttatcctgggtatgttccacatgaggaatcatcctattatgcttcaaaaatggctgctctgcgaggagtaccaaatatacctagagttgatgtaccattacagtcaagagcttatggtttggatgttccagcaggcgtgagccatcctgcttatggtttggatgttccaagcaggcgtgagccatcctgcttatggtttggatgttcccgcaggcgtgagccatcctgcttatggtttggatgttccagcaggcgtgagccatcctgctttggttggattgggtgcactgccaactggagctnaggccgcggggaacctaancccttttgggaagaccaacctctantccaaaaaaaaantttttnacntttggaaaaaagtngtc

SEQ ID NO: 99976 - DNA, 523 bp, Triticum aestivum
  unsure (1)..(523): unsure at all n locations
  Clone ID: PAT_TA_99976
tctcttccacccgtcgattccacttgttggggagcatttccgcgcgaggggcggagcatttgttgcggcggcgacgtccaaggttgcngnggcgtcagcggtcgggatctccaggcgagcggttgtgaagcaggagggcgtaggcaggagaggggatgctgtgatttgtggaggaagagcaaatcgactgcaaaacgccgcgaaaaatggctgggagcagtaagggcatccaagcaagacccccctacaaccaatcttgatgatgattttttttaacttgcctaaccattgccttctaagntgcctcaaaatgatgcaaacttgctgactcttttcattatatacttagatnaaatgactgtttctattcaanatacccgttacaagacncttttcatcatatactcctnaatgatcnangttncccaaaaatcttttccntagnactttgccccnannaattatggggaaaagcactcccctcccgtcccgccgaaataagnggnncctttnttccaanttt

SEQ ID NO: 99977 - DNA, 525 bp, Triticum aestivum
  unsure (1)..(525): unsure at all n locations
  Clone ID: PAT_TA_99977
cgccgccgcaggctttgactccatcgcctcctccctcctcctcttcgtctccggcaggccaggtagttaacagctccagcagccatgggaaaggagaagatccacatcagcattgtggtcattggccatgttgactctggcaagtcaaccacgactggccacctcatctacaagcttggaggcattgacaagcgtgtgatcgagaggttcgagaaggaagccgctgagatgaacaagaggtctttcaagtatgcctgggtgcttgacaagctcaaggctgagcgtgagaggggtatcaccattgatattgctctctggaaattcgagaccaacaagtactcctgcactgtcattgatgctcctggtcaccgtgattttcatcaaagaacaatgatcaactgggacctcccaaggctgattggtngctgtgcttatcaatngactccaccaactggtnggnttttgaaggntnggtatctcccaaaggatnggncaagacccngttnaagcancgctncccccttg

SEQ ID NO: 99978 - DNA, 445 bp, Triticum aestivum
  unsure (1)..(445): unsure at all n locations
  Clone ID: PAT_TA_99978
ctcactcacagacgcactacacggtgcaccttcctcgctctagccagccaagcgagctagtagcccggtaggccgtgcggtgcacactgccacgccatgtcgagcaagccgtcgtccaggaggagcagcttcacgctgcggcagccgccggtggtggacgtcggctgcaactgccgccgcccgaagctcttctccaagcctcttctcctcgtcctccctgccgttccgcggcaggggcggcaagcccaagtcgcccaacgcctcctccacgtccaccaccacggngttnangggcaactccgccgactccgcctcctgggggccccgcgtcctttaacaaacaaactcgctgtacgaaggaaccccgccgnccgctgcgcgccaaccgttggcaaagaagcccggngcaagganacaaggcgnccggcggaaggcaaccggccgg

SEQ ID NO: 99979 - DNA, 558 bp, Triticum aestivum
  unsure (1)..(558): unsure at all n locations
  Clone ID: PAT_TA_99979
gcacaactagagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacaaactattccccaatcccatcaaacattccatcatcaaccacaacaancatttccccaancccaacaaacatncccccatcaaccacaacaacaatttccccangcccaacaaccacaacaaccatttccccagccccaacanacattncccccaaggaatcccccagactnaccatttccccaannaagcccaacaancaatttcccccaagccctcancnaaccccccaacaaaccaatntccccaggtcactaancaacccatagnaannctttttcccccaagcccccaacaacaaattttccggcangccccnaanaaccnanaaanaattantttcccccaannaag

SEQ ID NO: 99980 - DNA, 534 bp, Triticum aestivum
  unsure (1)..(534): unsure at all n locations
  Clone ID: PAT_TA_99980
ttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgacgcccctggtcaccgtgacttcatcaagaacatgattactggganctcccaagctgattgtgctgtgctcancaattgactccancactgggggggtttgangntgggaacctcccaaggatgggcaanaccctngagcanccccncccttgctttnncncctgggngtgaancaaaattattnggctgctggnaanaaaaatgggggccaccaacnccccaagttanncaaag

SEQ ID NO: 99981 - DNA, 503 bp, Triticum aestivum
  unsure (1)..(503): unsure at all n locations
  Clone ID: PAT_TA_99981
gcccacagccgcggaggcgaggacgggggcggagccggcggcgggagggttccatcttcgggcgagctgcgggggatggataaaaaaaactctgtaaggctcattgaagccatcgagcaattgaacccagaggccactgtaaagctcactcaagctattgagaaattgatccangagctcaaggaaaagtcacctttcgatgcgctatctnagcgtaagaagtcattcattgaagcttcaaaagcgtttacgctgtttgccggcgccggtttaaatgcgatgaatgcgttcgctatcactttggcttacatgtcaatgcattcgatgaatgtcaacgcagatgctgctaacactacttcaacagccgctccctcctactgagagtggctacttctccctcccaatatgattcaatccttttcctaaccntggggaaacaaaggttttggtttcccttttcaanaangctncgctanaaacnanttgggggtcanagccaaatg

SEQ ID NO: 99982 - DNA, 362 bp, Triticum aestivum
  unsure (1)..(362): unsure at all n locations
  Clone ID: PAT_TA_99982
tcatgaagacctttctcatccttgccctccttgctatcgtggcgaccaccgccacaactgcagttagagttccagtgccacaattgcaagccacaaaatccatctcagcaacagccacaagagcaagttccattggtacaacaacaacaatttccagggcaagcaanaacaatttccaccacancaagccatatccgcangccgcaaccattttccatcacaaacaaccaatatctgcaagctgcaaccaattttnccgcaagccgcangccatttccggccacnaacntaccaatatccggcaggccngcaatccattttccaccancancantccantttccacaaccagcaaagccaac

SEQ ID NO: 99983 - DNA, 430 bp, Triticum aestivum
  unsure (1)..(430): unsure at all n locations
  Clone ID: PAT_TA_99983
aaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcancaacaacaatttccaccacaacaagccatatccgcagccgcaaccatttccatcacaacaaccatatctgcagctgcaaccatttccgcagccgcaaccatttccgccacanctaccatttnccgcangncggcaatcattttccaancaacaatcannccaatttnccacaancaaggcaancccacaaggtngtcctacaaancaacaaccaatccaaattttcgcaagnnaac

SEQ ID NO: 99984 - DNA, 476 bp, Triticum aestivum
  unsure (1)..(476): unsure at all n locations
  Clone ID: PAT_TA_99984
gcacaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacanacattcccccatcaaccacaacaacaagttccccaagcctcagcaaccacaacaaccatttctccangccccaacaaccattcccccaacaaccacaanaagccntccccccagnctcancaaaccacaccanccatttccccaagcaanccacaacaaccatttcccccangactccancaaacccccnacaatccnatttcccccaacaaacaacaacnnacnatttccccccagaatccaaacaa

SEQ ID NO: 99985 - DNA, 608 bp, Triticum aestivum
  unsure (1)..(608): unsure at all n locations
  Clone ID: PAT_TA_99985
ggcggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcaacgtcatatcatggttgatggaaaggtcccgcactgacaaagaactaacctgctgggttcaatgggacatcaattccaattcccaaagactgggtgaagaactaacaaggcnttcntttatgaacaccaaagggtcncttnccgccnttcaatcctgtcaangggaattaanggatnnctaaatttcaaagctcctgcaaaggtcaaggtntgttcaantttcgggcaaaaaanggnaatcccctaaccttnaaanacctttnattggccgcaacaatncgctttcccaaaanccaatccatnaagggcaattgaaaccat

SEQ ID NO: 99986 - DNA, 204 bp, Triticum aestivum
  unsure (1)..(204): unsure at all n locations
  Clone ID: PAT_TA_99986
gctctctttgcctttccagttgtctatgaccccatctttttcaccaccgtctctcttcttcctcccctanccgcccactgtacagctccgtgttcccaacttcccccgtctccgccgtcagaactcggaanccggaattggaaggaaggtnntgtggngggggtggcggccatgcatcatccggagnagggtggcgccgggtac

SEQ ID NO: 99987 - DNA, 576 bp, Triticum aestivum
  unsure (1)..(576): unsure at all n locations
  Clone ID: PAT_TA_99987
ctcccatcccacgccgccgcctcctccgccatgtacacatcctgcaggccgcacgcgcgcgccttccaccaccaccacccggccgacctggcccagcggggcggcggccagcccggcctgctcccggccgcagcgtggaggcggggcggcgcggcgccgagggcgagcctggtggcggcgcggacggcgacggaagaggcggtgtacgaggtggtgctgcggcaggccgcgctggtggaggactttcangggcgggcggccgcnccggganggccgacaaccggccgccggtggcngggacgagcaactnggagcaaggagggcgacgcccgagctccggcttgggggcctccctcgggngaatgcctaacgaaccgcttccggcgangttctggcgccnnagttacgcccaaagaacnttctacctccgtttnaagccaagncccctcaanaaccccgttccgttccgttccggtcnaataanttaattcaattctggnaggccaaattactcaatngcatattacaagttaacccccttacnanttnggaaatttatgggnaattccnttttcc

SEQ ID NO: 99988 - DNA, 628 bp, Triticum aestivum
  unsure (1)..(628): unsure at all n locations
  Clone ID: PAT_TA_99988
ggtgatgtagcctctcaatacaaaagaaacaagtggccgttcgtgcggccggcggcgtccgtgcgcggggaaaaaccaccgtgtcctcgtgttcatcttcctccttcctttctccttagttggttagagccatggcaacgcanagagagagaaagagctgcgccaacatttggtatcaagagccggtttcatcttgggtgtcgcctcttgccggaggcgtaccggcggtggcgggcgctcgccggcgggctgcgcgaanggagctcctggggccgtngtgtcgggcccaatggaagggttggggcgggcgcttgtggctcctcaatgggccgcnttggcgggattgcngccggggccggttgaacntccttggggttgccgttcnaacccgccggaagggccgcccnganggggcgcttccgtngtngncgcaaancnggcgccaacaacgggcaatggcgggcaattggaaggcccgccggncggttccaatggcaaattaaaaacccggccggccaaaccccggccnccggcccggtnccttttttaatgggtngcccaatttggacccntncgggcccctttgnaacccccggggcgtggganccccnttcaaggggcttggacn

SEQ ID NO: 99989 - DNA, 610 bp, Triticum aestivum
  unsure (1)..(610): unsure at all n locations
  Clone ID: PAT_TA_99989
ctcggtgggaggtcctcaggcgggcaggttcccctagatncccggagtcactcaatcaaatggctgacggtgaggacatccagccccttgtctgcgacaatggaactggcatggtcaaggctggttttgcaggggatgatgcacccagggccgtcttcccaagtatcgttgggcgcccccgccacactggtgtgatggtggggatggggcaaaaagatncatattttggtgaacaaggccaatccaaaaagggtatcctcaacttnaaatnacccgattcaacaatggnacctcaagcaaactggggaacaaattggaaaaatttgggaatcaaaatttctaanaaccaagctccctttttgcaacttaaggagcaacccaattactggcttaactgaaggngnccccttaaaccccaaagggttaacaaggganaaaaaatgacacaaaatcaatgttttggagnaaccttcaattgtttccaanccaatgttttgttggccaatccaaagccngtgcntttccctaannttgctantnggaccccanaaaaaagtaaccctgnttgggttcccggggaangggggtcaaccaaaanngnggcaatttt

SEQ ID NO: 99990 - DNA, 489 bp, Triticum aestivum
  unsure (1)..(489): unsure at all n locations
  Clone ID: PAT_TA_99990
ctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcatttgatgctcctggtcaacgttgacttcatcaagaacatgattactgggacctcccnagctgactgtgctgtgctcaacaattgactccancactggtggtttttgagggctggtatctccaaaggatgggccaaaccccgtngagcatgccccnccttggcttcacnccttggnggtgaagcaaaat

SEQ ID NO: 99991 - DNA, 559 bp, Triticum aestivum
  unsure (1)..(559): unsure at all n locations
  Clone ID: PAT_TA_99991
gaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaataacaatctngtcccccanctccaacagccattntcccagcaaccacaacaaatattttccccaanctcaacaaanattctcccattaaccacaacaacaagttccccagcctcaagcaaccacaacaaccatttctcnagcccnaataaccattcccccaagcaaacacaacanncattnccccagtctcancaaccacaanaagncatttncccaggcaancacaataaaccattttcccccagnactcaacaacccccaaacaancattttccccaaaaaancncaaacanccaattncccccaggctccaagnaaccccaacaaacnatttccccaggctccagnanccnaaaaaaaanctttttccccaggccccnanaaanaatttggcggnagccccca

SEQ ID NO: 99992 - DNA, 592 bp, Triticum aestivum
  unsure (1)..(592): unsure at all n locations
  Clone ID: PAT_TA_99992
gctagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacaagcaaccagttattatactgcaacaaccaccattttcgcagcaacaacaaaccaagttctaccaacaacaancaccaattttccacaacaacaaacaacancaatcaaccaaccagcaaacaaccaacatttttcgcaggcaacaaacaaccaagtttctaccaacaaacaaccaaccaatttttcaacaatcaaacaacaacccacccattttcngcagcangcaacaanccatcttcacnanaaaccaactttttccacaaanaacacccaanagnttcccaaaacaannaaatcctnttttttcaaccaatccnnttttgcangnacctnaa

SEQ ID NO: 99993 - DNA, 511 bp, Triticum aestivum
  unsure (1)..(511): unsure at all n locations
  Clone ID: PAT_TA_99993
ggtaagtagtacctaacgcaaatccaccatgaagaccttactcatcgtaacaatccttgcgatggcaacaaccatcgccaccgccaatatgcaagtcgaccccggctaccaagtacaatggccacaacaacaaccattcccccagccccaacaaccattctgccagcaaccacaacaaactattccccaaccccatcaaacgttccaccatcaaccacagcaaacatacccccatcaaccacaacaacantttccccaagacccaagcaaccacaacaaccatttccccaagncccaacanacattcccccaacaacccccaactancaatttccccaanaaccccccacaaccattcccccaggcctcaacaacccccaacaacaattttccccangtcacaagcaaccancaacanccntttccccangcccccaacaaacaatttcctggcaagccccaacnaaccggcnaanaattaattcccccccngcnaacaancaaccgtttt

SEQ ID NO: 99994 - DNA, 598 bp, Triticum aestivum
  unsure (1)..(598): unsure at all n locations
  Clone ID: PAT_TA_99994
caactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccaagcaaccacaacaaacatttccccaacctcaacaaacattcccccatcaaccacaacaacaagttccccaagcctcagcaaccacaacaaccatttctccaagccccaacaaccattcccccaacaaccacaacaaccattcccccagactcaacaaccacaaacaaacaatttcccccagcaaccacaacaaacaatttccccangactcaacaacccaacaaccattttcccancaanccaacaacaaccattnccccccagnctcaaanaaccccaacaaaccaatttccccaggctccaagnaaccaanaanaaacctttttccccaggccccaanaaanaattggcgggaagcccccaacaancggnaaaaatttantcccccccaanaaaaaaagggncat

SEQ ID NO: 99995 - DNA, 540 bp, Triticum aestivum
  unsure (1)..(540): unsure at all n locations
  Clone ID: PAT_TA_99995
gaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccaagcanccacaacaaacatttccccaacctcaacanacattcccccatcaaccacaacaacaagttccccaagcctcaagcaaccacancaaccatttctccagccccaacaaccattccccccaacaancaaaancaaccattccccccangaactcaacaaccaacaancaatcatttcccccaggcaaccaacaacnaaccaattttccccaggacttcaaacaacccccaacaaccaattttccccccancaaccaacnaccaatccaattcccccccaggacnncaaacaacccccaacatccaattttcccccaggcttcaaggaanccaacaanaaaccttttttccccaaggcccccaa

SEQ ID NO: 99996 - DNA, 355 bp, Triticum aestivum
  unsure (1)..(355): unsure at all n locations
  Clone ID: PAT_TA_99996
gctcgatcccccgacccacccgtgccgccgcccctaacccagcgcgccgccgccgcccggaaaccccagtcgccgtcgccgccgcgcccccatccctggcaaccccaggggcccccgcccccgcctcggggcctggntccacacgcagacgccaggcttggatcccacacggcgtctcncaccagcgcggcctccggccaccttctacggccgccgcgcctccccaggacctccacccgcccgccgccangggtccccatcgcctccggcctgncgccggctgncactgattccccgtngcctccccctcatccgcnactgnggggtcccccaaggaccanccaaccngaagcaa

SEQ ID NO: 99997 - DNA, 359 bp, Triticum aestivum
  unsure (1)..(359): unsure at all n locations
  Clone ID: PAT_TA_99997
gatcgcccacgcccaacattcggggaggaggaatagcggaggaggaggccaaggaccgccgccgccgccgccgccatggccgcgctgccggtgatgaagctggggacgctgctcctgcggacgctgtccaagcctatcgctaaccgcctcaagagccaggccgccgtccaacccaagtttcgcgaattcatcatcaagcatcncccaaacaaaccatcgtatcaactaaaagggtaaaaaggggcaattaatnggcaatnntaactaaatgtnggtntcaaaaactttnanattaaggaaaanggaattaaaagttgncnaaaatttcaattgggaaaaggttnaacctttccggtggc

SEQ ID NO: 99998 - DNA, 580 bp, Triticum aestivum
  unsure (1)..(580): unsure at all n locations
  Clone ID: PAT_TA_99998
ccgcgcccccgtcccctttctaaacccctctcctccccaccctcgcccgctgaggtttccgccgcgatctcgtctcgatccgcactctctatctgagatttggaatcgggcgaggcctgcagctcctgccgacatggcgctcgttttgcattcgggcaatggcaacaaaaatgccttcaaggcacttattgctgcaagagtactgtggggtcaaaggttgagctgaacaaaaactttgagatgggtgtctcaaacaaaaacccctaattcatcaaagaanaatccccttgggaagggtcctgttcttgaaaaccccgaaggggctgtttttgaaaacaatggttttggaagctntgttncccnctcaaanggggaaaaactgccttgggggggntcccctaattaaaaagcgcctgntnaacaaagggaggncctttggggcaaaaaaggtgattccaaaaacccnaaggggggtttaccaaagggttggttaaatnccttaaaatgcccaatctgaaggaattcggaatttctggatttaaaaagggcctttaannanttaaaaaanacctggaanaaa

SEQ ID NO: 99999 - DNA, 370 bp, Triticum aestivum
  unsure (1)..(370): unsure at all n locations
  Clone ID: PAT_TA_99999
gcatcatttaagccaagcaagcagtgctcaatacaaatccaccatgaagacctttctcatccttgccctccttgctattgtagcaaccaccgccacaattgcagttagagttccagtgccacaattgcagccacaaaatccatctcaagcaacaaccacaaaagcaagttccattggtacaacaacaacaatttccaagggagnaaaaaacatttccaacaaaataggcaaatccgcaagtgnaaacaatttcatcacaanaaacatattttgnanctggnaaacaatttcgnaagcgcaacttacaaatccgcaggcgggaattacaaattcgnaggcccaaacaattncggcaaaaaaatcaaattca

SEQ ID NO: 100000 - DNA, 563 bp, Triticum aestivum
  unsure (1)..(563): unsure at all n locations
  Clone ID: PAT_TA_100000
ccgcctcgtcctcttctcctgcgccgccaccccaccccctctatccagcggtgtcgcctctccttcccggtacgtgagccgccacctcgccgccgcccctcctcctcctcctatcttccgccgtctcgccgctgcagtcgtccccgtgagcaagctatctaggctagggttcatcggaaagaaaggaaaaaatccccattccctccgccgtctcctatgccccgctgcccgcctactcttcctctctgcaagcatcgtgtttatcctcgacgcaaaaagataacgtggactgaaagagacgccctgccgccgtgctcctttttgtanggaatgggaaggggaagggggggccgggggcgggaaattccgttggatggtggnggtcctcccctcngagggcgcaaagggaagggtnctgctcccctaatcccgggagctcctgcgaagggctcttcnttntgaacggaggaaanccggggggtaaattcccctncaatcntgccncttcttntggntggccggngccaaagtccccaacccccaanaaaatcttttncccnttg

SEQ ID NO: 100001 - DNA, 405 bp, Triticum aestivum
  unsure (1)..(405): unsure at all n locations
  Clone ID: PAT_TA_100001
ctcacccctcacggcctcatcctctcaccctaaccctctctccaaccctaaccctctccctccctcagatctcaatccgcagatccctccccgctccggcgagcccgccatgaaccgtctgcgggcggggagcccagtctacgggcggcagcgcagcgggagcagcacgggcttcacctccccgggcggtatctcccccttccancaccgctcctcctccacctcctttgctgcctccctccaacggccgcaaaagctcgccaaaaaaataaaagtngtcgccggccgcccctcgcaacaaggtcgggccctgcatcnaatccccaaaaatncccgccctcaaatggntcctgncctccaataactgnattcgggttcaaccccattncgnaatcccaaccaact

SEQ ID NO: 100002 - DNA, 580 bp, Triticum aestivum
  unsure (1)..(580): unsure at all n locations
  Clone ID: PAT_TA_100002
cgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagangggtatcaccattgatattgccctgtggaagttcgagaccaccaagtactactgcancgtcattgatgctcctggtcancgtgacttcatcaagaacatgattactggtacctcccaagctgantgtgctgtgntcancaattantccaacantggtggttttgagggtggtatcnncaaaggtgggcaaaaccgttaacaatgcctccntgctttcaatcctggggtgaaacaaatatttggctccgttaaaaanatggccncaacaacnccnaattatncaaaggcccnttacaagnaaattttcaaggaantcncttcgtactt

SEQ ID NO: 100003 - DNA, 594 bp, Triticum aestivum
  unsure (1)..(594): unsure at all n locations
  Clone ID: PAT_TA_100003
ttcagatccgatctctccaacaccacgggcacacaccaccagccctcccccgccgtctcgctccagggagctctcgccaccgccgcctgccgccatggcggcggccaacgcccccatcgccatgcgtgaggcgctcacgctgacgagcctggggatcgcgccacagttcgtcaccttcacccatgtcaccatggagtcggacaggtacatctgcgtcagggaaaactcgccgcaaaacaacgtcgttatcatcgacattggcatggccaaccaagcccctccgcaaaggcctatcaacggncgattccgcgctcaattaaacccaaaaacaaggattctcccnctcaaaggccaaatnacttggaanaaccaaggttaactgnaaattttcaatntttaagcctaaaaaaaagttaagntccaacaaaatgccnancaaggtgttgttcgggaaatggtnaacccccaantnnttgggttgggnaaaaaaaaatctntttatnatnggtcaattnaanggagatcctgaacccaccaaganttttggataagganaagctaatccngggcaantaancaagnttattaactacg

SEQ ID NO: 100004 - DNA, 627 bp, Triticum aestivum
  unsure (1)..(627): unsure at all n locations
  Clone ID: PAT_TA_100004
ccgttctccagtcgatcacgcacgctctcctcgccgccgagatgttcgggttcgggcaccaccacaaggaccaggcgccgccggcgtcgggccccaaccaagatcttcaagatctactgccgcgcctccgaggactactgcctcgccgtccgcgacggcgaggtggtgctcgcccccgtcaaccccaaggacgagacccagcactggctcaaggacatgcgcttcaacaacaacgtcaagggacgaggaggggaatgccggccttcgcgctccgtcaaaaaagggcaaccgggcctcccccgttaaagcaactccaatccgggccaagtcccaaccccgttaaagctnggtggccgttnaaacccgggcgtaacnaaggaacncctccgggttctgttggacngganaacaaaggaattggggaaaggggnttccgcttgaatncgcaatgggcaaaaaaaanccggcttcggtttcaaccccttcaaaggggaanaanggacaacgggggggtggaaaaaagggaacaacgttttttttctgggaattggtgcaaagggggaaaaacaaatgcttggaaaaatntgggccctggggccnaaggggcaaaccccccntctaatccng

SEQ ID NO: 100005 - DNA, 597 bp, Triticum aestivum
  unsure (1)..(597): unsure at all n locations
  Clone ID: PAT_TA_100005
cgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacaaactgaaatatgctctcacctaccgtgaagtgcaatctatccttatgcaacgtcatattanggttnatggaaaagnccgcaatgacaaaacctaacctgctggtttcatggacntcatttccattcccaaaactgggtaaaactaaaagcttctgtntnaaaacaaaggtcgnttccgnccttaatcccgttaagggaacaaggatncctnaatttaagcccctgcaaaggncaaggtcttccaattttggncaaaaagggaacccaanacctcaaacaaccntttatnggcgcaacaatccgcttacccannccccaaatcatcaaagggcnaatgnaaccaatcaangctgggcctngttnaaaa

SEQ ID NO: 100006 - DNA, 339 bp, Triticum aestivum
  unsure (1)..(339): unsure at all n locations
  Clone ID: PAT_TA_100006
ggcacaatcatcaaatccaagtaagtaatagctgacacaaattcaccgtgaagaccttactcatcctcacaatctttgtggcggctctaaccatcgccaccgccaatatacaggtcgaccctagtggccaagtacaatggncacaacaacaaccattctcccaagccccaaccattctcccaagcaaacaacaccaatncgtttccccaaccccaacaaaaanncccccttcaaccaaaaaaaaaatttncccaaccccaagaaccaaaaaaaccatttncccaaggccaaaaaacccaactnncaattncccaacaaacccaaaaaccantnccccag

SEQ ID NO: 100007 - DNA, 608 bp, Triticum aestivum
  unsure (1)..(608): unsure at all n locations
  Clone ID: PAT_TA_100007
ccgccgccgcctcctctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaaagctgaaggccgagcgtgagaagggtatcaccattgatattgccctgtggaaattcgaagaccaccaagtactactgcaacgtcattgatgcccctggtcaacgtgacttcatcaaagaacatgattactgggaactcccaaagctgaatgtgctgtgctcaacaattnactccaacaatggtggtttttgaggntggtaaccccaaaggatnggcaaaaacccgtttaagaannccctccctggcnttcaatccttggggttaaaacaaaattattntggcngccngcaanaaaaatgggntgccaacaaatccctaaattncnccaangggncctttttgaaggnaaattttcaanggaaantcncttcctaactt

SEQ ID NO: 100008 - DNA, 582 bp, Triticum aestivum
  unsure (1)..(582): unsure at all n locations
  Clone ID: PAT_TA_100008
ggaaaaggaaaaccaaccaagaagaaaagctcgggaggagagcgtggggggactagggagcatggcggagcacaaggaggagccggtggcggagtccatgatggacaagatctccgacaagttccacggtggggactcgtcgtcgtcgtcctcggactcggacgacgaaaaaaaaggggtcggcggcgggcgtcaaaggcaaaatttaaccgcctcttcnggccgcgaagaaacccgtccaacgccgtcctcgggcgggcgggaaacctgctnatnttgttctatggaggaaaaaaaaagtccccnggngggtgcttggtggngctaatggcaancgggttctgttccaagtcaatgggagtnacaaccnctcaacttggtggggcantggctcaanctccccctngnaaacctcctcctccnatccaaantntgcaatttcanccaaaaatccncccccaaaaatcccttaaggtnaaatncccggggggnnatgactgttaaaaantngaactacaaattgnggnattaaattaaaccngggggtttctttacctttaaaaaaaatnggcatgggccttn

SEQ ID NO: 100009 - DNA, 586 bp, Triticum aestivum
  unsure (1)..(586): unsure at all n locations
  Clone ID: PAT_TA_100009
cggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaaagtacgcctgggtgcttgacaaactnaaggccgaacgtgaaaagggtatcaacattnatattgccctgtngaaattccaagaacaacaaagtactaactggcaaccgtcnttnatgctcctggtcaaccgtnacttnaacaaaaaaaatnattaatggtnactcccaagctgaatgtgctgtnctcaacaattnaacccaacaactgggggntttnanggcgggaancnccaaggatggcaaaacccttaacaatgcccnccttgcttnaatnctggggtgaaacaaattatttgctcctttaaaaaaatggacncaacaacnccnaattatcaaaaggnccnttacaaagaaatttcaaggaantcccttcctacctaaaaaagggcggtanaacccttaaaaggttc

SEQ ID NO: 100010 - DNA, 325 bp, Triticum aestivum
  unsure (1)..(325): unsure at all n locations
  Clone ID: PAT_TA_100010
ggtcgaggttggatgtgaatcacgtgtatgtttgttcaggaataaaaggtttattagaatcattacgaaaagcattgccacacataaattttaagcaaataagttcaccaagaaaaatgtgcaaaatcagttgaatttgatagtgaagatctgcactcattcaaagaggctgaaattttaagttgcaagactgcaaaataattggtcaagatgttatacgacatccccgaaaattaaatgggtacaattaacaagggcaagggtgtttgagaccggcctttgaaaanttggnttcnagcnagncctaancaaacctccctcctaa

SEQ ID NO: 100011 - DNA, 238 bp, Triticum aestivum
  Clone ID: PAT_TA_100011
tctcgactccggccagtctcttcttctctagaaagctagcgaggcttggaggtgagcgaaaatgccggtcagcaggatcgccgtggggagccaccgtgaggtgtacgaggtcggcgccctcaaggcggcgctcgccgagttcatctccacgctcatcttcgtcttcgccggccaaggctccggcatggccttcaacaagctgaagccccgacggcgcggcgaaccccgccggcctgat

SEQ ID NO: 100012 - DNA, 582 bp, Triticum aestivum
  unsure (1)..(582): unsure at all n locations
  Clone ID: PAT_TA_100012
agaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacaagccatatccgcaagccgcaaccatttccatcacaacaaccatatctgcagctgcaaccatttccgcagccgcaaactaccatatccggaagccgcaactaccatatccggcaaggccgcaaactaccatatccgcaagccgcaaccaatttccgaccaacaaacaaccaatttccaacaaatcggcaaccaacaagttttcgcaaccaacaaacaaccaatttcgcaagcaagcaagcaagcaanaacaacnacaacnancaaaaacaacaacaaacaacaacaacaacaacagattcttcaacaaaattttggaacaacaactgantccatgcaagggatgnttgtattgcaacaacncaagcatagcgt

SEQ ID NO: 100013 - DNA, 604 bp, Triticum aestivum
  unsure (1)..(604): unsure at all n locations
  Clone ID: PAT_TA_100013
atatatctttattaaaaatgaattccancanntttagaacantggaagatgaaatgagcaggtttgaacgcagagatatctgctgctccaatactcaacgcctatggcccagcatacatacctggttttggagctatacctccaccaccagcacctccaatgttaataccacatcaagttaataagggtgtcaaaagatatgataatctatttntaacacctacttctactcaagtccgcantggtttctgcgaaacctactttatatgctgctcctaaggcaagtactcantcaatgcctcaagcagncccgacacaatcagtagattttattgctcttcaaaatgaagtggagaaagnattaaagaagttggncggatgganaaantttagtgcaanaattaactttttctcaagggtaaannctnggcagtgcactaacaatcctttttggggcccggggggnttnttaananggaaaaagtccccaaantntaaaattttgaagaaaaacaagntnggggggcaaacntggggaaaantccttcaattggngggattggcaaagaatnaaggttttangnattttnccgtggggattttt

SEQ ID NO: 100014 - DNA, 398 bp, Triticum aestivum
  unsure (1)..(398): unsure at all n locations
  Clone ID: PAT_TA_100014
cagaaccttccttccgtccatccagatctcgccgacgccgcctcctcctccacctcccccgcaccgtccctccggcggcggcggagccccgcgcgccggctcggccacgatgcagccggtgccgggcgccgcaccctcctcctcctcctcgttcggcgacgcccggctcaagcccccttcccctcccccccgcccttggcactcccacctctcctaactccctcccctcgtctcccctcctctacgcgccgcctcacccagctaaccccctctccctcactcgcccctgcctcgccgccccttccgcggnatttctngaccaacatctgcgcatccgtgggcaccgttgattgggcgactgaacccacccaactcaagnttaacacctcangtgacaa

SEQ ID NO: 100015 - DNA, 556 bp, Triticum aestivum
  unsure (1)..(556): unsure at all n locations
  Clone ID: PAT_TA_100015
acatccgccgcaacgaggccatcctcgcctccctccgccgcaaggccgacgagctctcggcggccatcaagtcctcgtccaaacgaggacaagggcgccccaacaatcaaccccgcaagaagcccgccgccaagacaagccccggcgagctccgccgctccctccggctctcccagctccccccctcccactccccggacgccgagcccacgcccgggccccctccggtgccccgcaacaacaagcttctcctcctcgctcgcgtcctccatcatcgaatccgcctcgctcgcgccgcctggcaaggntcgggcggacggtttccattccgggaaaganctcgttgtgaaccctgcgaaagtcaagaaagtggttgccgaaaagataattngggtttcggttctggcgctngtcaacgggacgttgtccccggggggaaaaaatttgggnaaaattgggttttggnttgggacggaatggtggaaaaattaggattggnaacaatggngaaaatngggttgttcaantattgcctcaaaaggggcctgttgcaaaa

SEQ ID NO: 100016 - DNA, 572 bp, Triticum aestivum
  unsure (1)..(572): unsure at all n locations
  Clone ID: PAT_TA_100016
cccaactccccactcctccctctcaaaaaaaaaaaaaaaaactccccactcctcactccagccagcaatgacaggcgatcccgccgccgcggggcccggccgaaaagcgccgccgccggcccggccgccgaggccgctctccgtcgtctccgccctccccttctggttctacctcaccgccgcggtctccctcctcgcgctcctcctccctcanctcctctccccccaccacccccctcccctcccgcctctcctccgccgccacctctccgaagggcgcctcctcaagctccaaccaaggccgggacttttttgncttcaactcccggcccggccggccaatccggnggnggaacaacaacccgtggntcgttctcccggggctcgccggccgggattctttttctttcggcggcttctttccttcctctngttccnggggctcnttcnccgcgggcgttaaacttccctggaaaangggctctncgcggcttcggggggcccctccggccggnaagaaaccggntcggggaaatantgggncggggnatcttccaaggggtttgaacaac

SEQ ID NO: 100017 - DNA, 589 bp, Triticum aestivum
  unsure (1)..(589): unsure at all n locations
  Clone ID: PAT_TA_100017
cgcgttgcanaggagaaggagcaggcggcggcggtgcccgaanaggananccacggagacctancccgagctcgcaaccatggctaggggtttgaagaagcatctgaagaggctcaatgccccgtctcattggatgcttgacaagcttggtggagcttttgcccccaagccatcatccggtcctcacaaggccanggaagtgcctgcctctnatcctcatcctgaagaacaagactgaaatatgctctcacctaacgtgaagtgcaatctatccttatgcancgtcataattacggttgattggaaaaggcctcaactggacaannaacntaaccctggctggtttcaatnggaaatcaatttccaattcccaaagaactggtggaagaaactaacaaggcttnctggtatgaacaccaaagggtcncttnccgccttcaatctgttaagggaagaaaggatnnttaagttcaaanctcctgcaaaggtcaaggtctgttcaatttggccaaaaaggcatnccaaacctcaacaactatgatnggcccaacatncgctaaccaaaccaatcaatncanggcaatgttnn

SEQ ID NO: 100018 - DNA, 556 bp, Triticum aestivum
  unsure (1)..(556): unsure at all n locations
  Clone ID: PAT_TA_100018
gatcccatttccccaatcccctcnccgctagggttttccaccatggcgtcggcgtcgcgtgcgctcctcctctccagggcctcgcccctccacgccgccgcctcccgcttcctccgcccggtcgcggccgcggggaagcctcctcccggcggngctggtcccgtcccccgccgcggcgccctgggcggcggcgaggcgattcgcgacgcaacccgcgaactcgtcgctgcgggactcgtccccgaactgggagcaaacgcccggccaaggaaaagatnctcctccaagggtgcgaattcnaacaatggctcngtcngtcatgggagccgcccccaagggaaggggctaaacccgatgtcaacctcgangaaattaatnangggtaaantaaaaccctcccccaaagtcntnggaagtgaaaaagaagcaagggatgaagatntactccgtgttaactaaggaantaatttggttttggggggcccaanaacttgaaggaaatcnccnanaaaanctaaaaaaattgccaaaatccgnttgggtttctccctgaatn

SEQ ID NO: 100019 - DNA, 580 bp, Triticum aestivum
  unsure (1)..(580): unsure at all n locations
  Clone ID: PAT_TA_100019
caactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaataacnagtcncccagntccaacaggcattatcccangcanccacaacatacatttccccaacctcaacaaacattcccccatcaaccacaacaacaagttccccaagcctcagcaaccacaacaaccatttctccaagccccaacaancattcccccaacaaccacaacaaccattcccccagactcaacaaccaaaacaaccattttcccaagcaaccacaagaaccattttcccaagactnaanaaaccccaacaaccatttccccaacaaccaaaancaagcaattccccccagactcaaacaanccccaacaatcaattttcccaagctncagnaaaccanaaanaaccttttcccangcccaaaaaaaatttggcggnaaccccaaacaaanggnatnaattaattcccccaaaaaaaa

SEQ ID NO: 100020 - DNA, 552 bp, Triticum aestivum
  unsure (1)..(552): unsure at all n locations
  Clone ID: PAT_TA_100020
cgccgcctcctctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgaaaggttcgagaaggaaagccgctnaagattaacaagcggtcgttcaaagtacgcctgggtgcttgacaagctnaangccgagcgtgagangggtatcaccattnatattgccctgtggaaattcngagaccaccaagtnctactgcaccgtcattnatgcccctggtcancgttacttcatcaagaacatgattactggtaactcccaagctgactgtgctgtgctcaacaatgactccaccactgggggttttgagggtggtaactccaaaggagggcaaacccgtnaacaacncctccttggtttcanacctggggtgaaacaaattatttggtgctggaacaaaatggtgccaacantcctaatacccaaagntcgttttaaagaaant

SEQ ID NO: 100021 - DNA, 577 bp, Triticum aestivum
  unsure (1)..(577): unsure at all n locations
  Clone ID: PAT_TA_100021
ccaccttccccgatccctccaccaaccatgacaacctccccgatccaacgaccggaccgccgcctactctcgatacccacacgccgccgccggcagtggatccgatgcgtcgccgcctgccctagatccccacgcgccgccgccggccctggcaacctctcacgcgcctccatcactgctgccgctcatcctccccatgcccgaccaaccaccggcgcaaccccgcgcgctccgccgcggatncaactgcctccgcccaactgcaacccgcgcacggggccgcaaattccaacaacgcctgattgccttgtcccgccaacaaactccgtcggactgntcccgaactctggcggccttctccaaaatgaaccggcgggcccctggaacaanggccctgattnccgaaancaacggccaaagaanaattgtggcattggnaacgtttgttgtaaaaaaaaacaanggttcttaaattctgggctttggaacttctgggtttggaatcctncccgcgttgaantttntngggcctntgaacgaactttccggtgtncncaaancttgaatnttnggaacn

SEQ ID NO: 100022 - DNA, 548 bp, Triticum aestivum
  unsure (1)..(548): unsure at all n locations
  Clone ID: PAT_TA_100022
gcatcatttaagccaagaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacaagccatatccgcaagccgcaaccatttccatcacaacaaccatatctgcaagctgcaaccatttccgcaaccgcaactaacatatccgcaaccgcaactaccatatccgcaancgcaactaccatatccgcaaccgcaaccatttcgaccaaaacaaccatatccacaatcgcaaccacaagtattcgcaaccacaacaaccaatttcgcancaacaanagcaacnacaacaacaacaacaaaaacaacaacaacaaccacaacnacaacaggttcntcaacaaantttgnaacaacactgattccattcaagggatttnttc

SEQ ID NO: 100023 - DNA, 608 bp, Triticum aestivum
  unsure (1)..(608): unsure at all n locations
  Clone ID: PAT_TA_100023
gccggtacagaggagagaggagcggcgccttctcctccattggcgcatctttatctaggccacagcccgggaaaggagcagccaccattttttagacccccaagaagcaaggaccgagccctgtgctagtaacaccaaacgctcccccccaagcgaaagcggcggcggcggaagacaatccaagaagaagccggccggccgccgtttcccaangcgatnttgaaattgggatcctctgcttcggcgcctcctccaaccttgctctgcgggnaaggaaaancaaacaacccccctcnggccttgggcntctgccggcggccggcgggccaaagtnggccggggggcngggccggcnggccttggggcttccctggaacgtccggngccnttntttccgggtccgaaaaacgaacaanattaatgcggggcgcttggtgggagaaaggagaattggttaatcgggccaaagggcgggctaacttngaaccggcttgggggaacgggggganttcaantcctccctggaaggaaaggaccccatggatttgggttttncaaaggtccaatttcccaacnanaattttgggccaactgaacccctttnccnc

SEQ ID NO: 100024 - DNA, 572 bp, Triticum aestivum
  unsure (1)..(572): unsure at all n locations
  Clone ID: PAT_TA_100024
ctcccgatcccatctgggtcggggcacccgatcccgccgccgtcnttcgaccccgcggtgctgcccgtcgctttcgcccaggggcacctcgccggaacaacgcaccgccgcctccgccccgcaactcctccccctgtccttgtgccaccgtcctcggccaagacctggccggatttcgcgcctccacgttctccaacactcatcccggactccccctgcatggattcggtcggggncaaacgccgctgcctctaacttgatgccaatcgccgttgccaagaacccggcggcgccgccaacaaactggctcgcccccaatcgcctccgtcttcgtctcctcctcnggttngtcaatcccgcctcgccgggaaccccaatttaatctaaaaaggggggtganaaaccctctntctggcttttctcccccgaagaaataaaaagcttncttcggtcaanaanggtccctgcgttctgttntttggttcaacggggccaaaaaagngcccggcctcttccaacttttttaagttgngggnggaaaaattntcaattgccgnctnttnccccccctt

SEQ ID NO: 100025 - DNA, 560 bp, Triticum aestivum
  unsure (1)..(560): unsure at all n locations
  Clone ID: PAT_TA_100025
ttccctccttcgcccgccgcctccctttgtcccttcaccgctgccgcccttcgtcccttcgccgcccccgctccatccattcaccgtcgccctggcactgatccggcgcgtaaatcacacatcacaagcgccggcctccactgatccggcgctggtccaggatccggcgccgatcctggtcaggacccgtcgccggagacgtccaaggatctggctacacctttcaccaagccgccgccgaggagccctatgccgcaagccaagatccaaagaggagcaaccgccgccgagattcgaaaaggaagtanccgccgccgaagttcgaaaggaactgggcaccaagaacttcctccccanccgggcggcaacaactcctcccccaacccctcccccaagtgcctggcaaaagtgggtctcaacctccctcctaactccgttcaagggtaagaactcccctcccctcccgatttcctcccttcgtcaaaggcaaganctccctcccctaaccgatttgacnaaaaaaagggcaagccntaatccgggtgttccaagttggcaaa

SEQ ID NO: 100026 - DNA, 664 bp, Triticum aestivum
  unsure (1)..(664): unsure at all n locations
  Clone ID: PAT_TA_100026
ctacaaaggaggaacaagctggtggtncaccaccggtggtgggngcgccgctctaacaactaggtgtgntccngcgggctggnggctatcantnaaagtatcaaatccaattangtagtagccnccacaatgtccaccatgnngaccttattcancctaanaatccntgcgatggnaanaactatcgccacngcgaatntgcaggtcgaccccagcggccaagtacaatggccacaacaacaaccattccgccagccccaanaaccattctaccancanccacaacaaacatttccccaaccccaacaagcattcccccatcaaccacaacaacaatttccccaagccccagcaaccacaacaacaatttccgcagccccagcanccacaacaancatttccccagccccaacaagcccaactaccatttccccaacaaccaaaanaaccattcccccaggctcaaaaaccccaacaancattttcccagtcacaagcaaccacaacanccnttttccnatgcccaaaaaacgcaaaaatcattcccccagnaacaanaaaccgttnnntcaagccatttctacaaaaatcagttggaacctttggnagaaataactcttatnncaatggnacctgtttttttgggggtcnancccccgnggtn

SEQ ID NO: 100027 - DNA, 570 bp, Triticum aestivum
  unsure (1)..(570): unsure at all n locations
  Clone ID: PAT_TA_100027
gcatttaagccaagcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcaagcaacaaccatttccaccacaacaaccatatccacaagccgcaaccatttccatcacaacaaccatatctgcagctgcaaccatttccgcaagccgcaactaccatattcgcaaccacaaccatttcgaccacaacaaccatatccaaaaccgcaancacaagtattcgcaaccacaacaaccaatttcacaagcaacaagcaagcaagcaagcaaacaacaacaaacaacaaccaacnacnaacnacaaccaaangcaaatccttcaacaaaattttgcaacaaacaactggattccaatgcaanggattgttgtnnttgcaagcaaacacaacaanagcgcaggggaaaattaaaaaggttttgcaaca

SEQ ID NO: 100028 - DNA, 549 bp, Triticum aestivum
  unsure (1)..(549): unsure at all n locations
  Clone ID: PAT_TA_100028
gcagcaacgggtccccgcgccgtcttccccgtcaccgtcgtcgtcgccgcggtccagccctccggtcggcgctgtgcgttgatccaggttgctggcgcgtggccaaaatccgtgcagttctgcaggtcgtcgccggcggacaatgtggggcgagagggctcaccacaagcacgggcaccatcacgacaacgtcggttccaaggaccaacaacccaagttcatagcaaacaactacagctcggtggatgaggtcattgctgcgttnagggaaactggccttgaatcntcaaatctaattctcggtnttgacttnaacaaaagcaatgaatggtcangtnngcattcctttggaaaaaaatctctgcatgccaatagtggnaacccaaacccaaatgagcaagccaactctatnantgggcgaacaataacaacttttgatgaatattactttataccaagcnttggatttggtgatcntccaaacaagatnaatccgggcctcaacttttacaaaaaaaccgtcctncctgggtttganganggtcntga

SEQ ID NO: 100029 - DNA, 615 bp, Triticum aestivum
  unsure (1)..(615): unsure at all n locations
  Clone ID: PAT_TA_100029
ctccgttccccactccactccgccctaatggcgtcgccggcgccgcccttccccggcgcccctccgacgccgtcctcccatgatgccccggcggcgccgccctgcaggcccgacgcctctccgacgttggaggcgcaggcggacctcccggaccacctgacggaggagatcctcctccgcctccccgcggccgccgacctcgcccgcgcgtccatggccggcccctccctccgccgcatcgtcgccgaccactccttcctccgtcgcttccgcacactccacccgccgcctctcctcggtatactctccgactcattcctcccagcccagccgccccacccctccgccgccgccgcccgaaccctcgccgccaccgacttctcctgctccttcctcccctcccgcgagcagccctggcgtcgctgcgacttccgtgacggccgcgcgctcctctgcgtcgcccccgacgcctgcgacctggtgagggacgtcgccgtgtgtgacccgctgcaccggcgctacctgctgctacctcccgtcccgcannacctgtccgatatagtctatcactgggagctttttcttgctcctgccggcggagnnnnnngcgccgan

SEQ ID NO: 100030 - DNA, 372 bp, Triticum aestivum
  unsure (1)..(372): unsure at all n locations
  Clone ID: PAT_TA_100030
naacaccataacaaacttgaaaattcaccagggtttcaacaaaataacaaaccacaacagtcccaagggagtcccactagtgaccatccaacaaattactgctgcccacctttacagcagcttacccccccttccccataacaaaacggaggaaaggcaaaaccttcaactgaaggccgtcactcaggggcaaccagcggcttgtttctgcggcctgatccnttcgtgcnnnaccatggcnaccctgtcgggctgcttcacggaggatccgtccaaaaccggggcggcccggccaaagacccggttgtattgaacttactccttttgccgaaacctttcctgctggggcggggnnntctcgtcccactgnnn

SEQ ID NO: 100031 - DNA, 546 bp, Triticum aestivum
  unsure (1)..(546): unsure at all n locations
  Clone ID: PAT_TA_100031
gcacgaggctcatccccaagctcgaacccattgctcttacccccgagctcgagccctcccccgacggccacccggacctcaccggccacctccacttcacacagcaccagatcgacgccgtccccgccgaccaccgcctcgtcgtctccaatccgcaacccgagcccaacccacaaggttccattccccccgcgcactctgacacatccgtctcctcctcttcgtcgaccgccaagaagcgcgcccgcggcggcgagatggtgcgcgtcaatacggtcacgcctcagnaccacatccacttccggtccctggtccgccgcgcgcgcctcaccttcgaggcgctccgcgggatctaccagcgcgaggagtcgtacgacggngnnncccgcaaccgcttcgacctgcgcgcctccagcaagatgctctcccggggcctctggctgtaccgggacgtgcgcatcgtcgnnnccatccccggcgtcctcgtcggcgacgccttccactaccgcgccgagctctgcgtcgtcgnnntncactgcaccccgc

SEQ ID NO: 100032 - DNA, 580 bp, Triticum aestivum
  unsure (1)..(580): unsure at all n locations
  Clone ID: PAT_TA_100032
gttcagtcctagcagctcgcgagctcactgatgacttgtcgatcgcggcgagccacgagagttggatgttgcaatatggccgtgtgtacaaggatgccactgagaaggcacaacggcttaaggtgttcaaggctaatgtcgagttcatcgagtccttcaacgccgagaaccacaagttctatttgggagtcaatcagtttgctgacctcaccaacgaggagtttaagacgacaacggctaacaagggatacaaatctagcttggagagggctcccacaggattcaggtatgagaacgtaagcttggatgcacttccagcaacagtagactggaggaccaagggtgcggtcactcccatcaaggatcagggccaatgtggttgttgttgggcattttccgccgttgctgcaaccgnnngcattgtcaagctgaaaactggcaagcttatctctttatcggaacaagagttggtagattgtgatgtccacggcgtggatcnnnnctgtgnnnncgggctcatggatgatgccttcaagttcatcatttcaaatggtggactgacaggtgagtctagntaccc

SEQ ID NO: 100033 - DNA, 601 bp, Triticum aestivum
  unsure (1)..(601): unsure at all n locations
  Clone ID: PAT_TA_100033
cctagcgccgccaggctcccaccgcatctcgatcgaatagacaactagccaactctccatcgcgatcttgccctctccgcgcttggttaagctaccaggcaaatcccaacctcgccggtgactatgtggccatggtggcttgtgatgatctcgaccacgtggtgttgatggtcggtcttggtcttgtggtgctggtggcaacagcgtcgtctccgtcgacaaaacaatcaagagatgggtaccaagtctgctactcgtaccgatatgttggtcgacataggaacggaagctggctgtgataatcttgaggttccacgacatgttgggaatggaagtgcatcccccgcgaaaggcacaaagaggaaatttgttgttgatgcaaccaaaggtgcatcacctggtgttaatgcaagtaacactgggcagcacctgcattcccgcagaaaaggtaagggtcctgggaaacatgcaaagctggaagacaacaaaggtgctactnnnnnggggagagatcagacaccaatcggcgtatttgaagatgaatgcgttttctnccattcatttagnaccagtgagcagttcnatgnnncgatgnnactnn

SEQ ID NO: 100034 - DNA, 565 bp, Triticum aestivum
  unsure (1)..(565): unsure at all n locations
  Clone ID: PAT_TA_100034
ttcgagttgggtagtttagctctacccaccagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggacggccagacacgtgagcatgccctccttgctttcactcttggagtgaagcagatgatctgctgctgcaacaagatggacgccaccactcccaagtactcgaaggcgcgttatgaagaaattgncaannnnnnnctcttccta

SEQ ID NO: 100035 - DNA, 641 bp, Triticum aestivum
  unsure (1)..(641): unsure at all n locations
  Clone ID: PAT_TA_100035
ctcggctgtacggatcgagccaacttgtttctcgaaccctagtggactaatctgttcttcgttggattgctcttgttttgctgcctgcgattgcagttcgtgtgtccggggcaaggatggccgagccctccagggtgatccacatccggaacgtcgggcatgagatctccgagactgacctgctccaggtggtgcagccgtttggcgcggtcgccaagctcgtcatgctgcggaccaagaaccaggcccttgtccagatggaggacctgtctgcttcaattagcgccatccaatactacactacgattcaacctagcgtgaggggaagaaacgtatacttgcagtactcatctcaccaggaactgactactgatcagagctctcatggacggaatcctgatcaggtacataattatccagttgcactttgggttctatactctattagcatgattgcttttctataggtaatcagctgtnnngtgcatttctgtaatctatgatctctgcatgtaaacatattggcntgttnncattccttctacttnnngtgtgggttgctcttctctatataacattatgggttcttgctcacagtatataccaacctaaatgacnnnnnnnnnaaaatgaacagctgg

SEQ ID NO: 100036 - DNA, 595 bp, Triticum aestivum
  unsure (1)..(595): unsure at all n locations
  Clone ID: PAT_TA_100036
gcacgaggtcgatctccaagctccagtgcgccgccacctcctgccgaccgccgccctccccggcaccgcacgccgccacgaatgtcgcggccgttggcggctccccccgcccctgctactcttctccgctcccgccgcctagccccgctgcctcgtctccaccggcgggattcgccgctaccggccaccaccgctcaccccaagccctcaccgtgtcgccggcgcggcttcggtgactcctcccctgctcatacctcgcccccacacatagctcagcccactggatggagctcctccgcccggtggccatggccatggggtgctcaagctcctcctccgatctcttcgccgccgccctcgcagtcgcatcaatttccctggatccctatgcttcctcccttcgccgctgccgatctcgtcgctacgtcaacggcaaacatttgacgccgccgaagcggatcgctttgcaaacgccgaggtcatcttataggccggaaatgccgaggacaccgttgccgccgtcgccaccatcgcggaaacccnnngcagggcgggcagcgaggagcggcgcaaggnnnccgtgccctgccctcct

SEQ ID NO: 100037 - DNA, 593 bp, Triticum aestivum
  unsure (1)..(593): unsure at all n locations
  Clone ID: PAT_TA_100037
ccaccttcctccacctgcagcggagaggaaagaaagcccctccaagaagaagaggaagcgaactcggatccgcgccccgccctgccccgccccgtccccaatcaatcccctccgaatctcgccgcggccgccgcaggatcgccgtcaaaccctagggaggaaggaggccaagggtgcgccagcgcgagcctcggctcccgatgccctagcgcccgcctcctttgtggctgccggtcgcgcccgtcgtcttggggctcgatgtcgtggagggatcccgctgtgccggcaacggggaggttcaactcccggccgcagcctgtgccgccgcccacgccgcatcccccgccagtggttgttatcgacgaggatgatgacgatgtcggcgcagacgatgttgccgctgccgaatctgaggttttcattattgatgatgatgatgatgatgtggagatagcccgtgtgatggctgcgtgcattagcaagaaagggaacagctcttgtagcaatgtgatcaacatagatgatgatgatgnnnntgatgnnnncgatggtggtcgggctggccccagcatggcnnncgccggctcnnnagc

SEQ ID NO: 100038 - DNA, 446 bp, Triticum aestivum
  unsure (1)..(446): unsure at all n locations
  Clone ID: PAT_TA_100038
cgcttttgcaggcagcgcactaaaaccccggggagcgcgccccgcggcagcagcaccgcagtgggagagagagagagagagaggcttcgccccggcccgcaccgagcggggtgatccaccttccgtccgcacctccgcccgcctcctgttttctgcgggctcacctccagatggcggcgacgggcgtcggcgccgggtgcctcgcccccagcgtgcgcctgcgcgccgatccggcgcaccgggcgaccgcgtgcgtcgtccgcgcgcggctccggcgcgtggcgcggggccgctacgtcgccgagctcagcagggagggccccgcggcgcgccccgcgcagcagcagctggccccgcccgtcgtgccaggcttcctcgcgccgcccccgcccgcgcccgcccagtcgccggccccgacgcagccgcccctgcccgacgccggcgtn

SEQ ID NO: 100039 - DNA, 427 bp, Triticum aestivum
  Clone ID: PAT_TA_100039
gcacgagggacaaatctcacacgctccccatcttctcttccctggcacgacaccgccgccgcggcggcgagcgattccgatggcggccacgggcggcggaggcggtggcggtggccgccactggatcgaggcggagacgcccgacttccgagccaggatgcgccgtatctacctacctaccaaattggccacatattttcagcccaagtattcccccaattccctggaggcccaaacacttattgccagattggaggaggatgccttcagggggacaaacagtaaggtagagtacgtgaaaaaaatatctgacaaggtggtcactatgttgagaaataaaactgacgagctacaacgacgagcgcagttacaaagccaattgcaacaggctattgaagcacaggctttacatggaggcagttcttct

SEQ ID NO: 100040 - DNA, 619 bp, Triticum aestivum
  unsure (1)..(619): unsure at all n locations
  Clone ID: PAT_TA_100040
ctacaccacaatctcagatttgacttcccgcacgaggagcagtcgggatcgggaggggacgggagggatgacgagccatcgccgcctccgctcgacggcgcggccgccgctggagaacgatgacctgctctccgaggtcctcctccgcctcccgccgcagccgtcctccatcccgcgcgcctccctcgtgtgcaatccctggcgcagcctcgtctcagatccaggtttcctccgccgcttccgcctccagcaccgccgcaacgctcctcttctcggtttcttctatattagtttcgcggagggaagttctcgggacatctacttcgtaccaaccatggatcgccccaatcgtctgccggagggccgcttctacttgccggccgacccagaggacggctaccgcgcgctccttggatgccgcgatggtctcgtcctcattctccggctaccttggaggtgccccgagaaaacaaaaacacccctggcatcgtggcgcccggtcctggtgtgggatcctgtcagcggcgaccagcaccccattcctgttcccctggtgcctgatgatgttaagctctcatggtggaacaacgnnncgnnncnncgnngtgccggattnnnn

SEQ ID NO: 100041 - DNA, 432 bp, Triticum aestivum
  Clone ID: PAT_TA_100041
gcacgaggatctctatccctcctcagctgccacagcaagaagccacgaaccctagccatctccctctccttgcgtcttcatgctcatcgccgccattcccccgctctccatcattgcccgacgccttcaccggctagctaccatggatccatggccgatgggagagtacgccgtcgtcgacccatcgcttaggttggtggcacatgggtcgggtctgggcagaaggccggcgcctgcgggggaaagtggcgggggttggtgcagcggaaaatgaggacggggttggccgtagagggaggctcgccggccggtacagccggagcaaggaggcagtgtcggccatggaggaaggcccactggccggagcagcaggagcaactgcagccgctggtcagctcgacgcaccgcctcctccgctgcagcccgcacggt

SEQ ID NO: 100042 - DNA, 547 bp, Triticum aestivum
  unsure (1)..(547): unsure at all n locations
  Clone ID: PAT_TA_100042
ggaaaagaaaaagaaagcaaggcctcgggagggagggacagaccaaaagcaagaggttaaaaaatactagttgcgctcacacagtttcctcccacccacgccgtcccgtccgcccgccccatttccgcgtctcggcgtgcggaagtcaaccccaacccacccccgagagccccgcggcccgcaggaaatcgccgcgaatccggcggccatgttcggcgactccgacggatccaaggaccccggcgccgcgccgccgcccgccgaccagcccttccccaaccgcgagctcaccctcagcagctacctctgcgacaagcccaccctcgcctccgccgccgccgccgaggccgctgcttccgcggccgccgcggcatccgcagcggcgccgggcccctcctcgcctcccaaccccaaccccgccgccgacgccgcggccgacgccgccaacgccaagctctgcgtggagcgcgacttcctccacctctccgcgcccaagcgcgnngatccccccggggacgactnnnncgtggtcggcgggaagaagccc

SEQ ID NO: 100043 - DNA, 403 bp, Triticum aestivum
  unsure (1)..(403): unsure at all n locations
  Clone ID: PAT_TA_100043
gcacgaggctccctcacgcctccgtccccgtccggcaccaaacccatcccatcccatcccctcccacccttttccacacctgaccaacgatagccaggccaccgcacccgcagtttcgtgcaccgcacttctccacccaccacctacctccccccgtgttcccctcccccctcaaaacctatcgccgcggaccatctacccaccgacgagcgactgcggccgattgatccgcagggcgaggcggtggcggcggagggagcccaccagatccggccgcggcggcgatgatgaagcaactgctgccgcagagccagctgcggcgctcggcggcggcgtnggcggcgcgctcctccgtcaacggggacaagggcgcggggggccccnnnnnnntnnncacgggcgc

SEQ ID NO: 100044 - DNA, 415 bp, Triticum aestivum
  unsure (1)..(415): unsure at all n locations
  Clone ID: PAT_TA_100044
cgcngcgccgnnactccacccgcagcggtanncatggcggtntntnnnnacaagcgcatctccaaggggaggaagggtngcaanannnaggccgtcgatccgttcaccaagaagcagtggtatgacatcaaggcgccgctgctgttcaccagccgcaacgttggtaagaccctcgtgtccaggacacagggtaccaagattgcctcnnngggtctgaagcacagggtgttcgaagtatctctagctgatcttcnnnacgatgaggaccaggcctacaggaagatcannctccgtgctgaggatgtgcaagggatgaatgtcctcacaaacttctggggcatggacttcaccactgacaagctcatgtctattgtgaggaagtggcaaacactcattgatgcntatgtggatgtnn

SEQ ID NO: 100045 - DNA, 626 bp, Triticum aestivum
  unsure (1)..(626): unsure at all n locations
  Clone ID: PAT_TA_100045
ctcgccgccccagccagtcgacggcggtggccggctgcccctcctcgcgctcccaaatcctcattcctccccctccttccatgcgcagatcaacgtagccatgcggatctggcagggcggagtgatgttttttgccgccgctgccgtgtgcatcctatatggcagcgccgaaatggtttgggaggtgagatcccgacatggccacctcccacagtcgtttcctggcgccaatcagacgacaccaaagatctcccgcggactgctacgaccgggcacgcgcacgacacctcacccaggaggcatgcgtgcgtgctcggttcaacaagcgttggatcgacgcttgtggtgggcagagcgatgggctcattgcgtgttctgccgttgccacgggagtgtgacccggtgttctgcagcctccattggcaacgtgaagatccatttcctatctctagtggtgagaacgatccactgggtccgctttggcaccttcattgcctcgttaaccaagctgctaatagggggatcaagacnnncgtgtttgaagannnnnggataggctctgtnnnnnccatctcgcatgctcatatcgagtcgagagccggagaagnnnccatagagcatgcata

SEQ ID NO: 100046 - DNA, 606 bp, Triticum aestivum
  unsure (1)..(606): unsure at all n locations
  Clone ID: PAT_TA_100046
tcccccctccccacccccatttcaaaccaggagacgagaaacaaattccctcataatcctccgattcaaccatcaaatcgcgcccctaatcacgcaggaatccatccgctcgccttcatcaatcgctcgaatccatccagcagcagaaaacggaggggaacggagcgtctccggcgacggcggcgatgatggaggaggacccgctgatcccgctggtgcacgtgtggaccaacgccgccttcgactcctcctcctcatcctccgcctggcacgcgcacgccacgcccgtgcgcaggggcgagaaggagaaccgcaggcccgctgaaaccaacgacgccgacgccgagatcgcgcgcatcgaggccgagatcctccgcctctcctcgcgcctccaccacctccgcgtctccaagggccacgacgccaagcccaccgcgacgcggccgcggccgagggggctcagcctcgccaccctcgacgacctccccgctgatgccgcngaccccgacaacctgctcctcctcccggacaagcagcagcccccgcccgccgcgcagaagcccaagcccgccgccaagcagcagnnnnnnnnnnnnngggggggnn

SEQ ID NO: 100047 - DNA, 626 bp, Triticum aestivum
  unsure (1)..(626): unsure at all n locations
  Clone ID: PAT_TA_100047
caagaatcaaatccaagtaagtagtacctaacgcaaatccaccatgaagaccttactcatcgtaacaatccttgcgatggcaacaaccatcgccaccgccaatatgcaagtcgaccccggctaccaagtacaatggccacaacaacaaccattcccccagccccaacaaccattctgccagcaaccacaacaaactattccccaaccccatcaaacgttccaccatcaaccacagcaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaatnnnctcttgcagnaatgcaaccctgtgtcattggtgtcatccctcatatcaatgatcttgccacgaagtgantgnnnnnnnatgc

SEQ ID NO: 100048 - DNA, 626 bp, Triticum aestivum
  unsure (1)..(626): unsure at all n locations
  Clone ID: PAT_TA_100048
gtcaagcataggaagggaggcctgccagcgacgaagcnntggcnntgttcgcgatggagagcgtcatgctgccggcgagcatggtgctggtgcagctcttctccatcttgctagtgcttctctccaagctcgccctcaacaccggcatgcggcccttcgtcctcctcgcctaccggaacctcatcggcgccgccgccgtcgcgcccctcaccttcgtcttcgagaggaaaaaagccaaaatcccaaacctcatagagtggggctggatttccatgaatgccacatccggggttatcctggcgatggggctgtactactatggactgcgcggcaccaacgccacctactccgtcgtcttcctcaacctcatccccatcgtcacctccgtggtcgccatcctactccgggcagagaagctggtattcaggaagtggcatggaaagatgaagctcttgggcatcgtggcctgcgccgggggaacaatggtggttagcctgtacaagggcaagatgctgcaccatccttggccgacccacctgctgnnntcccatactcnnnnnnnngcagctccggcagctcaccacaacatggtcatcggcacgttnnncntttgnnnnagttgnntn

SEQ ID NO: 100049 - DNA, 599 bp, Triticum aestivum
  unsure (1)..(599): unsure at all n locations
  Clone ID: PAT_TA_100049
gcacgaggcctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgttannnnngctattatc

SEQ ID NO: 100050 - DNA, 341 bp, Triticum aestivum
  unsure (1)..(341): unsure at all n locations
  Clone ID: PAT_TA_100050
aaaagggaacataggcttacccacaacaataccaagggtcacaaagttttgatttcatttttccatcaaataatttaccccctcccctgcaataaaatctgaggacatttccataataactaccgtaggttttaaaatggtaaccccggttcctttgatgaccccctaggaaaaactgctcgttttgcaaaacttttaataaaatttttcctaccccccaaccaacgttttggcctaatcaaaaatttggcaagccctgaacaaaggctaattttgcctaatcccccacctcaatgatcttcacaacaaaagaatttcccactttttggnnnacaacaacc

SEQ ID NO: 100051 - DNA, 638 bp, Triticum aestivum
  Clone ID: PAT_TA_100051
gcacgagggcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagtgtcgcgcattccatcatcatgcaacaagaacaacaacaaggcgtgccgatcctgcggccactatttcagctcgcccagggtctgggtatcatccaacctcaacaaccagctcaattggaggggatcaggtcattggtattgaaaactcttccaaccatgtgcaacgtgtatgtgccacctgactgctccaccatcaacataccatatgc

SEQ ID NO: 100052 - DNA, 617 bp, Triticum aestivum
  unsure (1)..(617): unsure at all n locations
  Clone ID: PAT_TA_100052
gcaatactagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaaccaccattttcgcagcagcaacaaccatcttcacaacaaccaccttttccacaacaacaccaacagtttccacaacaacaaatccctgttgttcaaccatccgttttgcagcagctaaacccatgcaaggtgttcctccaacagcagtgtagccatgtggcaatgtcgcaacgtcttgctaggtcacaaatgtggcaacagagtagttgccatgtgatgcaacaacaatgttgccaacagctgccgcaaatccccgaacaatnn

SEQ ID NO: 100053 - DNA, 577 bp, Triticum aestivum
  unsure (1)..(577): unsure at all n locations
  Clone ID: PAT_TA_100053
ctctctccctccccccccccccccccgcgctctctctctcgtcacacacgttcccccttcccctcgacatccacgccgagactgcgcttgaaccgcccacgattgagcggtggatgatgcgttgagacaaccgcgtgggctcctactgtatttccatccatatccggagtcctaggtgtgggcgaccaaccgcatctagatttggagtcaccgcagttgggcaaccaactacatccagatctggagtcctaggtgtgggcgaccaaccattttttccagatctggagccaacatgatgattggcgatggaggaaagcggcatactatctccgatggccacgtcttgccacgactggcatcggagaagttagttgttgcctccacttcgcgctccgctatcaacatcaaagaagaatttgaagctgatatcatgcaaaacatcaaccggagctccgacacccccatctccatgcaccgtgtcatgtttggacccgannnctgggcggacctaccacatggattattgcactccatcattnncctgttgggttcaactcgnnacctncnngnnntcatc

SEQ ID NO: 100054 - DNA, 294 bp, Triticum aestivum
  unsure (1)..(294): unsure at all n locations
  Clone ID: PAT_TA_100054
ctccaactccnttnngtacccttgcgattacggacaaannnttaataaaataataaaataacaccggctaacaccctacagtcccgtatcactccaccaccaccaccaccggcccttttccaatcgccaccgatttctccggccggagaccgatccccaccccccggcgnnacctgcgccgacnnaacagcctcctcttcgcgcggaggccgccnnctccgccnnacgcgccnnncgctctnaacttgcatacctggacagcatttaaaggaacgatggcactgcctcgcaann

SEQ ID NO: 100055 - DNA, 590 bp, Triticum aestivum
  unsure (1)..(590): unsure at all n locations
  Clone ID: PAT_TA_100055
gtcaagacaactgagggacaagttcgatgcgcttttctcaggcttgttctcctttccaatatatttcccagggacaccattttaccgatgcatgcaggccaggaaaaatgtgcagaagatactacgggatacgttggcggagaggttaagtacaccagggaagaaacatggcgacctccttgacgtaattgtccaagagctgcagggtgaagggccattaataagtgagagttttgctgttgatttggtctccacgttgttgttctccagcgtcttcacgttatcaggaataatcgctgtagcattcaaatcactccatgacaacccggacgttgtccatgccctccaggttggttgtattaattatgtcatactttatatatatactagtagtattatcaagattttagttgtattactcatgcttgtagacccacgacatatataatgaaacacaatgatcgagtagaaagataagatcctcaagacaagcaaaacagtaacatcttgaaacttgcacttcatcacacagaaagagaacccagctatgctcannnatcgaaagggnngggtgctctgggctcacannn

SEQ ID NO: 100056 - DNA, 606 bp, Triticum aestivum
  unsure (1)..(606): unsure at all n locations
  Clone ID: PAT_TA_100056
gcacgaggagcttctgcgcaccaagcaacggcgatggacaacagcgcgccgccggtgatcatcgttggggcggggccgtcggggctggctgcgtcggcgtgcctggctcggcgcggggtggatagcatcgtcctggagcgggacgactgcgtcggctcgctgtggcagaagcgcgcctacgaccgcctccacctgcacctccccaagcaggcgagcgcgctcccccacctgccgcacgacgacgacgcgccggcctacctcccccgcgaccacttcgtccgctacctcgacgcctatgccgaccgcttcgccgtgcgcgcgcgcctccgcctccgccgcgaggtccgctcggcgcgcttcgtggacggccggtgggaggtggaggccgtcaacctcgccaccggcgatgcggagcagtacacggcgaggttcctggtggtggccacgggggagttcgacgagaaggtgctgcccgaggtgcccgggctggacacgttccatggcgaggccatccacgccggcgagtaccggtccggcgaggggatgcggggaaaggaagtgctcgtcgtcggctgcggcaactctggaatggagatcgccctgnnn

SEQ ID NO: 100057 - DNA, 575 bp, Triticum aestivum
  unsure (1)..(575): unsure at all n locations
  Clone ID: PAT_TA_100057
cgctgctgacctaccaccttccatggcgctggcatccttgtccctgccatgaacacggacgcattactccgctttaattgccgcaagcgctgcctaccggctgacggtcgcctcgacgaccactggcgcggccagcagcgcaagcgccgcggcgtgcgcgtcctcgttcccgactgcttcctcgtgcccccgccggaagccaaatccgctgatttcgacatgtgggactacatctgcagcatccccgacaggctgggatggggcaacggcctgaggctgctcaagggctgggtccgtgcgtcgaaggatgtgccgcaggatccgtcggatctcacgtgtctcaccaagaatagcgatgtgaagccagggcgcgtggtggtcgcggggaattggaaagtagatgaccccgtgaaggtcgccttgaaggcagcggcgccgcctcctcctcggcgggaaaaggtgaaaccgtattggaagtatctccacgaggagacgagacataatgacaagagcttgggcgagatcgacgcccgggtggctcttctggagannnnncttgaggagcannnnnnngt

SEQ ID NO: 100058 - DNA, 435 bp, Triticum aestivum
  unsure (1)..(435): unsure at all n locations
  Clone ID: PAT_TA_100058
atcattcaagccaagcaagcagtggtcaatacaaatccaccatgaagacctttctcatcctttccctccttgctatcgtggcgaccactgccacaactgcagttagagttccagtgccacaattgcagccgcaaaatccatctcagcaacaaccacaagagcaagtttcgttggtgcaacaactacaatatccagggcaacaacaaccatttccaccacaacagccatatccgcagccgcaaccatttccatcacaacaaccattgccgcaaccgcaaccatttctgccacaactaccatatccgcagccacaaccatttccaccacaacaaccatatccacaaccgcaaccacagtatccgcaaccacaacaaccaatttcacagcaacaagcacaacaagcacaacaacaacaacaacaacaacaacaannnc

SEQ ID NO: 100059 - DNA, 196 bp, Triticum aestivum
  unsure (1)..(196): unsure at all n locations
  Clone ID: PAT_TA_100059
gcacgaggcccgctccgctaaacctcgcaacaacccccgtgggcgaccaacccagcccagccgnncccctctnntgaccaacccccgagccggaagcnnngccgggatggccgggaccgtgcccaagctcgccgccccgaggccggcggccgcggggccgttcccctcggngcccnnnnncgccgccgcgctgacc

SEQ ID NO: 100060 - DNA, 484 bp, Triticum aestivum
  unsure (1)..(484): unsure at all n locations
  Clone ID: PAT_TA_100060
caagcatcaaatccaagtaagtagtatttaacgcaaatccaacatgaagaccttactcatcctaacaatccttgcgatggcaacaacaatcgccactgccaatatgcaggtcgaccctagcagccgagtacaatggccacaagaacaaccacccccccagtcccaacaaccattctcccaacaaccacaacaatcattcccccaacaacaacaatggatgattcagtcatttctacaacaacagatgaacccctgcaagaatttcctcttgcagcaatgcaaccctgtgtcattggtgtcatctctcgtgtcaataatcttgccacgaagtgattgccagctgatgcagcaacaatgttgccaacgactnncacaaattcctcaacagctccagtgcgcagccatccacaacgtcgcgcattccatcatcatgcagcaagaacaacaacgaggcgtgcagatcctgcggccactatttcagctc

SEQ ID NO: 100061 - DNA, 625 bp, Triticum aestivum
  unsure (1)..(625): unsure at all n locations
  Clone ID: PAT_TA_100061
tgttggcnntcatctaaatctcctctctcgtcttaatctcttctctcgtcttcgctgttgagtcgaatgccccttggagtggtatgatattcagatctatcaagatttaaagtgattcacgacgcctgagagaagtacctaccataagtaaaggtccaatcatggtacgtcataaaaaacagtataacactatgggcgtggtagataatatgcaaaatgtcaaggtaaaagaagaggaagatgaaaatattaatatgaaagggaaaaggaagcaaaataaagctgaaggtggtaagaaagcagaggagaagcaaaattcctcgaagcggaagatggataagaacaaggaggagaaagagaagagaatgagagttgttgataaaaatgatgatgagaaggagagggaggatcgaagcaaaagaaaggaaaatgagaagaaggtgaagtcacatatagaaagaaaggaggataatgataataagaaagaagaacaagggcagcgagaaattgagaaagagaaagtagaggaagaaaaggagataaannngcanannngaaggaaggaggaagaggattcaaaggaaaaggataaggaccnnaatgacaaaacaaattgccctcactt

SEQ ID NO: 100062 - DNA, 615 bp, Triticum aestivum
  unsure (1)..(615): unsure at all n locations
  Clone ID: PAT_TA_100062
aatacatatgttagtgtcaccattctattagcatgccttattctagccctcggaggaaaagaagttaagtgtataagacgagacgagaatactagcggggtccctttgaatcgaaaagtcaataatactattgtggttgatagaggagatgtatatgactgcatcgacgtgaacctacaaccagcctttagccatccactactgaaacgccataaaatccagatggaaccaagctctttcccacagagtgtttcaaccaaatccccgtcgattcatgccaggccaccagcccaattgtctttgattgagtgccctacaggaatgattccaatatttcgcaagaacagaaggatccacaagctagtacaagctattaacaaagtgattagcaagaatgaacaacaggaggttgcaggatttgagtatctagatgtgctatacggaacgcgagctaaaataaatatctatgaacctaaggtgaagaataacagtaaggatctaagtgcatcatggatacagattaaagggatacaaaaagtnnnncttgcagatgggataggtgctggttcttgggtatatcnangctacagtggtgacagccttgctnnnnntcac

SEQ ID NO: 100063 - DNA, 584 bp, Triticum aestivum
  unsure (1)..(584): unsure at all n locations
  Clone ID: PAT_TA_100063
cacaactccaccccaactccgcgcgcgcgcgagagagaggatcgagagccgccacccgggtccggcgtccgcagccggatcgccgcctctcctcccggccgaggtcgccaccactcgtctgaggcggatcgggaactcccagcccgcgaccatggcggaggctgcagggccgacgcctctcctccacggcctcccggacgagatctccatctgggagatcctcgtccgccttcccccgaaacccctcctccgctgccgcgccgtttgccgcgcctggcgccgcgccgcctccgcccgcgacttcctcctcgcccaccacgcccgccagccctccctccccctcctcttcgtcgacaccgacgaccagtcctccatagacatcatcacatgcgaccaacgcgcagccgacgagctccactccgtcgcccggcttgacgccccctccggcgtctctctcagggcctgctgtgacggcctcctcctcttacgcacctggaatannnggtgtcccatctctctccatctgcaacccggtcactcgtcaatacgctccccttcaccggcttgatgactncnnnntctng

SEQ ID NO: 100064 - DNA, 629 bp, Triticum aestivum
  unsure (1)..(629): unsure at all n locations
  Clone ID: PAT_TA_100064
ggcgtgcctctccccccgatcccctccgctcccgccgccgcgctcagcttctccctgcttgctatcatctcccgccgtcgacatccaccctctcccaatccccgccccggcgctccctccccacgccctatcgccacatcctccaatccctgtcgccagcggcggcgtgcttccggcgacaccaccggacgacggcgagaaggaatagatatcgctaggcgcagcaaaacgaatctttcctctcgccagtcttccatcttactccaagcccacctccgcaatggcagagccctgcaagattcctgctgccatggtagccgaatccgtggaaaggtcatatgtgctcaaaatagatggatactcaagagtgaaggggctactgaagaacggcaagttcgtcgcttccacccctttcagtgttggaggccacaactggaccgtgaaatattacccgaacggttgccccaagtattgtgacgatttcatatctctttatgtgcaccatgaatctgccggtgccaaagaagtgaaggcgaaattgacgctcaatgtgcttgacaagaatggtaatccggtgccttcgtacacccgtaccacccctgtgaatactttctccaagnnnnctcaac

SEQ ID NO: 100065 - DNA, 628 bp, Triticum aestivum
  unsure (1)..(628): unsure at all n locations
  Clone ID: PAT_TA_100065
gctcgatccccatacacccgagcggccgctagggttcctagccgccgccgcccctccaccgccgcgtgccaagccgtcggtgccgcttccccgccgtgacctcctcttcctacactgctcgttggacctcctcccttcccccacctcaaaacaggaacacaacaaaaatccccatcctacccatcgtcgagcggctcgttgccaccggggccgcctgtgccacgggagtactacgctggaaccgccgcagccgtcgtgaccgccgcgacctccactgccatcccacgccgcgcctcttcttctcttgtccccgatctcgaaggtgggattgtagtgggcgtagtgaagtagaggggagatctgggcgtcagagcggaggaggagcaaggtggaccaggccacacacaaagcagaggtcatcctacccgcgccaggcatacccatgtctggttgctgttgatctgacgccatagtgcacacaaggtgtttgaggctgccggtccagccatatggaagatgcgttggagatcaaggacgtggaagaaatcgtagaggcaatcctcatccgcctcccgcctggtgagcctgnnnatttcgtccgtgcatccctcgtctgcaaattnnngtg

SEQ ID NO: 100066 - DNA, 245 bp, Triticum aestivum
  unsure (1)..(245): unsure at all n locations
  Clone ID: PAT_TA_100066
ggagagagaactagatcagcgacggacgggacaagaattgcattccccccggccggccggcacggatcggagcgggaatctggcgtcgctttccgccgtccgtcctctttttctttcttgatgattgtttgtctcttttttccacctttcgtaggcgtctgcccgtccctgtgaatacggaaatagtaccagattactgccacactggtatcctaaactgtgagtgcacaagaaaaaaanaaaaa

SEQ ID NO: 100067 - DNA, 459 bp, Triticum aestivum
  unsure (1)..(459): unsure at all n locations
  Clone ID: PAT_TA_100067
ccggcttccccatgtggctgccctgggtcaagacgcgctcctcctcccccacctccgcctccacctgctcctccacggcgctcgccgccgcctcgccgcgcctctccttcaactcgccctccctcaaggatctccaggccctcctccgctccgacccggccgcgccctccccgtccccgccgcagccgccgcacacggncccgtgctccccctccgccgcccgagtcttccaccgcgtccgcatcgccgcctccgccctccgcggcgcttcgcaacctggagggcgccggccggccccgccgncgangggggaccgccgcgtcgtgctctantaaaacctccccttncaaggtcatncgggggcaaccaannaaggactggncggcggccgcgcngnggccaatctctggggcggggntccgggggcctnccgttcaangaagcgncgancttcgccat

SEQ ID NO: 100068 - DNA, 344 bp, Triticum aestivum
  unsure (1)..(344): unsure at all n locations
  Clone ID: PAT_TA_100068
gctggctttggctggcttctcccttcccctctcctctccctctcccgctcccgcctgattttactaaccgcttccgggattattagcgcgcgagacccaccgctataataacgccgctagcgactacccagtggctgcttaacacgacacgcatcgtgcttctgcctggctgttagcgcggccggctagctccgctcagctcagctagggttaagggtttgcggcgagcgcatgcgcctgggatgaatgacgccgcagcgggtcgccgggggttnatgggcggggggaaagaagnangaagccgaaggggaaggggcngcccnnggttttncnnaaccccnccc

SEQ ID NO: 100069 - DNA, 513 bp, Triticum aestivum
  unsure (1)..(513): unsure at all n locations
  Clone ID: PAT_TA_100069
gagacaattgaattcagtaaatagtctattcataactaggctcaatctcagatatactacaagcacgagtttgcaaagggtttaaaactcggctattttagaacatggtccaatggaactgtcatatgcattttatattattttaatcttccaccaatttactttgttagtagcaaaaggtatcatgggatttaatggatgatactcatcatgagagtaagagagtaaagagtaggtgtgatacataattacaagtatgtttgtaagcaagactgcatatttacaccagttttattttggtgtnaggtatcatgggatttactttccataaagtatgccaagggatatcttttcctggtggccccttttgggaattttaacaatgttatgttnaggnatatgggtaatactgataatattacatatattagggtgcttgtgcacacgttacttcctgcngnaataattggtcccacaaagttaatttggnaatgaaacntttgttgntcntca

SEQ ID NO: 100070 - DNA, 395 bp, Triticum aestivum
  unsure (1)..(395): unsure at all n locations
  Clone ID: PAT_TA_100070
ggggaaacccttgaaccctttctccccgccgtctcctcccctcccctccccaccccanccccactcccaacgcgagcggnggngatggccaaaaagctcgggaagaangcccgcaagttcgcccacaagcacctccaaggcgggcgccaagcgcaaccgcaagctccgctcccaattcaaccgccgcaaccggaaanatgggaaagggccgggaggacgacaaccnccctggacnggcgaacggcggggancnaaggaaanccncccgcaaacgaccccaacaattgaacattaaacgangatgttngcttaccttggntnaactggtttaaaagttttcaacaaagaatgaggaattganttttcatggggggtnntattcccacangntggtt

SEQ ID NO: 100071 - DNA, 534 bp, Triticum aestivum
  unsure (1)..(534): unsure at all n locations
  Clone ID: PAT_TA_100071
cctcgtgccgaattcggcacgaggttctccttctgtcccgcaaacccccgagagatcacaccatgttcggcttcggtcaccacggccaccatggncagaancccccggcccacgctccggccgccgccggcggcaaccagcccaccttcaagatcttctgcaaggctgacgagggctactgcctctccgtccgcgacggcaacgtcgtcctcgccccctccaacccccgcgacgaagcaccagcactggttcaaggacatgcgcttcagcaagccagatcaagggacgaggagggcaaccccgcctttggccatcgtcaacaaggccactggcctcgnccgtcaaagcactccgctcggccagtcccacccggtgaaagctcngtgccattcnancccggagtacttcgannaagntccgtnnatgttggacnggaganccaagcgaacgttcggcaaangggcnttccgcctgcatttcgcnatgggggaancaaanattccgcctccaaactttcgaacgccctcaaaaggg

SEQ ID NO: 100072 - DNA, 406 bp, Triticum aestivum
  unsure (1)..(406): unsure at all n locations
  Clone ID: PAT_TA_100072
ccttccatcgcgcggcgaccggcaccggcggcgactccaccaccaccaacagcagcagcaccaggccggcgaagcaacccagcccatggcgccaccgacccgcgcntcncnaaaacncaagaagccggggagggccctggggcgganggggcatntcgcgggccgaggcggcggcggcggcggacgcggcggcgatgncctcggcggcggcgcgggaatggcnccttgtggggcnantgggcgatgggcgcggtcaatgtggcgggcncaactatggcttcatccccctcgtcataaccgttcngngtgatnaaagtccnnacccaaggccctnccctgttncagctcctcgcccccgttctgatcnnttccccgccccccgttccgtccggatncgagaagatgc

SEQ ID NO: 100073 - DNA, 257 bp, Triticum aestivum
  unsure (1)..(257): unsure at all n locations
  Clone ID: PAT_TA_100073
gctccctctctggcctctctctgcgcgcaagccatggcgtccaacggtgtcggaaacagcaactctccctactctgcgtcgtcgccggatgtccgcccgtcgagcccgctcccggccaccaactcatcccctccccagtccgctcgccgcgccggnggtcgcctccgccncggccccacctcgttctcctccntcgggcggggttcgagactccgccgncaccggggccgccgcactccgttcaggtgctggcgaaa

SEQ ID NO: 100074 - DNA, 179 bp, Triticum aestivum
  unsure (1)..(179): unsure at all n locations
  Clone ID: PAT_TA_100074
gcctcgtgccgaattcggcacgaggcacaccttgtgcttaattaatttacattgcgcncagctagcganaggacctcccgcgcgctcgggtnatggtacanatanacacncaaacgtacgtgnacgctagancttantccacnancgttcaagnatatatggcatatctcntccggatg

SEQ ID NO: 100075 - DNA, 402 bp, Triticum aestivum
  unsure (1)..(402): unsure at all n locations
  Clone ID: PAT_TA_100075
gcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgncaaagaccgttgggggaggtgatgatgctttcaacaccttcttcagcgagactgggtgcntgggaaacatgtccccccgtgctgtctttgtaatctcgaacccacngtgattgatgaggggaaggactgggtgcttaacggccaagctctttcaaccctggagcnnccttatcaattgggaaaggc

SEQ ID NO: 100076 - DNA, 482 bp, Triticum aestivum
  unsure (1)..(482): unsure at all n locations
  Clone ID: PAT_TA_100076
gcacccctttgcaccataaactcttcaccagaaaaaagagcaaactgaaccctcgaaaaaaaaaanccatttgtcccanttcccccaaaaccatgaacttctccgtcggcgccggcggtagtggagacggcggaggcgagggcgggagggtgcaagcggagcggtggctggagattgcggcgaagcttctcgccgcgcgcgacatcgtcggctgcaagcgcttcgccgagcgcgcgggtggaggnngattcgcttctccccgggngccgaacgaaatccctcgccngtcgcttgacnttcntcctcgnctcccaaggtgatggctctaatnaccggaagaagcctgaacccaanttncccgttcttccaaggtncccctccnaaaaacaaacgnaccanggggggccaatttnccgggggcctttcgggcggcctttgggggttcctccttcaaaatcaangaaacccccanccccggggnt

SEQ ID NO: 100077 - DNA, 317 bp, Triticum aestivum
  unsure (1)..(317): unsure at all n locations
  Clone ID: PAT_TA_100077
ggtttttttctgttanatgtactattcaggaatagtaagggatatatatgtgagattgctgtacttctccacttagntttttttttggtaattgaaaattaaccggattgtaaattgcatttcttagtgtaatccctantggattcaggggggctttggtaanttcatcttttcagggggagtactaattgtacatgtagttttctagtgggcaagtanttcaatgttcagggggggggggggggcntnaaatggnttttccctcgttaaattgtacnattcacgaatagtcacnggataatatanggnganaatgg

SEQ ID NO: 100078 - DNA, 513 bp, Triticum aestivum
  unsure (1)..(513): unsure at all n locations
  Clone ID: PAT_TA_100078
gctagcaagcaaatggttggggttttcctcatgatttgggtgcggagtgacataagggagcatgtgaagaacttgaaggtgtcatgtgttggtagaggcttgatgggatatcttggaaataagggatcgatatcaatcagcatgtctctgcatcagacaagcttctgctttgtttgcacacacttaacatcaggtcagaaggatggcgatgaacttagaaggaatgcggacgtggtggaaatattgaagaaaaaccagattcccacatgctcatggtgcacgcgacgagaagtcnccagaggcaattcttgancatgatcgaataatatgggtccgggatntgaattaccggatagctccttcctatcgctccgtnaaggctttggtccaagatcacaactgggaaacaantgttgggaaaaaggatnaacntcntataaaancaaaagggtttgggncgggtattcccccngctgggnaaaaaaaggaaggattnanttttcaancccccgt

SEQ ID NO: 100079 - DNA, 522 bp, Triticum aestivum
  unsure (1)..(522): unsure at all n locations
  Clone ID: PAT_TA_100079
gccgccgcccctcccacccacccaagaatcctccaccataatccccggcaacccacgcccggctccgatggcccgcacgaagcagacggcgcgcaagtcgacgggcggcaaggcgccgaggaagcagctggcgaccaaggcggcgcgcaagtcggcgccggccaccggcggcgtgaagaagccgcaccgcttccgcccgggcaccgtggcgctgcgcgagatccgcaagtaccagaagagcacggagctgctcatcngcaagctccccttccaacgcctggtgcgggaaatntcgcaggacttcaaagacggacctccggtttccaaagctccccccgttgtcngcgcntgcaanggagggccgcccnanggcaataaccttgggtngggccctgtttcaaggaacancnaaatcctccngcgcccatncaacgcccaaagcncggttaancaatcantggcccaaagggacattcnagnttcgccccnccgnatnccntgggggnangncgccctaaggtc

SEQ ID NO: 100080 - DNA, 519 bp, Triticum aestivum
  unsure (1)..(519): unsure at all n locations
  Clone ID: PAT_TA_100080
gcacacacgaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccaatgcaagtgcggcaccaagctgcggctgctcctgctgcaagctgctaaattcatcatcgatcatgcatgcaccgtgccgtgcgttcatcatccatnatatcgatntactactancataccatgttaccgcnacctggattgangggcctttaatgtncgcaactgaccctgcatcaacantcaaggtgncaagncatgaatttgttaanaaggcccccctnaaatnaaaaacctcccctgatttaaaaaaaaaaaaaaaaaaa

SEQ ID NO: 100081 - DNA, 496 bp, Triticum aestivum
  unsure (1)..(496): unsure at all n locations
  Clone ID: PAT_TA_100081
ggtgatgcagcctaagtaggatgcaacttgctgcagaaccgaatagtgtaatagagttgttagtaatgtagccccccatctcttgctacgttcactttgttcctttgctgagcggatttaccgagttttttctaagcttgatctttaaatttcccaagaaagataaaatagaattgtgctagctatacaagttacctgcaaattattgtcngggctgggtttatttatcccaagttgtctacaaacatctgaaccancatcatagcataaggtcgtggatcaattaccaacaagtctgaacnatctcaagtttgntcctttttaatggtactttggnaggggttccatttaaacaaacacnaantgattccagtaaacttaagtcacttnatgaaaagtttngtnnggaaatcanncnaaaaggtcagnccaaggttatcaananggatttgtnaccttgccancctnaatnaagatntttgccctggtactggct

SEQ ID NO: 100082 - DNA, 250 bp, Triticum aestivum
  unsure (1)..(250): unsure at all n locations
  Clone ID: PAT_TA_100082
gccactcgcctccccgcgtcgccgtcgaacccactccgccgccccgtcgccggcancgcccccctcccccgatgggcaggncccgaggtcctcttcaacctgcgcaacctcttctacctcggcgcctatcactctgccatcaacaatagngacgncccngggcctcgatnccgatnccgcggtcggagcgcgacntcatcntcttccngcacctacatcgncctnggggatncctaacnaagctggggtg

SEQ ID NO: 100083 - DNA, 449 bp, Triticum aestivum
  unsure (1)..(449): unsure at all n locations
  Clone ID: PAT_TA_100083
gggaaaccctttcccccaccccgcgataggagccagacgaggcagcacgcgagaaacctcgacggcgacgcgcagattgatttcatcaccacagggacgggttgaggtgaaaaaattcatgctttactctgtcagttgagatgttgaatatgtgatgctctatcctgctcatgtgatgattgaacaattgatgtttctctctctcaattgatatgttgtgtcctgctcatgtgtagatttaataagtgcatgctttctttgtcaaatgagatgggtgaaataatgatgttgtgtgctgccaatgccaaagttcaaaattagtggttgtgtatgtgtgcattggtanctccanaatggnctcaaaatgggcttaaanttcttccattaccgnnggagcacnaaaagaagaaacatgtaaanggnctgtnttgacaacaaatgtttaattg

SEQ ID NO: 100084 - DNA, 566 bp, Triticum aestivum
  unsure (1)..(566): unsure at all n locations
  Clone ID: PAT_TA_100084
gcccaatcccccaaatctcctcagcctcccggcgcatctccgacgacatggcccgcaccaagcagacggcgaggaagtccaccggcggcaaggcgccgaggaagcagctggccaccaaggccgcccgcaagtccgccccggccaccggcggggtgaagaagccccaccgcttccgccccggcaccgtcgcgctccgggagatccgcaagtaccagaagagcaccgagctgctcatccgcaagctccccttccagcgcctcgtgagggagatcgcccaggacttcaagaccgacctccgcttccaatcctccggcgtctccgccctgcangagggccgccgaaggcctaaccttggtgggggctgttcgaggacaacaaccctctgcgccaatcacgccaagcgngttcaccatcatgcccaaaggganttcanctccgcccgccgcattccgttggncgaaaagggncttaaagtctgttaantcnntcctcctanccnagattgngcccnatcggngggaaatggtgcgtngccaatgtttcgntccttgccaaaggggggntgt

SEQ ID NO: 100085 - DNA, 428 bp, Triticum aestivum
  unsure (1)..(428): unsure at all n locations
  Clone ID: PAT_TA_100085
gcgcaccgcttcctcgtgtccgaactaagccccaatcccaccaccaccgccgctggtgctcggcgcgatggcgcagaaggacgccgccaatggcaacggcgccaccacgcgcccgccgcccactccctcccccatccgcttctccaagttcttccaggccaacatgcggatcctggtgaccggcggagctggcttcatcggctcgcacctcgtcgacaagctcatggagaaacgaggaagaacgaggtcattgttgctgacaactttttcactgggtcaaaaagacaacctgaagaagtggnttggncaacccaagatttnganctcatcgttaacnaatgttaacggaaccaactggntccgtnggggggttgaccaaaattctaaccaacctttgcttgttcctggcctcaaccaaatccttncta

SEQ ID NO: 100086 - DNA, 360 bp, Triticum aestivum
  unsure (1)..(360): unsure at all n locations
  Clone ID: PAT_TA_100086
gagagctgccgcgactcagtattcgaggaacttgngnngccaggggtctttcgcatgttcaaggtccactgccggtcaagttcccgcttccagatcccagaaacccattatctctcangccagggtctcttaatttcgactcttcaaactccgccctggtcaaaactggagagtgtttctgcaagccgatanntgggggctagagctgccgcgactcaatattctnnggaaggggaactagtgcctgccactagcaagcnagattcaaactccaggggggggcccggttacccaantncgcccctaanagtngaagtcgnattaccccgcgctcaacttggncngtcgtnttnaaangtt

SEQ ID NO: 100087 - DNA, 383 bp, Triticum aestivum
  unsure (1)..(383): unsure at all n locations
  Clone ID: PAT_TA_100087
gctcgagttttttttttttttttttgtacacaaaatcaactgaatattagtttgaacttggccattttacatgcttacgaaacatcatcctcccaacatattacattttgtttcatctatctttcaacttcgcaatattcaacctcccctgtagctttcactcgtttgcactgtattgtccgttgccattgggatgttttgccatccccgaggaccattgggangaatcattctcgcgtatttccntcanaacccagcnanggtcgcatnccaaccggaaaaaaaaatagattnatggaagattgctaaccctganaatnaatcaaccaggggggaaaatngccttttggcancgaatttttgacaagttcaaaccgaaggtt

SEQ ID NO: 100088 - DNA, 541 bp, Triticum aestivum
  unsure (1)..(541): unsure at all n locations
  Clone ID: PAT_TA_100088
gggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaaggcaanagagaagaccctctctgatcagtttgaggcgaagcgcgccaagagcaaggctagcagggagaggaagcatgccaaggagggaggagagattggctcanggccccaagagaccatgcaccagcaccagcgggtgcagctccaagctccggcagcaagcgggcaccaaaanaaggccaaggccaaanaagtgaaaggtctgacatgaaanctttagctttctgggaattatgaaagggttancctgaattttggcagcatctnaaagttcaaaancttgntttcctggtgcaatacctggtgttcccccgtctgancancacctttaaaatatcananccntgctttgntccggnngggatgnttcanaaaaatgcct

SEQ ID NO: 100089 - DNA, 598 bp, Triticum aestivum
  unsure (1)..(598): unsure at all n locations
  Clone ID: PAT_TA_100089
gctcccgtcccgtcccgtccccagccaacctcccatctccgtctcgcgtcgcggcggcagttccactccctcgccangggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacaagtgacatcaagctcaaggacgacaagactctgctctttggcgagaagccagttaccgtcttcggcgtcaggaaccctgagggagatcccgtggggtgaggctgggtgcccgattacgttgtggaagtccaccggtgtcttcactgacaaaggacaaaggnccgctgctcactttaagggtggtgccaagaaggtggtcatctctgcccaaacaaagatgcccctatgtttgggggttgggngtcaacgangacaagtncnacctcaaaacgtttaanattgtctcaaaattntnagctgnaacaactaaactggccttggctcccctaagctaaaattaattaatga

SEQ ID NO: 100090 - DNA, 465 bp, Triticum aestivum
  unsure (1)..(465): unsure at all n locations
  Clone ID: PAT_TA_100090
ctaattaccccgctattctcctcctgttttgatagaataagttcaaagaagtaaagccagtaagaagctaatgcttgtctgagcttattctcgaacatacggtaatcatacttctctatctcatgtttctctatctcatgtttctcaagtatggtcttcttttataaatgccttgtcgtccagcaacaaggggctgaatcatactcttggccatcgtttgggatagtattgtgtatagaacacaagaccgcaaccatagcggatggtacggtatgtgttgcaacgatgctatccttccgacaagatgggatcaagttgcaagttactangtttgtttgatgaaaaatcatgtcaagatttgttaatagntgtaagtcacattttttaccttactggtcccctttttgaccctcctcctcnctaaataagagaaaatgttaagtngtccaanaacaatggcgttat

SEQ ID NO: 100091 - DNA, 555 bp, Triticum aestivum
  unsure (1)..(555): unsure at all n locations
  Clone ID: PAT_TA_100091
gctcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgaaatggccgggggggaagaccggcggctgcgaacttgcaccaacttgcaagttgcggcaacccgtgcgggttgctccctgctgcancttgcaacttgagcccggngcanaaagaaggcccggccgggcaaaanggcgaancaacaangattnanggagggagaaagcaaagcaantcatcnatcaaccaaccaaccaancaanccaagcgttatcaantancaattaacccnccgcaatgccgctccccgccgcgccgcctnaaatnaaaataaaaaccgtccaanggnttccttaatttctgttacnaacaantgtccccncccccaaaggcc

SEQ ID NO: 100092 - DNA, 591 bp, Triticum aestivum
  unsure (1)..(591): unsure at all n locations
  Clone ID: PAT_TA_100092
gaaccagccaagccactgggtcaatatttttgtggttacatattattattttgttagttgttcttttgnattccannaaggatagtaatgcctaaacgtgttagcagttccatccattcatacttgacccttacaaacatgagtttttgaaaaatgttcttgtgcatgtgggagatgcaggagtttgcttgaaccgagcgcagcagcttgtaagtggtggcaagactagatgatgatgcataagtgcacggatgtgtgtatttcttcacttcttgcaatcaaggtgtagcctggtactgtagaggatataaaataatctatgggattatgggaaagtcatgtgaatggggttatgggggtaatattggctgctataataataaggtccctccgggggcacataaattgaagactgtccctgacccaantctngggtaaccgttcctgcgattttcctttggtggaagttnccccnagaacctagagccaatcccgggtttaattccaaaacccngtggagncccnantttgaaaaaaagttcaattaatgaatttgcanngtngttttcaaaatanggatgcaaccaaacc

SEQ ID NO: 100093 - DNA, 528 bp, Triticum aestivum
  unsure (1)..(528): unsure at all n locations
  Clone ID: PAT_TA_100093
ggactctggatacgacatgctctaggagttgcgtccctattctagcttcttcagcttgccggcgtccccgtagtcttggctccggcagtcccggatatgcgcttctctccagatcttggcccgtccgcgttgccggccaccttgcgtcgctgtcgcattcccctccgcccggtcgcccaaccccgttcacctctacgcctcgctccctctactgccagatctgtggcttgctctcctagtgacgtccggtgttggnttccgcggcggacgttgctcccctcnctgtgattggcggcctcgacctgtgtctcgacttcctcctccccgaagttctacccaaggggcatgggattgcccanatttatggccaagggcgaaaatcctttgctccggntttgccgggntactggggaagcgggngaacacccnatgggggtggccgnttccctttttttgggagggnggtttgccaatggntccaanattcntttgnccctgtntcnagtcaancaattgggtaaaatcctc

SEQ ID NO: 100094 - DNA, 647 bp, Triticum aestivum
  unsure (1)..(647): unsure at all n locations
  Clone ID: PAT_TA_100094
ggtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcaagcacccctgggaggaacaagctcgatcaatatcaagatcctcaagtacccgcttaccactggagtctgcaatgaaagaagatcgaggacaacaacacactcntcttcatccgtccgaacctgaaagggcngacaaagaaagaaagattaagggccgctgtcaaagaaaaatgttcgaacattcaaggccaaagnaagggttaacaaccctcatcaaaggccttgattggcaaanaaagaaaggncgtacnttgaaanctggacaaccaagacttncgatncctccttgattgtnggccaacaaagatncggaatcatantaagtcaaaaagggaangggncctgcaattaagggnccntggtgtccgtggggttccttngtttattgggnaattttgnnagcttnttaccttaacaaaagggggcncaattgggncccaattgcccnacat

SEQ ID NO: 100095 - DNA, 514 bp, Triticum aestivum
  unsure (1)..(514): unsure at all n locations
  Clone ID: PAT_TA_100095
ggttattgtgatgctgattgggctagctgtctggatgacaggagatcaacttcaggctattgtgtctttgnaggaggaaatctagtatcttggagaagcaagaaacaacctgctgtttccaaatcaactgcagaggctgaatacagagccatgtccaagggactgagtgagatgtggaccacaaatctattggcagaattgaagatattttagacaggttgtatgaatgtgtggtgtgataacaaatcagcaatcaacatagcacacaatccaagtgcaacatnatanaaccaancatgtgggaaatagacaagattcttcatcaaaagaaaagcttcacgctggggatcatcaanaattgagcatnttangttctggggnaacaanatttgcaanacngttttganctaaaaaggaattggggaaactaaaagaatgncaatnctagcnttggtggcaaagatggggaatgntaaaataacctatnaccccctccttgaaggggggagtgttt

SEQ ID NO: 100096 - DNA, 613 bp, Triticum aestivum
  unsure (1)..(613): unsure at all n locations
  Clone ID: PAT_TA_100096
ggctctctctccccgacagctctcgctgtctccgaccccgaccgctcgccctctcgtcggccagtcgctcgccggnnagtcgccaccctctccctctcgtcggtgtcttcctcaccgcagtcttgcacctcaccacccataaccctagcaagcccgcctccctctcgtcggtgaaaggtgacatttttaccaagttggggtgctcgattcgtgggcggcggtgctccgatccgtggggcggnggtactcgattccgtgcttggagcaacggggaagaaggangccaaggttggaagaatcgntggtgccgggaagggggaagctccgggcgagacgggcggcttggatctgaaaacgagggctgctccaaccttcctcaagggtggggngggggaatctcccgaactccgctggnaaanggaanaaagggccccgaaccgnctgggngtcaatcccggccggctttccttcaaagggtttgggngggcggncnggccttgccttnccgggcgggangggcgggnacnttccaaaggntgcttgcaaggttgggggggnaatgcaactaacncgggacngggccngaagcnaacgccgtngcnaaggaanttta

SEQ ID NO: 100097 - DNA, 330 bp, Triticum aestivum
  unsure (1)..(330): unsure at all n locations
  Clone ID: PAT_TA_100097
cacacacacacgaacgcattttcattcatttctcaagccatgcagcagcgcgcgcaccgatccggtgacnatgatgatggnggtgancanggcccagctgccgcaancgcgcgccctggcggncctcctcntcctgngtgctgatcacgctgggcggcgcggccgaggcacanccgccgctcggnacctgcggcgcgcagntganccagctggcnccgtgcgcncnctntagcgtgccgccgcctgcngggggcaggcgctccccggtncnccgggnccggacttctgctcccnccgctngngtccggtgttccgnganctgcngccttg

SEQ ID NO: 100098 - DNA, 409 bp, Triticum aestivum
  unsure (1)..(409): unsure at all n locations
  Clone ID: PAT_TA_100098
gcgagctttttttttttttttttttttttanacgaccggcttttaatcgtgcaaccaccggtggcactagncagagccagagaccacttaattagcttagccagtcccctaaaacacgcggcaaagcagcgccagaaaaaggaaagaaaaacagtgcagaacacacctagttgttaaccaaaattagaagccatttggcatggtacacttgtcagacagcagtcactgcctgctactagtaaccactatcaagagctgangaacgatcaatanaccanaggaccacgggtgaccaaccgccctgaaaactccatatggnacctgccggccctccactttcgccncggggcaaaacanatgggaaaacatcngaaattcctccatcatccctttggggcttgctcagagg

SEQ ID NO: 100099 - DNA, 660 bp, Triticum aestivum
  unsure (1)..(660): unsure at all n locations
  Clone ID: PAT_TA_100099
gcatccccgccgccgcctcctctcggttccttctccttcctcggagcttcagccatgggtaaagagaagactcacatcancatcgtggtcattggccatgtcgactctggcaagtcgaccaccactggccatctgatctacaagcttggaggtattgacaagcgtgtgatcgaagaggttcgagaaggaagccgccgagatgaacaagaggtctttcaagtacgcctgggtgcttgacaagctgaagggccgancgtgagaaggggtatcaccatttgatattgccctgtgggnagtttcgagaacaaccaangtnctnactgcacccgttcattgatggctcctgggtcaaacggttgaactttaattaaaggaacatgattnactnggttacctcccaaaggctgaactggtgcctggtgcctcaatcaattggcctccaaccaanctgggtggggttttttgagggnctggggtaatctcccaaanggatnggccaaaaaccccgntgnagcaatggccttcctttnnttttcantcccttgggggtngaaaccaaaatgcatcctgntngcttttaacaaagnttgngacgcncacccanctccccaaatttncaaaaggccctttncaaggnaaattnncaaaggaatttccttt

SEQ ID NO: 100100 - DNA, 261 bp, Triticum aestivum
  unsure (1)..(261): unsure at all n locations
  Clone ID: PAT_TA_100100
ctccgatctcaccacctcaaaggcggaaagggagcgtctcccaccattctttangcgccaagcaaagcgggagtaaccctagggncagctnngcctccggatccgggcaccttccgcgcggcagatgtcgtcgcngaccgccgcnccggcgccgactangcccncggcgccgcnggntaacnccaccgcgccngccccggccancccgtcggtgcctcccccggcgntcccctcccnctcnccgcnggcctnggntaaccc

SEQ ID NO: 100101 - DNA, 509 bp, Triticum aestivum
  unsure (1)..(509): unsure at all n locations
  Clone ID: PAT_TA_100101
gcccaatcccccaaatctcctcagcctcccggcgcatctccgacgacatggcccgcaccaagcatacggngaggaagtcnaccggcggcaaggcgccgaggaagcagctggccaccaaggccgcccgcaagtccgccccggccaccggcggggtgaagaagccccaccgcttccgccccggcaccgtcgcgctccgggagatccgcaagtaccagaagagcaccgagctgctcatccgcatgctccccttccaagcgcctcgtgagggagatcgcccaaggacttcaaagaccganctccgcttccaagtcctcccgccgtctccnccctgcangangcccccgangcctaccttggtggggctgttctangacaccancctctgcngccatccacgccaatcgcgntaaccaacatgccnaaaggacatccaanctccgnccggccggcatcngttggnnaaganggccntaagctcctggttaggtcgncntcntaacccaagatgt

SEQ ID NO: 100102 - DNA, 505 bp, Triticum aestivum
  unsure (1)..(505): unsure at all n locations
  Clone ID: PAT_TA_100102
gatcagaggagacctctctgccaccagaactgtgagacaaaaaaggagagcanggggtgctggtgcgtgtgcggcatataagaaatgggagagagctgccatggntggtgtttctttagttgctgatgcagctgaggagcttgaacacaaaatgacgacccagaacttgtcgtgtaatgcggatgcaactgtgctaagcttcatcacccaacaacgtatctactgttgatgatgcgggcacaaatcatatgaaagaaagcaagatccgcaagcaccttcaaagctgaagctgcagttatttccaataaatgaagccacacggaaagnattggggaagggtgatcataatccacatctggggctcacattaaagttccaagaaaaaaatgtcttcctggttttaaaaaaatctggaatccnaagttgggggnaaaccncaaacaattngcatnttgggagaagnttggggccntttcccanaaattggggcncaacanaagagggg

SEQ ID NO: 100103 - DNA, 367 bp, Triticum aestivum
  unsure (1)..(367): unsure at all n locations
  Clone ID: PAT_TA_100103
gttttttttttttttttttttttttcaactgatgtgcggacgacagancttctcgtacatggtcatgtnganaattngncactaccaccgacntggaacacatggactaataataaagcttccggagcctacctatgtacaacaaaaaccgcgacgcgcagatgacttggtgcaantaangcacctttctaagtactacatgatacgatactggnggctggatanttgggggtcagaattcataagcttcctccctcctatagcagggtttacncgcngggcgtcaanattgtcatgatnntctnccggncgtacatgtnaggnnaactggttttcctctgttttgtccctgcgaagggaaccccaa

SEQ ID NO: 100104 - DNA, 314 bp, Triticum aestivum
  unsure (1)..(314): unsure at all n locations
  Clone ID: PAT_TA_100104
gctaggagaggtgcacggtgaggcatcgacgtatgctttttgtcatggtgttctcatatccaaacttgaatcaagtatgctttttgaatggcttgcactaaagcagagtataattcttatacttgtgttttaaattgactacatgttgtcgtctcctcttgtatacatcttccctaactacccattttgtgatgggttgttaagctaccattcaagggaatgcatgttgacaaatgtattgatgaaaaaaaaaaaaaaaaaaaaaaaaaaaaaaaaaaaaaaaaaaaaaaaaaaaaaaacaanngggggggnan

SEQ ID NO: 100105 - DNA, 505 bp, Triticum aestivum
  unsure (1)..(505): unsure at all n locations
  Clone ID: PAT_TA_100105
ggagcatttcaagaaacatacatcttgttaatctacaccggcgacaggcgcatgagctttccgatccatggnaacacnagtcaacagggtaccgcgaatgattcatcanactgaggaaatttagtctggcatcaaattttatatggtctgatgctcaagacaccaatggaattgttcaaatcttacccagtggtgatcattgtaggctccatttgttancaaaatacgctaattagtgcgtgctcatacaccaaaggaacagttcaagtcttgtcgcctgctcagtcaatcggngagttacantaaaagcnactaaatggtctagccttgcgctcagtttacgttttgaacanggcanaaantnggctttttacaattncatnnttttggaaaanggcttccncctttccaantcttatcccgtnaaactnaaaattgggnggaaaantncncatcctcnccnanaattccnatngtgcaggtttccaanttaatccanntttaa

SEQ ID NO: 100106 - DNA, 436 bp, Triticum aestivum
  unsure (1)..(436): unsure at all n locations
  Clone ID: PAT_TA_100106
gctctcanctccttcccagctccacggtttccagcaagcaagccgaagcactagatcctcgatggctcgcgtggcactggtcgncgtgttcgccgtgctcgcggcactggcggtggcggagatggcgtccggggcggtgacctgcggcgacgtgacgtccgccatctcagctccttcccagctccacggtttccagcaagcaagccgaagcactagatcctcgatggctcgcgtggcactggtcgccgtgttcgcccgtgctcgcggcactggcggtggnggaaatngcgtccggggcggtgacctgcggggancntgacgtccgccgtcgcgccgtgcattgtcctacgcnacggggaaggnggtcggcaccctcggggtgccgtncntcaacnggngtgagggnccccnnaaacccnaangtgtncaaccccgg

SEQ ID NO: 100107 - DNA, 575 bp, Triticum aestivum
  unsure (1)..(575): unsure at all n locations
  Clone ID: PAT_TA_100107
ggctctcagccctcctcccccgcgtcgtcctccctgggcgactcgggggcgataccttagccactgcttctagnnggcacctcgngctcacccctccccccgccgccgtcggcggccgtcgccgggcctggcccgtgtggtggtaggcggcggcggggcctgcccttgcaccatcttggctggcttggccccgtctctccttggtcgccgcctgtgccaactttgatccccctgctgcgggcactgctcgcccacgactccggccccgtggcggttccccgtcnggcgcncctggagccgctnccnccttgccggatntggcgctggngngtgggtctggtngcggaagggccgcccgatctgggttgcctgngctntgggacggggggtttaagggcccttgancttgctgaaggccttgcnncaatcccgcccccgaattcnaccggaacccntggtgcnnctcgaaaggntggtttggctttncaattccggngccggattttatccgggtggggggacgtttttaaaaccaacttttgcntccgggntantttaagggtgggctgtggaaa

SEQ ID NO: 100108 - DNA, 383 bp, Triticum aestivum
  unsure (1)..(383): unsure at all n locations
  Clone ID: PAT_TA_100108
ggttcactgccactgcctccgcccgtctgacgactcgcgacggccggacctgccggcggccggccaacggcgaggcgccgccgccgccgccgcaaggtatccgtccatcccgccccgtcctctccaccaccgccacgccgtcctgacgatcctccgcctcgcaccgcagcgccgccggaatgcctccagggaagaagggaacggggagcgcgccgccgccggttgcgcggcggcggaccgcaatcggggccgctcccgggacccaatcttgcaagaacgttcccctcctttctccccgggcgcaaggcgggccttgcgggacttgccttgctgggcccggggcttggggcaactnctggggattcaacaaggggcctgcnctt

SEQ ID NO: 100109 - DNA, 460 bp, Triticum aestivum
  unsure (1)..(460): unsure at all n locations
  Clone ID: PAT_TA_100109
gcggaaccaacgaatccccagccaatctcgtctccgatcgaccccaggctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccaagcagcgccttatctttgctggcaagcagctggaggatggccgcacccttgctgactacaacatccaagaagggagtccaccctccaacttgtcctgcgggtgcggtgggtgggcatgcaagatcttccgtcaaagancctcaactgggcaaagaacatcaaccctttgaagggttgaggaagctcccgaacaccaattngacaaacgtcaanggcaaagatncaaagaacaagggaggggaattccctccggggaccaag

SEQ ID NO: 100110 - DNA, 402 bp, Triticum aestivum
  unsure (1)..(402): unsure at all n locations
  Clone ID: PAT_TA_100110
nggtttcctgctacggttttggtccttcggtttcggcggngcaagatgggggatagggtcaagggaaccntgaagtggntcangggncaccaaggggttcggcttcatctccccggaggacggcanngangacctcttcntccaccangtcctccatcaanntccgacggctaccgcancctcaaacnataacgacaccgntcnaagttcnaggtcatcaccggcnacgacggtcncaccaaggcctccgacctcaccgcaccaggaggagnaaccnctctcnngcgtgntcccgcccctgggcggattgncggtgngttgaccnctggcnggcngccgnccnggtacacgngnggnggttnggctanccagccggttggncctttgcnngtctctgagcct

SEQ ID NO: 100111 - DNA, 203 bp, Triticum aestivum
  unsure (1)..(203): unsure at all n locations
  Clone ID: PAT_TA_100111
gcgcaaactcgttgcacaagaattcctcccacccccaccgtctcgccgccgccaccacagctagataagaaaaaanggngagaggngnnctcgttgggagtgctcnagatctgtgtcnggagaaggggaaattcttganatcgggaatccggaacaagccgggcacnctcgggatttggggttaccaaanaattttttcccaa

SEQ ID NO: 100112 - DNA, 516 bp, Triticum aestivum
  unsure (1)..(516): unsure at all n locations
  Clone ID: PAT_TA_100112
gcaggtcaattttgcggatgctgatgagcaaccacgacctcgtccaggcaggcacaagaggatgctcatttcngtccagggnttgatgcgaaagagggtaacctgctcctgcttacgatgatggaaccgagtatctgagacggcttctgtcaggttgattctagaaggaattggaacgatgctacattttttggttgatcaaacaggcttctgtactttgagatatcctcattcttattatgcatgtatntacatttcaaggaaataaaanagcaagancaacatntnacccgtntcatantaaaaaanaacaattggccaaataatatganatgtnaattnngtgnagatgccatttttgcncnagtaacnaaaaaccccaatncgtancngttntttttcanttttttaaaaaaaagggttgnaattggggttnnttgaatttgntggggataaatccctgncngntttttgccactanacaantttttaaangaaattgnntttctngccccc

SEQ ID NO: 100113 - DNA, 508 bp, Triticum aestivum
  unsure (1)..(508): unsure at all n locations
  Clone ID: PAT_TA_100113
ttctccctgccgccgccgcactatctcccacctcgggatcctccccaaatccaaaaattcccctcgagttcccaaccagatncaactcctcnttccctgtngctcctcctttgctttctcctcgaacccgtagcagcaacggagcaggagccctcgcgcccgagcctcaccgaccctgcaggctgcgccctccggcgaccccgtcgccggcgatcacggcgaggaccggccttgtcccgctcctcccctccctatctcttttcctccccgtgcttctctctcacaagattccctctcacaaggaatgatgccatggggctcccttttcccccggactccctcacctcctctctcctcttcaaggaactccaacgaatgtncccgcaagaacccagccaatgggancccgntgggattgccggccctnctgcaaacaacngttgncaaannaccggttgggccaaangtngtnccgggngaatggntcaaaaacctngccccngggccc

SEQ ID NO: 100114 - DNA, 648 bp, Triticum aestivum
  unsure (1)..(648): unsure at all n locations
  Clone ID: PAT_TA_100114
gactccacctccaccacccccatccatccatccatcagagaagangagagagagacagagagagaggagccatggccaaggaggtgagcgaggagccggagcacgccgcgccggcgcacaaggactactccgacccgccgccggcgccgctcttcgacatgggggagctccggatgtggtccttctaccgggccatcatcgccgagttcgtcgccacgctgctcttcctctacatcaccgtcgccaccgtcatcggctacaaggtgcaatcggcggccgacccgtgcggcggcgtcggcgtgctcggcatcgcctgggccttcggngggatgatnttcgtnctcgtctactgcaacgccggcatctcgggcgggcaaatcaaaccgggcgtcaacttcggggctcctcctgggcgngcaangtgtcccctgctaancccgggggatttaaatcctngcgcaattgcgccgggcnggaattcttgggcgcccgnaatcgtccaangggnnatcaattaaaggncgcnnttccaaggcnaannggggggggggggccnaaaantnggngggcttcgggggtttntccccggngggaacccnncctgggggggggngaantttttggnaacnttgtgggtcgnntaaaacc

SEQ ID NO: 100115 - DNA, 376 bp, Triticum aestivum
  unsure (1)..(376): unsure at all n locations
  Clone ID: PAT_TA_100115
gcacacccaatctcgtctccgatcgactcgagagctcgtcgaatcctcctcccccatcgtctcaagatgcanatcttcgtgaagacnctcactggcaagaccatcactctggaggttgagagctctgacaccattgacaatgttaaggctaagatccaggacaaggagggcattcccccggaccagcagcgcctgatctttgctggcaagcagctggaggacggccgcaccctggccgactacaacatccaagaaagagtccaaccttcacctggtgctccgcctccgtgggggtatgcaaatttttgtgaagaccctcaacggcaaagaacatcactctggagggttgagagctnttgacaacattgaacaattt

SEQ ID NO: 100116 - DNA, 639 bp, Triticum aestivum
  unsure (1)..(639): unsure at all n locations
  Clone ID: PAT_TA_100116
gcgttcttcttcttcgagttgggtagtttacctctacccaccagccatgggtaaggagaagactcacatcaacatcgtggnnantggccatgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgaacgtgagagangtatcaccatcnatattgctctctggaagttcganaccaccaagtactactgcaccgtcattgatgcccctgggcnccgtgacttcaacaagaacatgattaccggtacctcccaagctgactgtggtgttctcaanaancaacccancaatggggggtttnagggngngggatccccaaaggnagggcaaaanacntnagcaaacccncccttggtttnanaccctggggtgaaacaaaattattntgctgctgcaaaaanattgggnnccacaacnccccaattttcaaaagggggngtttntaaaaaaantttnnaaggnggggtccttccnaccctaanaaagggngggntnaaaccnctaaaanggttccttttcccccc

SEQ ID NO: 100117 - DNA, 628 bp, Triticum aestivum
  unsure (1)..(628): unsure at all n locations
  Clone ID: PAT_TA_100117
gggtctttcaagtacgcctgggtgcttgacaagctgaaggccgagcgtgagaggggtatcaccattgatattgccctgtggaagttcgagaccaccaagtactactgcaccgtcattgatgctcctggtcaccgtgacttcatcaagaacatgattactggtacctcccaggctgactgtgctgtgctcatcattgactccaccactggtggttttgaggctggtatctccaaggatggccaagacccgtgagcatgccctccttgctttcactcttggagtgaagcaaatgatctgctgctgtaacaagatggacgccaacactcccaaagttctcaaaagggccgttacgangaaattgtcaaaggaanccncttcntacctgaaagaaaggccggtaaaaaccctgaanagggtccccttgttcccaanctctnggtttgnaggggaanaaaatattgaaaagnncaacaaacctgactggtaaaaaggcctancccttcttgnaggtcctgaccaaatnaacgngccaananggccccnaaaaaacccctgggttttcccctnaaggagttaaaaaattgtggnatnggaacgtntcctttngccctttttnaaagnggtnatn

SEQ ID NO: 100118 - DNA, 584 bp, Triticum aestivum
  unsure (1)..(584): unsure at all n locations
  Clone ID: PAT_TA_100118
gacagcagccgcagcccgcagcgcggcggggacagcaactcgaccccatctccggcaccgggagggcgacggtctccctggaccgatggcagcacanaacgaacggcactggcagccaccgtcgtcgtggtcagccctcccgctggaactggcaggcctggtgctccgcttgctccccgcatacgccgaccgcgcccggttcgcngcggtgtgcccacagtggcgtgccgcagccaggcagaagctgatgccccctccactgccgctgctcgcgctccctgacggnaccttctacagcctcccctatgacgaagctcttccaattccccggntgcggcttcgctgggtacaaagagcncctggcggcaactggctttgtctttccgcacgaacgatggggtgcttcctttgtcaaaccgttctccaaggntacccgtgaacctccctggctcctctnaaagtgttccggcctacggggccccnaaaanncaattnccctnaattnggnanatttntgggaaaaggnnaattttgcccaaaaccctntggnaaattggnttgcaaaaccaanggcccnaccccga

SEQ ID NO: 100119 - DNA, 221 bp, Triticum aestivum
  unsure (1)..(221): unsure at all n locations
  Clone ID: PAT_TA_100119
gcctcntgccgaattcngcacnagggtttcctgctagggttttggtcctttgttttcggcggcgcaagatgggggagagggggngngggaaccgtgaantnnttcaacgtcaccaacgggttcngcttcatctccccggncgacngcggtangaccttttcntccaccagtcctccatcaantccgacggntancgcagcctcaacgacatctactccgtt

SEQ ID NO: 100120 - DNA, 571 bp, Triticum aestivum
  unsure (1)..(571): unsure at all n locations
  Clone ID: PAT_TA_100120
gcttcccancgaaaacaccaccgcacatctccccggccaagtagcagcagcggcatccatggcccccaangcggngaagangccggtggcggagaaggccgaaaagaccacggcggcgaataagaccaaggccganaagcgaccgccggcgtccaaggagggcggcgagaagaaggggaagaanaagtccaagaagagcgtggagacgtncaagatctacatcntcanggtgcttaagcangtgcacccgggacatcggnatctcctccaagggcatgtccatcaatgaatctcctttatcaatggacatcntccanaaagctcccccgggcgaagtccgcccaaggctcgccccgcctacaaacaatgaagcccaaccaatcacgtncaatnggagattccaataagttctgttcngccctntgccctnccccggggggaggntnnccccaagnaacccccttctcccggagggnancaaaggccntcnccaaatttaacccccctccccanantggggcnngttccctgnncacggggggnctggtttcaatgcccncccnnttaatta

SEQ ID NO: 100121 - DNA, 529 bp, Triticum aestivum
  unsure (1)..(529): unsure at all n locations
  Clone ID: PAT_TA_100121
gccaaaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaaccgcgtgatccccgacttcatgtgccagggcggngacttcaacaagggcaacgggaccgggggngagtccaactaagggcgaagaaatttcccnaccaaaaatttcgtccaaaaacanancaaagcccgggattctctccattggncaaagcggggccccaaaancaaagggtnccaatttttcaancngaaccggtcccctgnaatttggtccaaccggaaacaccttgtccttccgcgaagtcnccnanggcaatggacttcttcaa

SEQ ID NO: 100122 - DNA, 360 bp, Triticum aestivum
  unsure (1)..(360): unsure at all n locations
  Clone ID: PAT_TA_100122
gagagagagagagagagagagagagagagagagagagagagagagagagagagagagagagagagagagagagagagagagagagagcnacctccnngngaaacaccaccgcaccccacaatcccangggtctccccggcgaagtatcagcggcatccatggcccccaaggcggagaanaanccggtggcgganaangccgagaagacgacggcagccaagaanaacaagggccgagaancggncgccggcntccaatgagggcggngaaaanaaggggaanaataagtccaanaatgagcgtggngaccttacaagatttacntcttnaaggtgctgaancangttgcacccgggacat

SEQ ID NO: 100123 - DNA, 614 bp, Triticum aestivum
  unsure (1)..(614): unsure at all n locations
  Clone ID: PAT_TA_100123
ggttcgattagtattgggctgtgtcaacctgacgactttgagacttttccgagttgaggtcaaaagaaagtttggtcgccangttgaancattctttgtgttactaactgctatccacntttcatgctttgttctactcaacccggnctcttccaaatatcttagcattanctttagtcaacttggcatactctttctggttcaagggaaattacctatgcacattacaggcactgattattgcanctgttgtttttaaatgtgatatgattccacttcttggtacgaaaagggttgcacttttgctnaccaagtccttttctctaaaggaacccgtaaaatgtttcanaaacactgcccttttaangattggtntcaagggtacaaagtttgncncgaataatgtgggcaanaanaaatcctggtggncaagnaattttgaaattttcctggggttaaatcanttcctgnnccccaaantcaananggggggngtanccccttaaagccnttggttttggggaacccggcagtttattttttganaaaaaaaaaaaatgtttcnatatcccttcttttaaanngggntccccnaatcctttcccngcaacttt

SEQ ID NO: 100124 - DNA, 186 bp, Triticum aestivum
  unsure (1)..(186): unsure at all n locations
  Clone ID: PAT_TA_100124
ggagagagagagagagaactagtcacgtgtttttcctcctgtttgcttttctatacgcctactgatcaacacggngcgatttgatgatggaccgtatagtttagtgggtttggctgatttagtctgaacatttgtcagtaaacctgaaaattctaggtgcacgtcacagtaaaaaaaaaaaaaaaa

SEQ ID NO: 100125 - DNA, 604 bp, Triticum aestivum
  unsure (1)..(604): unsure at all n locations
  Clone ID: PAT_TA_100125
gaaggcgtcttcgtactcgcctctctccgcgcaaccgagccttccgcccacctcctccccatttcgccagcggcgcacccaccanccacccccacccgccgccatgagggagtgcatctcgatccacatcggccaggccggcatccaggtcgggaacgcgtgctgggagctgtactgcctcgagcatggcattcagcctgatggccagatgcccggtgacaagaccgttgggggaggtgatgatgctttcaacaccttcttcaacgagactggggctgggaagcacgtcccccgtgctgtcttcgtagatctcgaagcccactgtgatttgatgaggtnagggactgggcgctttaccgccagctcttccaaccccgagcaactttaattaagtggcaaagggagggatgcaagcccaacnaannttcgccccggtggtcatttacancaattggcaangggggaattggttgatttggtgcccttgaccggtatcaaggaaacctttaanacaaattgcaactgggtctccaagggaattcccttgtcttcaatgctngttggngggngaaactngactctgggcccttggtttctctcctgc

SEQ ID NO: 100126 - DNA, 375 bp, Triticum aestivum
  unsure (1)..(375): unsure at all n locations
  Clone ID: PAT_TA_100126
gcaagagcatcacctgcaagcaatggacgtctcaggcaccggagctggcgccaagggcaagaagggcgcggccgggcgcaaggccggcggccccaggaagaagtcggtgacgcgctccgtcaaggccgggctccagttccccgtcggccgcatcgggcgctacctcaagaagggccgctacgcccaacgcgtcggcaacggcgcccccgtctaactcgccgccgtcctcgagtacctcnccgccganctgctggagctccccggaaacgccgccaaagacaacaagaaaaaccgcatcatcccgcgccaactgctgctcnctgtcaagaaanaanaagagctcngaaanctgctgggcggngtcaacaacgcgca

SEQ ID NO: 100127 - DNA, 674 bp, Triticum aestivum
  unsure (1)..(674): unsure at all n locations
  Clone ID: PAT_TA_100127
gaatccctcgctagccctacctcctctcccgtctccagtcgcagccgccgccgccaccgcaccccaatccaacccngccgccggngatctcctcgcccccctgtgccgtcgcccccaaccttctattcctctcccaagggaagggaagggaaggcaagacaagggaagggagagggagcgcccagatccacggcggcatcagcgcgccgtcctccacctgatccgcgtccatccacanatgggaacctaatcggcgcaaggaaatccccgtccccgcgttcgagccccgncaacctccgcaaacggnttnaacgcccaancacgccgctggcccccgcgggngccgaacaatttgggtctccccggngggtggaacgccgcccttngtgtttgnccgaacgccgggcttcnctgnngccgcaactggnccctcaaaaagcgtctttctngtcaaatgatnggacttnaanaaaggtcaaaggaattttccaaattgggaagatttgggaaaaagncncctccaatctcctnccgggngggacgaanaatcaaanaatngccannttcnaggcaccttnttgggnctngaaanaaaaaaaatnggaaatntaaaaaannaaaanaattgcaattnttttatnttccgaanaaaaggggtnntccgaaaatgnatt

SEQ ID NO: 100128 - DNA, 666 bp, Triticum aestivum
  unsure (1)..(666): unsure at all n locations
  Clone ID: PAT_TA_100128
ggccagcctcgcctccaagggaagggaaaggagaggagtggtggagcggcatctctccgtgctgccatgcaagtgcacgctcangtttcttgcaggtgttccttccgcgcggccagtgagtactctactggtgagtgangaatgagtgggtgagtgaatgggaactcangcaatgccgtccggtggggccatctcgcgccanggctcgctctgcaacctcacgctgagcgacgtccaagggcaactgcacggggtcaaactccanaaactcctccgcacggncggntcgggcaaagaagacnggtgaccaagtgtngcgggaaatccacngngccnaacggggggaacaancnnccccgggcccaaattaacgcttgangacntccctgtccaaagccccggttggggaacccgggggggcccccaaatggggccgancaattanaatccccccgggccccggtggccggggnaaacaacgccaanaaanaaangtttgggcgttccccttcccccnggccnctggggggtgggcccccgggcccgtttntggacccctttttcaacaacnncaacaacnangggggcaacaatnttccgggcaaaaaaccttccccccttggcgggccccgggaaaaaaaagggnggancggcnggaaaaaacng

SEQ ID NO: 100129 - DNA, 633 bp, Triticum aestivum
  unsure (1)..(633): unsure at all n locations
  Clone ID: PAT_TA_100129
gccagcctcctcactcctcacagcatcctctcagtccttagcttccttccctcgccaccacccacagccaaggaggatgtcttgcngcggcggcaactgcgggtgcggcgccggctgcaagtgcggcaacggctgcggcgggtgcaagatgttccccgacgtggaggncaccgccggcgcggccgccatggtcatgcccaccgcctcccacaaggggagctccggcgggttcgagatggccggcggggagaccggcggctgcgactgcaccacctgcaagtgcggcaccgcgtgcggctgctcctgctgcagctgcaactgagccggngcacaggangccggccggnaagaggcnaagcaccangatnatgagganaagcaagcaatcatcatcaacaacaaccaccacncagncgtatnaagtaccactannccgccccaatgcgctncgccncggncngctaaaataaaattaaaaccggtcanngtncttccttantttctgttangaacannggtccctcctcaatgccttccaactttctaatgaaatatatggccgcctcnaacnttnggaaaaaaaaaaaaaaaaaangggggggccngggtnncaaattcccccntatngtgagt

SEQ ID NO: 100130 - DNA, 395 bp, Triticum aestivum
  unsure (1)..(395): unsure at all n locations
  Clone ID: PAT_TA_100130
gcttctcctccccttccggttcgggttctggttcggttcgggtccgagagtanctagcctagtctagggtttccgtagntcggngaggagagaaagggagagatccatggcggagacggagtaccgctgcttcgtgggcggcctcgcctgggccaccgacgaccacaacctccagcaggccttcagccagtacggngagatcctcgacgccaagatcatcaacnaccgcgagacggngcaggtcccggtggnttcggcttcntcacgttcggcagngaggagtcgatttcgccagnccatccagganattaacngnaangaattcgacgggtcgcaaacatcaccgtcaacgaagcccaatcccgccggtncnngtgtttggnggcnggcngcgg

SEQ ID NO: 100131 - DNA, 478 bp, Triticum aestivum
  unsure (1)..(478): unsure at all n locations
  Clone ID: PAT_TA_100131
gcaatctcattttcatctcatttcatcccatccacgccaacggacggacggacccatctcttccccaatttcgtcgtcgncgtcggcttcttcttcttatttcttcttctttccgtgtccgtccaccattgctgcttatttctttctttatttgtttcttgtcatcaatctacatatcctatctattatcttcttcttcttcttcttcttcttaacactgattgacaatgtggcttgggatctccaactccatncaaagcaacaaggaccaaggagcactggttcgtcattgcttgggcctctttaaccataatccaatatcccatgttgaattgctgcctnctgggccgncaacccaaccaattcnacaacgnaanggggggngnctcnaagggcgggaggggggggaagaacaannccccaaagcnaancggcgccnnggtaaccnctgggtgnaacncccctacgngggcaatcc

SEQ ID NO: 100132 - DNA, 641 bp, Triticum aestivum
  unsure (1)..(641): unsure at all n locations
  Clone ID: PAT_TA_100132
gatgaagtgaagctcatggatgcaaaaggagctgagaggtacaagtttcacaatatgaatactggtgcagaagaatttcataagttgctgattgcctgtggggcttcattgacatatgcaactaaagaatgggtgaacaatcactataaatggatcatatggaaacttgcttcacttgagagatgctatccaactaaagctgctggcaaattcttgacagttgctaatgttttagacgagctgaagtacaggtatgacagagaagtgaacaatggccatcgatcagccataaagaaaattttagaaggaaatgctttgccatctttgatgatggtgctgtgcatttcaagctatttattcccatcctgatgtacataaagttagangctgtcgggacaagatgaaaatgaaaacaagtatcaacaaataaaancntgttagctgctaaaagaaacatgcctgcacacaattgaantaactgatggatggtatgcacctacaaagcctccattagacntnggaacnttcaagancaacttncangaaaaagaaagncttttatagggacaaaaaggcttcnggntatgggggaccttctttgtgttggttggncctgggcccgtttcaattcantgnaggng

SEQ ID NO: 100133 - DNA, 539 bp, Triticum aestivum
  unsure (1)..(539): unsure at all n locations
  Clone ID: PAT_TA_100133
ggcattccgaacaagcaccgccgctgacgcatctcgagtagtttccaagttcgccggagaaggagcaagatggccggaaggaagggcggcgacaggaagaaggcggtgacccgctccgtaaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagcttgcaggcaacgctgccaaggacaacaagaagacgcgcatcatcccgcgccanctgctgctcgccgtccgcaacgaacaaganctcngcanggtgctcnctggcgtgaccatcncccaaggtggngtgatncccaanattaantctgtgtgctccccaaaaaatncccccaacccaaaaagggggcaaatcccccaaaaaaaaaggcgccaacaaatccccaaaaaaaaaggcnccccaacaaangggtaagggncccaaaaacccaanttcataatccanga

SEQ ID NO: 100134 - DNA, 169 bp, Triticum aestivum
  unsure (1)..(169): unsure at all n locations
  Clone ID: PAT_TA_100134
ggagattcatggcgccccggtggttccctatccgcttgattagctagggtgtggtgaggcgtccggcgttcgccctccggctgcttcgctcccgtccggccgnccaccctctccngcccccccctcnctaaaaancttnaggcattgacaancgtttcatcaaaaggtt

SEQ ID NO: 100135 - DNA, 491 bp, Triticum aestivum
  unsure (1)..(491): unsure at all n locations
  Clone ID: PAT_TA_100135
ggaggtcgaggcgccgccgcctccggggaggtccccatcgaagcgctggtcatgccggctgtggtgagtccctgccccgcgcgcgcaccaacgaggtgagccgtcgatggctctgctccgggcgactccgctcccgcctccggggaggtccccatcgacgacgctgctcacctccggtgcggccgggcgtcctcgccgcgttcaataatggcgtcacggaaggttgcggccctgcggtgcgtcacgtatgacgggtccttcgcattccaaacctcctcgtcatccangttgggatngcaacaaggcaaggaaagttcgtccatctggttccggaaagngggcgaacttaagtaacttgaaccaatanggccctcaatcgcaaagaatttcccggaacttaacaacgggggggnagttccggnntcacncaattaaccaattatttaactaataacccntttttntgcctaattaatcctttcaatngagaa

SEQ ID NO: 100136 - DNA, 595 bp, Triticum aestivum
  unsure (1)..(595): unsure at all n locations
  Clone ID: PAT_TA_100136
gctgggatggcaggacggtgaggagggggtgaggaacgtgacggtggacagggcggtgctcacgggccacgaccancggcctgcggatcaagacgtgggcgatgcccaactccggctccgtcacaaacgtctccttctcacggatcaccatgaaccgcgtggccaaccccatcctcgtcgaccaagaactactgcccccgcaaggtcgactgcccaggcaatagctcgggggtggcaagatnaagcaacatatcatacacgggacatcgaaggcacatccggcgaaccccgttgcaagtgaaattcaaacttgcaancaacaacaaacccctgcaagcggggattaaagctcaacgaacaattaaaggctngcgttacaaacacaaancggcccggcgcaaggccaaagttgccggaaaatgcccggcngggtccaacntccggaaaaggtcaaaaaccgcccnaacctgcnttctgaacaatttggagttttggcccttcccggaccggaaaaagccncnaacaaccctcccttaattttgaangggtttctgttaaaaaatttttgctaantccaaatcccnctttaaacttt

SEQ ID NO: 100137 - DNA, 533 bp, Triticum aestivum
  unsure (1)..(533): unsure at all n locations
  Clone ID: PAT_TA_100137
gagngctcctccctccccaacctaccggcgcatctccgacgacatggcccgcaccaagcanacggcgaggaagtccagnggcggnagggcgccgaggaagcagctggccaccaaggccgcccgcaagtccgccccggccaccggcggggtcaagaagccccaccgcttccgccccggcaccgtcgcgctccgggagatccgcaagtaccagaagagcaccgagctgctcatccgcaagctccccttccaacgcctcgtccgcgagattgcccaggacttcaagaccgacctccggcttccagtcctccgccgtctccgcgctgcaggagggccgccggagggctaacctcgtccngcctctttcgaggaaaccaancctctgcgcccatccangccnaagcgcggtcaccatcatgcccaanggaaattcaantcgncccgccngcaatccggtggcgaanaggggcctnanggctctnttnttcnaatccaatngcggtccgtctggttaaattcggttngtnaaggaaatt

SEQ ID NO: 100138 - DNA, 191 bp, Triticum aestivum
  unsure (1)..(191): unsure at all n locations
  Clone ID: PAT_TA_100138
ggagaactagtctcgagttttttttttttttttttcatcttttacccttattattacatgagcattggatgccgtgngtgggnggnatccaatccanccaaagggcacaacacttgacaggaaaannaaatctacacagatcgcacgcatgcgcatgcgcacatttgtccacaaatcaatcccacaaataa

SEQ ID NO: 100139 - DNA, 523 bp, Triticum aestivum
  unsure (1)..(523): unsure at all n locations
  Clone ID: PAT_TA_100139
ggcaccctcttccgtcgccgtcgattcgaacctcccccaaatcagcagcagtcgaccggaggcgccgccatggcccgtaccangcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaagaggcggccganggnntaccccgtccggctgttccaaggaaacaaactgtgcgccaatccaangncaaagcgcgttaacatcaaggccaaaggacatccaactcnncccgncggaatccgttggnnanaggggctaaactgtcctcnccgtnnaacnacggttagtgggttc

SEQ ID NO: 100140 - DNA, 641 bp, Triticum aestivum
  unsure (1)..(641): unsure at all n locations
  Clone ID: PAT_TA_100140
gcctttctccttctgtcccgcaaacccccgagagatcacaccatgttcggcttcggtcaccacggccaccatggccagnaccccccggcccacgctccggccgccgccggcggcaaccagcccaacttcaagatcttctgcaaggctgacgagggctactgcctctccgtccgcgacggcaacgtcgtcctcgccccctccaacccccgcgacgagcaccagcactggttcaaggacatgcgcttcagcaagccagatcaaggacgaggagggcaacccccgcctttgccatcgtcaacaagggcactggcctccgcccgtcaaagcactccgctcggccagtnccacccggtgaangctcgtgccattcaacccggagtacctccacgaagtcccgtnatgttggacgggagaacaatcgacttncggaaaggggnttccggcntgcattcccantggnggaacaaacatncggccttcnaantttngaacccccttcaaccggggaaaaanggaccaaaggggggggtgtangaacnggaaccaacgnnttttcctctggggagttgggncanagggggaanaaccnaagnctgggaagattcnccccctgggggggaannaaggccnacccccggggg

SEQ ID NO: 100141 - DNA, 463 bp, Triticum aestivum
  unsure (1)..(463): unsure at all n locations
  Clone ID: PAT_TA_100141
atcttggccatagaaaaagctcgcgcgcgtgctgactccttggcaccgtcaagccgtccaccaccaccacgcacaaccttcnncaatccgcgcggccatgagcttcgaccccctcccccttccccacccagtgaatggcgatgttacatacacgccgcttttttgctggaaccagctacacagagagctacaaccagcaccgcgggggagctggaaccagccgttccagagcagcgacggcacatgccgtttgctggaaccggcatttcggggagctgcaaccaagctttgcggntaagctgcaacctgcaagactgctagcaccggggtggccgccattttttgggaagtgattgtttttgctacaacctaagtccaaattttggcnccaccntcttcgattttatgctatcaacgtcttttgtttttgccaacaacccaatttttcnaatttttttgctgg

SEQ ID NO: 100142 - DNA, 375 bp, Triticum aestivum
  unsure (1)..(375): unsure at all n locations
  Clone ID: PAT_TA_100142
ggccagcgccactcgcaccacagtcatccactcacaagctaagctagcggcgcagtagctcacttcagtccagtcggcanggnggctccgaggggcgcggcagtggtgctggcgatggtgctcgcggccatggtggtggcgccgccggcgacggtgcacgcggccatatcctgctccacggtgtacagcacgctgatgccgtgcctgcagtacgtnnagcagggcggttccccggcccggggctgctgcaccggcatccaaaatctgctggncggagggcaacaaanancccccgaccgcccgcactatntgcgggntgcctcaagaacgtcnccaacnggcgccttcggnnggggccctaaaatnaaccggcgt

SEQ ID NO: 100143 - DNA, 496 bp, Triticum aestivum
  unsure (1)..(496): unsure at all n locations
  Clone ID: PAT_TA_100143
ggagagaactagtctcgagttttttttttttttttttttagtaacagaaaacttgcttccnttattccttcctcnaganattanaacttgacgaaaattgctgaacttaacaagactantaatatcnactgcaaaatattattacattaaagttgcagcaccagactgttccgttagagctgcaagtagtcttgggatcggngggacatcaatctcccgtaggccctcgagaaactggacacttcacccancactgggcggntcaaactcattatcgttggntgccaccanccatggnaantttggcaaaaccctttttaagccctcntccaaaanttgnaacncaaccantgntaactgggggattcaaccaaaactccttttanaatctccngcnggtgaaagccttgnctgntgggtttncccaaggggaaaattattccaaacnatggctggggccaaaatngctgnccgcnnaattgggggntaatngtgg

SEQ ID NO: 100144 - DNA, 341 bp, Triticum aestivum
  unsure (1)..(341): unsure at all n locations
  Clone ID: PAT_TA_100144
ttttttttttttggatccaaatgatacaataattatcataaattagttgtttgcgtcaatattctttcatgaaacatacnccctccggncnggaattattgtcngagaaatggatgtatcnanacatattttacttctacatacatccatctttgtccatttcctcaacaagtatttccanatggnaggtanaaaatactttncanctttgcaactcaaaanctanttagcccacgacaccnatggntctcangcttgattcatctgaacattgcatccaaactcccatgccctgttataaaaataataattnanccccatacatcacaagctngctccta

SEQ ID NO: 100145 - DNA, 634 bp, Triticum aestivum
  unsure (1)..(634): unsure at all n locations
  Clone ID: PAT_TA_100145
ggcagctcgaaccaaggagagaccgtcagccatgtccgggcgcggcaagggaggcaaggggctcggcaagggcggcgccangcgccaccggaaggtgctgcgcgacaacatccagggcatcaccaagccggcgatccggaggctcgctcggaggggcggcgtcaagcgcatctccggcctcatctacgaggagacccgcggcgtgctgaagatcttcctcgagaacgtcatccgcgacgccgtcacctacaccgagcatgcccgccgcaagaccgtcaccgccatggacgtcgtctacgccctcaagcgccanggccgcaccctctacgggttcggcggctangctcgtcctcaactccgttgcaaaatttccgatgttcctatccccctgtngcgccgttngtctcccctgtccaanaaaacntanctgnaatttnntttcccaagnttnactcccctgtttccctcntaaggattaactgtttcctnaaaaaaaactgttcncatccgnaanttggatncaatcntggnntcaaccccaaaaaaaaaaaaaaaaatccnaggggggggcccgtacccaaatccccccaaagnnattcttttncncccccnaanggccntcttttaaancntt

SEQ ID NO: 100146 - DNA, 660 bp, Triticum aestivum
  unsure (1)..(660): unsure at all n locations
  Clone ID: PAT_TA_100146
ggcggtgcaggtggtgctcatgggcttcatcgagggctaccgtgttggtggcgggcccctcggcaagggcgtgtggttcaaggncggcgcccatatcttctccgangggcggactcgactacctgggcaaccccaacctggtgcacgcgcagagcatcctcgccatctgggcggtgcaggtggtgctcatgggcttcatcnagggctaccgtgttggtggcgggcccctcggcgaggggcctcnacatcatctacccgggcggcgccttcgacccacttggcctcgcccgacgaccccgacaccgccgccgagctcaaggtgaaggagctcaagaacggncgcctcgccatgttctcatgttcggcttcttcgttcaaggcatcgtcaaccggggaaaggggccagttngagaaactncttcnanccaccntcnccggaacccggtcnaacaaaaaacgccctngggcctttcgccaacaaacttctncccccgggnaagcntaaattntgtttaancccgtccggtccgtccgttcccgtncannccggacngaaaatatgcaatgtngtncttntaccgtcctgnggattnaaccgtntnaccttanannaaccttnggggggtnaatttngnacccangattcaaaccaanccgntg

SEQ ID NO: 100147 - DNA, 590 bp, Triticum aestivum
  unsure (1)..(590): unsure at all n locations
  Clone ID: PAT_TA_100147
gcacgagggaaaaagtcccccgcgtcgctccgcaggggcggctcgggcggagaccaagccgcgacttccgccgccccctcccctcctcccctcctccgccgccgccggcacgcgtcgccgggcaaagccccggtggtggctggcggcggcgggccctcgctcctgcacgcggcggttggtcttgtgcgtgacctcggtggtgcgtgcgcagcggcgtcgcgcgcggcgccgtgctccggcggcgctccggcttgtgcagcggcctcttggtcgtccggtgctcggcggttggtcgtcacgtggccctgtgcccccctggttgctgggtgggccggcgtcgggcgcccctgcgcggcgcgggtggtggatctgggcggttgcgctccccgggctcgtcccggtgtgtgccgtcgtcttggcgaggccgcggcgtgcggggccggatccggcaggcccctgcccggatctgttgggtggcgctagttttcctgctccctcgacggcagatcggattttctctaacttggcgtacgcgtactctcggcgtgggngnngctctnnnnngnnnctgnnnatgcctnnngnnnncn

SEQ ID NO: 100148 - DNA, 619 bp, Triticum aestivum
  unsure (1)..(619): unsure at all n locations
  Clone ID: PAT_TA_100148
gcacgaggccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggnnnnnactgtatgannncntggac

SEQ ID NO: 100149 - DNA, 638 bp, Triticum aestivum
  unsure (1)..(638): unsure at all n locations
  Clone ID: PAT_TA_100149
gcacgaggcagccccctccccactccccctccctggatccgattcagcagactcgccacctgttttcgcccccgcagtcttctcctggggttttgccttgcccccacagcccacactcttcccatttctcgcgtctcctctggccaccaccaggagcaaagcccgagccgcaacgcctctcgatccacgaatctccccagcggatctgctggttccggaagggtttggagcgcgccggagcctggaggcgtctcggcgtgcgcgtaaggttgggccgtcgagctgtttcggtaggggagggggaggcgcatgaggattcgcgagctgggggacggcgacgggaggccggtggagggggaggagcnnnaggacgcctgggcgggcggcggcggcggcgaggtcgtgcggctgagggccaagcgcgcgctcgtcggcgccggcgccagggtgctcttctaccccacgcttctctacaacgtcctgcgcaaccaattcganncggagttccggtggtgggaccgcgtcgacnnntgtattttgctnnnngctgttcctttccctnnngatgttccacgtctgaagcacttggagttcnnnnngntntnnnattgaangnncnnnatgnnnctcnnnnnccn

SEQ ID NO: 100150 - DNA, 548 bp, Triticum aestivum
  unsure (1)..(548): unsure at all n locations
  Clone ID: PAT_TA_100150
gcacgaggggcaggagtcccggggctgtacggggagcagcgtaccgcgtacgtacgcgcgccccaccggctggctacacggcacgggccaccgccgcgcgcgagggaggaggacagggtgtcagcgcggccgggcgggcggccgggcccctttcctttctttctggtgcgggccttgaatgcgtcgtcctggctgctgatatccacccgcccgccctcccggactcctcggccgatcagattcggttctgttactcgagctcgccgcggaaagaggggaggggataagagggaggaggttgggacctgaacctgccagcaagccaggcattctgatccggattcggctccctcaacctcccggccgcctcgnnnaaggaaggatacttgagaaggccaggctgccgcgggttcttcagcaagattcnnngatctgtttgatactgaacagacccttgacctcnnngtgcatcacccatcttttttacaacttgcggcaagaatttggcagcaaatgggtcgaggaatcgctgcgattcctggcctnnn

SEQ ID NO: 100151 - DNA, 633 bp, Triticum aestivum
  unsure (1)..(633): unsure at all n locations
  Clone ID: PAT_TA_100151
gcacgagggcgagcgccgcccctcgagggcctctcccgccaccataagcaggtgcacgcccacctcctccgccgcggccaccccttcccgccggcagagcacgccgaacctgaccgcgcctacctctccgttctgcgcgccgccaccgcgacgccagtcctcgcgctcgccgcttgcgcgtgcctccgccgcgccggcctgccagcgccgggccgccacgcgctccctgccctgctccgcgccgccgcccgcgcgcgctgcgccgactctgtggggcaagcgcatgccatcgccgtgcgggtcggggccgaagatgatgggttcatcgggaccgcgctggttggcgcgtacgcggcgtgccggcgcgtggccgacgcccgcaagatgttcgaagtaatgccggatcgggatctcgtcgcctggggcgtcatgcttgacagttattgtcagactcaagactacagagaagcattgcttctactcaataagctgaagagatcaagaattgtgcctgaccaagtcatccttgctaccgttctatcagcttgtggtcatacacgacatttaagatccggaaaagtcatccactcatacatactggtctcagncattnnnatcgatgcccgcctcnnn

SEQ ID NO: 100152 - DNA, 618 bp, Triticum aestivum
  unsure (1)..(618): unsure at all n locations
  Clone ID: PAT_TA_100152
gcacgaggcttcttcaatcccaatctctgcccgccctcgccgtcgccatcccctctccgccccctcccacgcgcgcgcgccgcggcaccgccccccgcctccgccgcacgcgcgcgcgcgcgcccccgacccccgcccgcagccggacgcgccggattccgccgccgccggacgccgccggagccggatcggccctccgcgcgcggcgctgcaacaggtctgctttccgggttggcaccatcattatgttcttgtcgagcaatgtgtagcagttgccgctcgcaagactcgatcgcccgttcccgcactggtgtactaggcgatggcaaaactcccgatagttggtcgcagtgtgcatagtagcaggaaacccaacgagagcatgaggcttgtcgtcgtgaccatcatcggggtggtctttggtttcttcatcgggatctccttcccaacagtcagcataacaaagcttcacttcccttctagcattgtttcntacatagnnnacaagaactctggactcacagctcnnnntatactgaaccatgcctggatttctgctagaaacgcannngnaaatacttctgaatctagtnnnnncactaccatgaagnnntatgt

SEQ ID NO: 100153 - DNA, 556 bp, Triticum aestivum
  unsure (1)..(556): unsure at all n locations
  Clone ID: PAT_TA_100153
gcacgaggaattgacaagtcaagtacaaatgagcggttccaggagccctcaacatcagatagcaacaagagtttcccaagtatagctgcctcccagtcgtcggatgttaaacagccagcctcaagcagttcagatgctcgaactgctgagccttcatttgtccggaaaggtgtgatcggcaatgaagtcccaaatagcaaccccaagtctggtcaagttgccaagatgccctccaagccacaccagtcttcattaccatcggatcaacagttcaagcattcagttaataataatcaggatcgtctggccagggttacccaaagggctggaactgtgaatgaatggcaacgtcggtcaggatatcccgggaggagctctggttccaacaagaaatatggcactggtagggtgaagcagatctatgttgccaaatcgtcatcaaaaagtagccaggccccatcaagctaagngcagatattctttcggcccaattttctgtgcatgaganncatgttttatttggtaatnatagcctgnncccnnnnnnnnnnnnnnn

SEQ ID NO: 100154 - DNA, 536 bp, Triticum aestivum
  unsure (1)..(536): unsure at all n locations
  Clone ID: PAT_TA_100154
gcacgaggccaccacagccccactctcagagagcacggacgccggacacgcacgagtcttcttgaagcaatggcgaccaccgcgatggcgctctccccctcgtccttcgccgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggacaccgcggggctgtcggccgaccccgagaccttcgccaagaaccgggagctggaggtgatccactgccggtgggccatgctgggcgcgctcggctgcgtcttccccgagctgctcgcccgcaacggcgtcaagttcggcgaggccgtgtggttcaaggccggctcccagntcttcagcgnnnnnnnnntcgactacctcgggcaccccagcctggnnnacgcgca

SEQ ID NO: 100155 - DNA, 610 bp, Triticum aestivum
  unsure (1)..(610): unsure at all n locations
  Clone ID: PAT_TA_100155
gcacgaggatgaaagcctcatttctttactggatgtagtaagctaggtcgcggatgctcttgatcccttgtattttctcaccactacgtatgtctttgatgtaaaatgtaagtttttaaagagagaaagtttattagttatttcttgccgatgtataactttgtcaacgtccatgtttttccatgttctaacctctgtcttttcacaataacagaagtatgtctcagagattaagatagtaagctgaactgctgaagtatcagctatttcttgtctgcagataaaaatttcgccatgcatggcttgttcttcgaaattccaacccctatgtcttctcgatgctctagcactaaatcatgcaccttgctagttctgtatttccccccttctgtttaacccttatctttcttatagtggatcttaactgatgagttcatgaatgaccatgatgtaacatgcgcatttgcttgcattcatgcagtgattgtttccaagatggccagtgatgaggattcactagatgatcaaaaccctagatcttggaccgttagcaacactagtgttgtgagttaatgctacctttactttcagaannnaaagaatgtaccat

SEQ ID NO: 100156 - DNA, 316 bp, Triticum aestivum
  unsure (1)..(316): unsure at all n locations
  Clone ID: PAT_TA_100156
cccaaaacccnnncaaacctttttatttaaaacccctttccgggaaaatcccctccatccctaaatcataaagggcctttggggtttaaacctgtccatgatggctggaaagtcaaaaagtcaaacccatttcccaactaaaaaatcgttccctacccgggggggggggaaaccaacaccttccatttttgggggaacaccctgaaaacaaaaaagtggcttttggcggaaaaatcgggccaacccccccaaaaatgtaatttttttgcccagtcttacataaaaacctggctncgaaaacggggatgcaaaaccn

SEQ ID NO: 100157 - DNA, 359 bp, Triticum aestivum
  unsure (1)..(359): unsure at all n locations
  Clone ID: PAT_TA_100157
gcacgaggcaccacccaacaccatatagttactcccctctccccccctccccaggagcttgctagctggaatagcagcaacatcagctcgccaccaccgcaaatccaccgccgccgacgcatccccgtcctccgccgccgacgcagcagcagcagcagatagagcagctagagcagaggaggcgctccgccatgggtgcgccggcgtacggcgccgtgctcctcttcgccctcgcgctggccgcgggcgccgccgccgctgagaccgcgcggccggaggaacccacattgcccgccgctgctggcggtggtggcgacnngnnnnnnnnnggcnnnnnnnnnnnnnnncaannngtgcgg

SEQ ID NO: 100158 - DNA, 297 bp, Triticum aestivum
  unsure (1)..(297): unsure at all n locations
  Clone ID: PAT_TA_100158
gcacgagggcggaaggggtggtggttggccatcagtgcggctgcggctgcaggaaggggcatgtgcagtgcgcctgcaatcaatcagccagctttcgatcaagttttcttcttcacgtgactcagggatacccagtagtagagtattgtgcatgaggtattcaattgtttgttaccgctcgtgacaacctttttgtaccacacaacttgtgttgcnnntgtggccaacatttgtagcctggtttcccgaaggataataataagtaaacaaccccaacatttgtccaaaaaaaaaaaa

SEQ ID NO: 100159 - DNA, 602 bp, Triticum aestivum
  unsure (1)..(602): unsure at all n locations
  Clone ID: PAT_TA_100159
gcacgaggggcaaaggagacaaaatggcatgtgcaccgcctaagaaatgttattgaaaccaaccagtagttgaatgattagaatagtggcggtcccatccatatgtgagtgcatgtgtgtattgatggtgtgcatacactattatccatatttctttaaacttttatcaagacatagaacaatttttataatttgcctttttcttaattcaaatacaaacacatcatagaaatctagagctcgtgtcgctattctcattccctagccggctggttctccatagggagtactaatgcacactttctaatatctcaatgtttcaatcttctagacatgagacttccaaaagaaagttttttttttaccattatcacttatttatctggtagagtatgccaatttttttcagaattatgacataatttttaaacacataatggtattattttcattatgaataatgcatttatacatcaaagccatacaagtttgaattctcacacatcaagcatgacatgacccctaaaatgatgtgtgtctgggcatcttttaccatgttgtgacccctannngaatcaaacagatgttatgcttattttgac

SEQ ID NO: 100160 - DNA, 629 bp, Triticum aestivum
  unsure (1)..(629): unsure at all n locations
  Clone ID: PAT_TA_100160
gcacgaggggcggatctacctacagctgccgccgtcgccgtgccgattctaccttagcctcaatccaacctctcggcggcgcgcaccgccgccggcgaaacaatcgccgccgccatcgccgttcccctttcttcctcggccgccggccgccgggacatccagctgccccgtccagtgtttggccattgggtctccttccatacttccttcctctgagcctgaggtcggacatacatctagatccgccgcccctgtatttgtattaccatggagactgtacatgaatcatggcggtggcacgacggctactgcttgcacggttccatctgggagtaacaggacctaatcgcctccgggttccaattcgtgttctagtcggacctcctccgccctcccttccagtaaagacggcagctttgcctcatgacatccacggttcagagcttattattatcgtccatggagcagaataataagccacaagacgaagataggctgggtgccctgactgacgacatcctgctctccatcttgnnnagtgtggaccttgcgacggccgcanngaccngcgctctgtcgacgcgctgnnnnagcctgccatggctgctccccgannttaaccccatgtt

SEQ ID NO: 100161 - DNA, 620 bp, Triticum aestivum
  unsure (1)..(620): unsure at all n locations
  Clone ID: PAT_TA_100161
gcacgaggctccccgtgcccctccgtccactccccacgaccaccacctcctaccccgccgccgcacaacctccttccccacgccgccccgcctcctcctcctcacggccggtgtcgccgcctcctcctcctcccagccggagccgccctgcctcctactcctcctgtctggtgccgccccgcatctcccccgcgcgcctctgacccgcagcgccgcccagcgacggccccggcccgccccgctccagccatggccactgccccgccatgcgctcgccggcgtcaacggccccttccctgccgcgcgatgcctcccgaccccgtccacagcctcggccccgccctaggaggcccagcccccatggcctcggctccgccccgtgacgccgtccgacgcccccgcccccaaccaagcccgacggcgctcccgcggacctccgccaaccccgcccccatgcatcctagcaagattcctccgtcgccctcctactccacttcccttccctacctctcnnntcgtgcgacccttcccatcgtcggggtcaattttcgaggccgtggacaccacacgcatcggcaaccagcgagattccagtgcagttcggttcgatgtgcaccact

SEQ ID NO: 100162 - DNA, 600 bp, Triticum aestivum
  unsure (1)..(600): unsure at all n locations
  Clone ID: PAT_TA_100162
gcacgaggatccagtcagtgaagtcaccacacaccacacaatgcttccgaccacggcgaccgcctcaacgcccccgccgccaccggccgagccgcctggcgagccgcacgccgccctcttcctcgccctgggctacatgcggctgcccgagctgctagcctgctggcgcgtatgccgcctcctcggcgaggccgtcgcgggggaccccctcctgtggcgtcgcctcgcggtagagccgccgctcagtggccgggtgaccgaccaagtcctcctcaagttgactgcgagggcggaggggacgctgcggtctctccgcctgttcgggtgcctccacgtttccgacgccggcctgctccgcgtcgtcgagcacaatccccgcgtcaccgagatttatgttcctggatgtaaaggcttgactggtgatggggtggtgaacattgttcagcttctgcacgaacacaagggaaatataagtcgtctccgactcgatggcattagcaggatgagtaagcatcatcttgatattatcatgtctctcatgtgcaaangaaacccacaagggcaacaagatggaatcccacttttctacaaccatagagn

SEQ ID NO: 100163 - DNA, 631 bp, Triticum aestivum
  unsure (1)..(631): unsure at all n locations
  Clone ID: PAT_TA_100163
gcacgagggttccgtctacatcacaagcggtcttccgattgtgtcgagtgcatcacaaaggcgcaggaggaaaaaggaagaatcagccaaaatctgacaagatgcaaaggcacatatcaagtgtgggcatacgtcaagctgtcgcttgagaccgccatcatgctctgctgcaaagttttgtatctcttcatgatcactgtcctcaccgacattgtccaggatgcgcagattgattgtcaactcgcttggcatctggtacttagtggcttacttttactacttaaataatactgaattttggtcatgttgcttctgttttatcctgttggcgacagattggattgtttattttatctgaaagcattattattccccctcatcagttggatggcttttaagacgtgctgatctctcctttcttctaactgactagctgatctctcttttcttctaactgactagctgatcttcatttggagtggaattgttcgttagtgcagctagctagcatatattggataatatggatcggccctgtactcttggttgttaatttagctaccaaatttgttttatatagaagtttacaaagctgcatgccatcaagnnngtagnnnnttaacacgcatgc

SEQ ID NO: 100164 - DNA, 576 bp, Triticum aestivum
  unsure (1)..(576): unsure at all n locations
  Clone ID: PAT_TA_100164
cagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaacnnng

SEQ ID NO: 100165 - DNA, 621 bp, Triticum aestivum
  unsure (1)..(621): unsure at all n locations
  Clone ID: PAT_TA_100165
gcacgaggagcccattctccccgccgcgcccctctccccttctctaccgcagccgcagacccgtgcccgcctccctgccccccgccgtcgtctccttcgccgccgggagctcagcccgggttgctgccgcggagttcctggcgggcttcctcctcggcctactcacgctcacggaggccgaggcggccgcaccgcctctatcgccggcaggagggggccccggcagccgccgcgctccgtgccgacccgtgcttccgcacggcctgcctcggcgccgccatcgactgctacatcgatgcgagcacgcaccctcccaatccccttcttcgtggtcgacggctcgatccgtggaatcccagtcgattgattgattggttgattggctcactccccgccagccatcctccctgcccgccgccgccgccatcctgtcacaccaccaccaccatcctccccgttcgtcgccgccacgccatcgccgccacctacccgacgacgctgtggaggaggcgaccagagagggatggcgtcgccggcctgtgtgcgtgccttcgcgggttcccgtcgtggccgccggagccgtgggtcaaccacgtcgggnnnngatcgccgccacgtcgn

SEQ ID NO: 100166 - DNA, 611 bp, Triticum aestivum
  Clone ID: PAT_TA_100166
gcacgaggcacaaaaacactgtctgcggggttaggattgggaaaggcacctgaggagagggagatgaaccctgataggaaaacaacacttgaattgtcagttcgcgcttacgcagagacaaaatctgggccagtcatcaatccaacaattggcacatcttttgactcgttggatgaagcatatgagttctacaacctctattcatgggaatatggtttcggcgcgaggcttgcgaaaagcagactgaatgttaatcggaagagatgtatgcaagaaatactgtatgcttgtgcgggcaaaccaatgagggaaaacagtcgatcatcaaggtgcgggtgtgaagccatgattagattcctccgttcaaatgacaacggttggtacatatcagagttcaaatcaggccataaccaccctcgatcatcaaggtgcgggtgtaaagccatgattagattgctccgttcaaatgacaacggttggtacatatcagagttcaaatctggccataaccaccctcgatcatcaaggtgcgggtgtgaagccatgattagattgctccgttcaaatgacaacggttggtactccgcacgccgccggccaagaatcaacct

SEQ ID NO: 100167 - DNA, 611 bp, Triticum aestivum
  unsure (1)..(611): unsure at all n locations
  Clone ID: PAT_TA_100167
gcacgaggcacaaagcaatggaggcgcatatgcgatccatgacggccacctttctcctcgtgctcctctccctgtccgcagccgctccgtcagttcgtggccaggcggtggcggccgcgccggctccagcggcggctgccccgaagacgatcaaggcggtgctgaccaaggccgggcagttcaccaagttcctccagctgctgcagtcgacgcaggaggaggagcagatcgacacccagctcaagggcaaggcctcatccggcgccggtctcaccgtcttcgcgccgccggacaacgccttcaccgcgctcaagtccggctccctcaattccctctccgaccaacaaaagacgtcgctggtgcagttccacgtggtctcccagctgctccccatggcgcagttcgacacggtgagcaacccgctgcgcacgcnnnccggcgacaccggcaggggcaagtacccgctcaacgtcacgtccgacggcggcgggagggtgaacatctccaccggcgtcgtcaacgcctccgtcgacggcacgctctacaccggcgacaggctnnntggtgtaccnnntggacannntgctgcttccgtgggcgctctannngcc

SEQ ID NO: 100168 - DNA, 553 bp, Triticum aestivum
  unsure (1)..(553): unsure at all n locations
  Clone ID: PAT_TA_100168
aacaccctgcatgcgttcgtttcttaattcaggtgataaaacagtacaatcgttagtaaacagagacaacttcctgatgcttaacaaatgtaacgactctgtgctagcaatgctttgtctcaacaaattgaacgaataaatcactactacgggtctcggttagtctattctaacagctggtatctatcactatcagtaaccaccaattttatacaaagatcccaaatacacttatgctggactcgaaaatggcgcgaaccatgggccctctccatctatcgtcatgagatcctgcaagccttcccacagctggtcgccggccccgtccgcagccagctgccattgtcccggcgtcctctggccggcgtccgtgctgcacggggacggcgtggtcaaagtctcgttctgcggcgccgcgccagcannaccatcaccgccattgccgctcccgtgcacacgcatnggctcgtcggagcacgggaagttgagcctggcgcgcgggccgcggaactnnagcgcnnnnnngtcgtannnccgcgcgnnntccnnnnnn

SEQ ID NO: 100169 - DNA, 590 bp, Triticum aestivum
  unsure (1)..(590): unsure at all n locations
  Clone ID: PAT_TA_100169
gcacgaggcggcgcctccacttctctgctccctcgtctcctctcgcgcagggcccggcgaaagggaagcaagatgtacaccgccaggaagaagatccagaaggacaagggcgtcgagccctccgagttcgaggacaccgtcgcgcaggctttctttgacctggagaacggcaaccaggagcttaagagcgacctcaaggacctgtacatcaacactgcaatccagatggatgttgttgggaacaggaaggccgtggtgatccatgtgccataccgtctgcgcaagcccttcaggaagatccatgtcaggctcgtcagggagctcgagaagaagtttagcggcaaggatgttgtctttgttgcaacaagaaggatcgtgaggccacccaagaagggttctgctgttcagcgccctcgcaccaggaccctgacagctgttcatgatggtatcttggaggatgttgtgtacccagctgagattgtggggaagcgtgtcnnnnaccgtttggatggtgccaaggtcatcaagatctacttggacccgannnagcgcaacaacactgagtacaagctggagaccttctctgcagt

SEQ ID NO: 100170 - DNA, 629 bp, Triticum aestivum
  unsure (1)..(629): unsure at all n locations
  Clone ID: PAT_TA_100170
gcacgaggctcgatttttgtttcgatctgctctccggcggcagcggcctttcccgagcttggcgagccggagctggcccttcccgtcgtcaaccacctcctcgccggctggccgtcgtagaccacgaagccggtccccgccagttccttcacctcgccgccaacctcgtccatctcgctcccccgcgcacctccctggagtcggcagaagttctccactttcctccgtcggcagcagcaaccatccccgccttcgccgcccagcaaccagcactgcccgcgacgacagagaaaagttgcagttgcagcagtacgggcctggagatttggtgactgtcttgctgttcggtgatgcagcagaacacttgcagttgcttgggtggcctggccctttcagttgcaacttgcaaagttctgtatgtatcctttgggttgttgattctgaacattttgtgcaacttgtatgtatcccctacttcatcaccaattcgtttgaccacaccacttgcttgctgatcttcacaggcatataatgtgcacccttggtcatccgatcccatgaactgctaacgaaacaacgcccaacgtcgtgactgtngtcacgttctgcaaccaagcaaccgccctnnn

SEQ ID NO: 100171 - DNA, 595 bp, Triticum aestivum
  Clone ID: PAT_TA_100171
gcacgaggagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaaaaaaaaaaaa

SEQ ID NO: 100172 - DNA, 601 bp, Triticum aestivum
  unsure (1)..(601): unsure at all n locations
  Clone ID: PAT_TA_100172
gcacgaggattcatctttttctatcccactaggaaccctagccgccgcccgccgcccgccgcccgtcacccactgctgtggcccgacgccccatgcccatgagatgtgagccggtgacgaccgccgcatcaaggcgcgcggcgcacccctgaccgacgaagatcggcgccccgagccccggccccgaccagtggagaccggcgccccgcgccgccatccccgaccccccgtcagtcgctccactgcccgtgacacggccgtccgccgtcagtgacgaccgccgcgtcgaggcgcgcggcgcgaccttgactgatgtagatcggcgcgccgagccaaggccccgaccattggagactggcgccccgcgccgccatccccgaccccccgtcagtcgctccactgctcgcgacacggccgtccgccgccggtgctccgcgccccgatgactggttcaggagctgcagtccatcaccactcatcaccacccgtcttcttcaactctattcgtcggctcgctgtctactgccctccttcatttctccacatcgcagctgaagnnntgattgaagaatttggggacaaggtgannngaaagcacaag

SEQ ID NO: 100173 - DNA, 620 bp, Triticum aestivum
  unsure (1)..(620): unsure at all n locations
  Clone ID: PAT_TA_100173
gcacgaggccacggctcacactcacagcttcctcctctcttcgtcccttttcgcctccaatttccccacgtataaatcgagccaaaaataccttcaccctccctcactcttcccggatctcgctccgcaaaagccccggccagatccgccagagatggcagctcggtcgccgccgaggccggtgctgctgctcctgctcctcgccctcctctgctgccacattgcgctctgctcctccgctccgccggccgccaagcccaagcccaagctctccggcggccgcaaggagctcgtctccaccgatgacgacgagccggtcaagccgcccaagaccaccgctgctgccggcgtcaagaagaaggtctcctctggcgccaagaatcagaccaaggttctgaaaggcacgaaaccggaggagtccacctcgacgacgaccaaggtcaccaccaagaaggcgaccgctaaagcggagtcgaccacgaccaagaagccgaccgctaaagcgggcggcgatgcggccacgaccaagaagccggccactaaagcggccggcgatgcgnnnaagcccaaagtcccgaagctggannnnnnngcgnnnancgccaagcccaagagcgccg

SEQ ID NO: 100174 - DNA, 618 bp, Triticum aestivum
  unsure (1)..(618): unsure at all n locations
  Clone ID: PAT_TA_100174
cgcctggagcacgacgacgcctcgcgtcccactcctcccctacgtcctcctcggcctcgcttccaccgtgatgtcgcaggagccggacgcggaggaggaatgggcagcggtggaggggcgaggtgctcacctggtaacgggggcggcggagcgccccttcatcatccacgggttcaacacctactggctcatgtccttcgccgccgacgaggccacgcggccgcgcgtgaccgcggccattgccgaggctgccggggcggggctcaacgtgtgccgcacctgggcgttcgctgacggagggtaccacgcgctgcagaccgcgccattctgctacgacgaggaggtgttccaggcgctagatttcgtggtcagtgaggcaagaaggtataagatgcggttaatactgtcactatgtaataactgggaagattatggagggaaggcgcagtatgtaagatggggcaaggaggctggcgtnnntcttacttctgacgatgacttcttctctgatccaacacttaaagggtactacaaagcttttgttgnnnctgttttgtcaagaataaacacaatcacaaatgnnnnntacaaagacgatcctaccattcttgcctnnna

SEQ ID NO: 100175 - DNA, 610 bp, Triticum aestivum
  unsure (1)..(610): unsure at all n locations
  Clone ID: PAT_TA_100175
gcacgaggctcgattcgcgagcgtcggcggcgataagcccgcttacgcgcgcgcgggatggcgtcaacgctttgctctccccgccaccaccaccgctcgtatatctgccgtcgccgcctgcgcccctcccctcccagccacgcccgtccccggagcggcgccggcggcccaccaggattgaacaccacgaaatatctttgttcccacccaatgtccaccggcaggggttctcctgtatcgtgttcatccatggaagcatccaaaagcaagccaggaccggaacatctcattgttctggttcatggtatcatggcaagccccagtgactggacatatggggaagcagtgctgaaaaagaggcttggtgacaatttctttatctatgctagttcatcaaacatctacgccaaatcttttgacgggatcaatgtagctggaaggaggttagcgaaagaagtcttggacgtggttcagaagatggccggcttgaaaaagatttccttcatagcacattctttgggtggtttgtttgctagatatgctatttctatactatattcacagcaagcaaaannnncaggaagtggtgctagtgtcatgctgacangtn

SEQ ID NO: 100176 - DNA, 594 bp, Triticum aestivum
  unsure (1)..(594): unsure at all n locations
  Clone ID: PAT_TA_100176
gcacgaggtgttgctctctctctctctctctctctctctctctgggttggtggaagctgtgagtgagagtgaccgagtcctctgtcctctcttcttcttcttccacctcgcacctcctccttgttcttaccgtcacggtgcagcaaacaacaaacaatcagatcgacacagatccggtggcccttgttgttgcctcaccggatctccccattccttcttctcctctcctcttgcttgcccaccggtgcagtggaagcaaagcaatcatcttgatcttggaagactgattgattgattgatggggaagaagcccaagtggctgggcgccgtcaagaaggcattcagccccgaatccaaggaccagaaattgcagaggaggttggccgccgccggcaccagcgcaggcgcagcctacccgcgggatctgacgccctccgcctcctacctcgaggcacgcgcctcaagctcagctcccccgcccgccctcccccgctaccccgacgacttccaagaggaggagcatgaaattgagcatgtcgccgccgcgccagcgccagcgccagccacggatgcgccgctacctgcccctcctgn

SEQ ID NO: 100177 - DNA, 571 bp, Triticum aestivum
  unsure (1)..(571): unsure at all n locations
  Clone ID: PAT_TA_100177
gcacgaggctcccttcccctgtaaagccgccgctcgcagcgatgacgccccccttccgcccgtccccctcctccaccgcccccgccccccgcggctgcggcggcgagcgctgcgcctccggccgcgaggcctggccgctccaccacgtccgccacaacgacgtcttctgccgcctctgctcctcctgcgtcctcctctaccaccccgcctccttctgctcggcctgcctcctcctcctccacacggacgctgccgccgccgccgccgccgcgcaggacccccacttcgaccccgccgtcgccccgccgggccccaccgccgagtgctccaattgcggcctcttcgtcgcccatgtcacctgcatccccgaccccgtctccttcgtctgcccgccgtgcgccgccgaggccgagggccggcccttcacctacgcgcccgccgcccgccgcgtgatggacgagcgcgccgcgcggatcctcctcatcgcggcgcgcctcgcgcacgagtccatcggccgcgctgccgctgccgcccgcgannaggcggagcgccgcgtccaggnnncggccgt

SEQ ID NO: 100178 - DNA, 502 bp, Triticum aestivum
  Clone ID: PAT_TA_100178
gcacgaggagacaagtcaacctcaccgaggagaagcagagagaagggagaagatgtcggggcgcggtaagggaggaaaggggctcggcaagggcggggccaagcgccaccggaaggtgctccgggacaacatccagggcatcaccaagccggcgatccgtcgtctggcgcggcggggcggcgtgaagcgcatctcggggctcatctacgaggagacccgcggcgtgctcaagatcttcctcgagaacgttatccgcgacgccgtcacctacaccgagcacgcccgccgcaagaccgtcactgccatggacgtcgtctacgcgctcaagcgccagggccgcaccctctacggcttcggcggctaggccaccgccagattagctagcctgtgtctagggttcgttgtccatgatgtaattgcagcatctcgctgttgtttgctatcttctgtagaatcgaatggaatggaaattgaactagtttatcattggaaaaaaaaaaaa

SEQ ID NO: 100179 - DNA, 604 bp, Triticum aestivum
  unsure (1)..(604): unsure at all n locations
  Clone ID: PAT_TA_100179
gcacgaggccaccaccctcgcccgcagaggaattaaaacctccttatcctctctggcgcgctgctgccattgcacccctagctgcctggatccaaccgtcccgtccctcgccccttccctctctgatccgtgcgctctccttttggagccttgcgccgcgcccctttctccctgtcccaatccgcttcgacgtccctcctctaccggcgcgttctctccttttggtgccccccagcgagcgagctctcggtgcccgtgccaccgccccttttgccacgctctcctctttttgtctccaccttcttggctagccgttgaaggggcagccattgttgcgcagccggtgaggtgagctgaggaggatgtcgtccgcggtggaagccatctcctgctccaaggtcgccgacatcgccgcggccgggcctgcggaggccannnagtgcgcggcggcggtggcggagcacggcaacggcaacggcggggccggggacgccgcggcgacgaacgggaagaagtgcggcggcgacgtcgcggcgccgccgcattgcggcaagggcgtggaggnnnnnnnnnannnnnannncgannnnntccccgagcacat

SEQ ID NO: 100180 - DNA, 602 bp, Triticum aestivum
  Clone ID: PAT_TA_100180
gcacgaggcttggttgctgatctttccccgaatggggacctcgggcactacaacctgcacgtcttctcgtcggagacgagcgagtggagcaccaaacacgtgcagctgaaggtgcctgccaatgtcctgccacgagacctgccaagccaaaccgacaaggtgatccgtctcggagtaagcaccgttggatgggtcgacctctggcgcggcatcgtcgtctgtgatgtgcttcaaaaggatcctgctctccgcttcctcccgctgcccaaggccgatttcgacctgcgacgggaaggacgagcacggcaagtgcgggacgtcgttggcctccccgacggtttcatcaacttcgtcgagatcgaaaactgcatcagatggttcaccgttgtcagtaagagcacgttgaagacagccggcgtttttgacgtcgcggataccatctctgatgtgaagctcctcagccatagtgatgatggtatggacgacgttacggatgacaatcctgtgcggcatgcacctgctggctggaagatacggacaatgcttaggagcattcattgggacttatggcacaagagtcgcactgtccatctgaccacata

SEQ ID NO: 100181 - DNA, 611 bp, Triticum aestivum
  unsure (1)..(611): unsure at all n locations
  Clone ID: PAT_TA_100181
gcacgaggattgatgcccctggtaccgtgactgcntcaagaacatgattactggtacctcccaggctgactgtgctgtgctcatcattgactccaccactggtggttttgaagctggtatctccaaggatggccagacccgtgagcacgccctccttgctttcactcttggagtgaagcagatgatctgctgctgcaacaagatggatgccaccacccccaagtactcgaaagcccgttatgaagaaattgtcaaggaagtctcttcctacctgaagaaagtcggatacaaccctgacaaggttccctttgtccccatctctgggtttgagggtgacaacatgattgagaggtccaccaaccttgactggtacaagggccctacccttcttgaagctcttgaccagatcaacgagcccaagaggccctcagacaagcccctccgtcttccccttcaagacgtttacaagattggtggcattggaactgtgcctgttggccgtgttgagactggtgtcatcaagcctggtatggttgttacctttggtcccactggtctgacaactgnnntcaagtctgttgagatgcaccacgagtctctcctggangcnn

SEQ ID NO: 100182 - DNA, 610 bp, Triticum aestivum
  unsure (1)..(610): unsure at all n locations
  Clone ID: PAT_TA_100182
gcacgagggcgaaacccccaaatccccctcccccccgcaccgccaatggcgacgccgccggcgccgtcgccgtcgccggtcaagctccggctcgtgttcgacaaagcccgccttctccggcgggcgcagagggacctccggcgctgctggctcctcctccggcccgagctcgccaccgtcgccgacctcgccgcccacgtggccgcccgcttccgcctccaccgctcctgccccggcggcgtcgtcttgacgatggatggattcgccgtgccgcctttcgagtcgacctgtatcttcaaggacaannatatcataanngttcaacagaaagcttgcaagagaatggtacaccatgatgatgtacactgtattgaagatcccgagaaagtagaaatgcgtccgcttccgactgaagataaaatccttgcaattgagtatcaaattgactctagtaagcatcaagaagaagaggtgcattgtgatcatcagcctgaagaaaaggtaacatccgaccacgatctagaaaatgggcatacaagctcgaagaggaaacgaaaagatgaagatgcaaaaatacctgagagctcaaggagaaagnnnctgaagannn

SEQ ID NO: 100183 - DNA, 513 bp, Triticum aestivum
  Clone ID: PAT_TA_100183
gcacgagggcaagaagcacacaggaagctcctagccaacaccaatcaaggcctccatccaagcccaagcaacctcgaatatgtcttgctgcggaggaaactgcggatgcggcaccgcctgcaagtgcggcaacggctgcggtggctgcaacatgtaccccgaggttgaggccgccggcgccaccctcctcgtctccgccactgccactcacaaggggagctccggcggcatggagatggcggccgagaacggcggctgcggctgcacccagtgcaagtgcggcaccagctgcggctgctcctgctgcagctgctagatcattgatcatgcatgcgccgcgtgcatcatatctatgatctacgtatccatctactaccatgtaatgccacctgatcgagggtctttgtatgtatgtagtatgtacgcacctgcctgcatgagcagagcgggtgccattccatgcatgtaaacccctaaataaaatctcccgtggttttgcttaaaaaaaaaaaa

SEQ ID NO: 100184 - DNA, 538 bp, Triticum aestivum
  unsure (1)..(538): unsure at all n locations
  Clone ID: PAT_TA_100184
gcacgagggagctccgggcgaaagtccagcattgaccttgggtcggtgccggcaacagcggcaccatggtcatagtgtcgttccccttcttgaaagtgttgccgtggtgctcctttgcacgactctccgggagaaatccctagcttcagatggctgaagcgggcgataacggcggctacgtcgtttccttctttgaagcatcgtcttggagagtcagcatgttgcagtttgcacggatctcttcatcgtcaggggcaatggacgtcggggcggcggctccggatggtttctgattgtgagtcgagatggcgatctcgggaacaacgtgagtggtagctctatgaagtggggctctatctcgacattggttgggtggcatccttgtttcgcttgggcgtaagggtatcggctcggtcgatgcgccccannnngggcggtctgactttacatcggnnncggcgnncccgaatgtgnngcnnnngttcgtggtctgcgagcggttgccctgagcattgtgggctgcagcagcnnnnntnnn

SEQ ID NO: 100185 - DNA, 635 bp, Triticum aestivum
  unsure (1)..(635): unsure at all n locations
  Clone ID: PAT_TA_100185
cttcctgcttccaacaaactcacacaacccaccaccgaagatcccaactccacccgaagcggcagccatggcccccaaggcagacaagaagcccgcggccgagaacaaggtcgagaaggcggcggagaagacccccgcgggcaagaagcccaaggccgagaagcggctgccggcgggcaagacggcgtccaaggaggccggcggcgaggcgaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcgaggtacaacaagaagcccaccatcacctcccgggagatccagncctccgtccgcctcgtcctccccggggagctcgccaagcacgccgtctccgnnnncaccangnnngtcaccaagttcacatcctcctagactgacggcgtgttgttggtttctgcatctgtagtgtcgactctgcttatctatctatctgcaagtagtggtagcagtagtagtacctgtgcnnnnnnannnnnna

SEQ ID NO: 100186 - DNA, 594 bp, Triticum aestivum
  Clone ID: PAT_TA_100186
gcacgaggcctcgtgccgaattcggcacgagggatttctcatcgagacgatccagccgcgccaagtccgtctccagccacgccggagccgctccttctcccaccccgcgtgcctgccagcagccgccgccgttgactctgccttgcgccgcctcctctgttctgcgctcattcgagcggggaggacgagcgctggtgcgtatgcgctgcccccttcgcatcgtcaaggcccagcgtgtcgccagcccactttgccctgcttcccctctccacccaccgggccaagcccatggtgagctctgctgcccccaccttttgcacttttggcccaagtgcagttttggcccatggcatgtttttttcctctagatgattttttctattattccagagaatgcccgttttgcagaaaagtccctaaacatcatgcatattatatctcaccaatcgtgcatcatattaaaataagttatatatataatgcttagaattttgtgtagattaataatattcaactttcatgcatgtttaaaatgtttaaaatgttttttgtttaaattttgttaaataaattgctaaaatgatttaattcata

SEQ ID NO: 100187 - DNA, 602 bp, Triticum aestivum
  unsure (1)..(602): unsure at all n locations
  Clone ID: PAT_TA_100187
gcacgagggtgctctcgtgtgttcctgattcaggaagatcgcaggttttcatatagctttcctgagccaaactagtccggcgaataaaggatgcagattctcgtggacactgtcgccggcgagacgatctccctcaaggtcgatccatcagacactatctaccttgtcaaggaaaagatccaggataagcagctcctcaccttcaacggggagcagctcgacgcgctggccgactatggcgtccgtgacggatccgctcttggcctccgcctccatccgctccatgagaagatgcagatccatgtggttgagagcctgacgggcagggtcatgaaccttgcagtcacgacctcagatacagtcgacaatgtcaaggccaagattcacaagtggcacggttttcccaaggatcaacagtgcctcatcttcgccaacagacagctcgacgacgacgaagaagaaggcaggaccctggcggacctcaacatccgcaacgacgccaccctcctcctcgtcctacacagccggtgtcccagnnngatgatgaagatctacgtgaagacgctacggcaaaatttctataatcttgnnnnnaggagcac

SEQ ID NO: 100188 - DNA, 597 bp, Triticum aestivum
  unsure (1)..(597): unsure at all n locations
  Clone ID: PAT_TA_100188
gcacgaggatccaccccatcgaccgcgccctgcggtgcccctacaccggcgccacctcacctacaccgccccgtcaccgccgccccaaccgcgtcacctcctccattccctccccgacctggacgccccgcgcgctgcacccgaccatgccgtcgctccggatggtgggctccctgccgcgagcgcccgtcctcgacgcccgagctccctccccctcgctctccttcagcaccgccgccctccacagcgcagacgcatgccaggcgccgccatcgacccgtcgccctccacctcgaccacgacgccttgccgctggatcggtcaccgccggcaagctccggctccctcaactgcgtccccgacctccgctaccccgagaccgacgttgatgtgactgagtatgactacatccccgacgacccctccttgccagagcaaccagttggttacactagtgacttcgacgagtagcttgtatcccagctacgatcttgtacccttggganngtcgtatttagtcnagcttcttagtcttttccttttgtnnntgtatgtactcagncatgtaatgcttccgttgtttgtatggtctgaatg

SEQ ID NO: 100189 - DNA, 611 bp, Triticum aestivum
  unsure (1)..(611): unsure at all n locations
  Clone ID: PAT_TA_100189
gcacgaggggccgcagcggccacctagccaccgtccctgcccgcccgggccggggcgccacccagccatgcgtccgtcttcccctgtggggtcctgctgctcggcccacttctcgcgcagcgcgggatcgggatggggcacgcccgcgtccgtcgcagatctacccggatccgccggtccgtcgcagatctacccggatccgccggtccgtcgcaagagccgaattcccagccgcctccccccgagtcaacggtctgccccaacgccccggcgcgtttcctgctgcggggcgagagctccaagggttgggctgcgcgttctcctgcggtccatggggagcacccctgctctgggaagaacaagctaaagtccatcgtatttgtgcctttccccgcaccgcccctttcctcttcgggcaacgaggacgactggacagaggtcaaatcgcggaaagggcggcgagcgctccagaagccagcaggcaagcccnnncgccgcccgnnggggcggtcgggcaggcgccctgccattaatggcgacgcgggccatgccgccttcttaagccgnnncgncnncctgtgttttcattgcctcagcagtagccatcgcnn

SEQ ID NO: 100190 - DNA, 600 bp, Triticum aestivum
  unsure (1)..(600): unsure at all n locations
  Clone ID: PAT_TA_100190
ggtacacagatcatatttggtttataggaagattgggcccatgctgctgcagagtttgagaagtatattaatagcactccaaaagttatattccagtgtcattccatgacaaagtactaagacgttccaaaaaatgtcattttttactttgatttgttttcttcggcatgtgtgaccaatgtttgcggaacacgtaacaatgtacaagcgttaaagaaactcagaaagggtttaccaacttttaagagaacaatgccatgatgactgctgtgccatttcccccttgttttcctttattctgttcacttctgtattttatttttgcttcatttcttgcaatcacaagttcacagcaacccacccttcccaaattctagctattagcctatcatcaccttttctttcatctagttacactgtccttgactccttggacatccaactacgcggttgtaggaatgagcagaaacatgttgtagcctgcttaaactgttgtaagtagccactctcttgcaaatgacgtgtggatggtggaagcgcccccttactcacaggttcatggagggatttgagggtatgggatgacctnnntggtggatt

SEQ ID NO: 100191 - DNA, 619 bp, Triticum aestivum
  unsure (1)..(619): unsure at all n locations
  Clone ID: PAT_TA_100191
gcacgagggtccatatcaggctgatttgcagttaatttgcgttgcacatttttgctttgggtccatatctgcagcaacttcatctcctatttgtgaagtggtgccaagaaaccaacctatggcaatgagcatcagattgcaaaataaaaataaaaataaccctctgttattttcaatcatattaaagtaaccaaaagtaaacatgtacactaactcacaggcaagataagtcaaaagcatgcagaggaattcatttagtagcactctgaacccacttccagaaaaaaaaatctaagtaactagttacagccgtgatgaacacagcctgtattcatttccaaatttggatagagatccacaaatttgtgggtatgtggctgctgagcctgagatccaagtatacatgtggtctgaaagaggcttggtgggccaatcattgtcttcaccatcgatgggatcatcatcactgatgttgttgagcataccaaatacttcttgtgctagaactaatctggcctttgcctaacgaagaacagtagtaaatgcggcaaaacaggggaagaacnnnnntgaacagaaaccnnngttgttcatttatatgtcgtgccatccaacnacn

SEQ ID NO: 100192 - DNA, 606 bp, Triticum aestivum
  unsure (1)..(606): unsure at all n locations
  Clone ID: PAT_TA_100192
gcacgagggcggttaggcgccagcgggagcgggggaggacgaaggctgctggtggtagccgggccggggtcgtacccgccgcggtgcacgtccaagtgcggcagctgcaacccgtgctacccggtgcacgtggccgtgccgccgggggtgccggtcaccacggagtactacccggaggcgtggcggtgcaggtgcggcaaccggctctacatgccatgatcggcgcaaagatgaaaacaaggccggtctcaagccgcgcgcggtgagcttaccgacgccgatcgacctcggcgcaagctgacgagagagcccgtcgtcgagctgcattattgctcggggcgggggccgggcggctcgaccgcagctgcagctgcagcagtgccatggctgtcgcggcgcgcctgcctctgcctgcatgggtggagctgnggggggggtggcccactgggccgctgggctctgtttctgtgcgtgtcttctctgagccgctggaattcgcacggccctaccacgacgcgccggggcatggggggctgtacggcgcgtgctgtgctgnnnntgggaggagtgagatacagtgcactgagtgcagcnnctgcacgtgnn

SEQ ID NO: 100193 - DNA, 582 bp, Triticum aestivum
  unsure (1)..(582): unsure at all n locations
  Clone ID: PAT_TA_100193
gcacgaggcaactcaccactcaacacaagtcagcgccaccaccaagaacaccacaagaacagacacatgaccttcagcatctcggcggcgatggacgtcggccacgggcacgagtacatgatccgcttcgacggccacttcgaggacccctcgcccagcaccgccaccgccgagccgccgccgttcgcgggcagggcgatctcgccggagcaagagcacggcgccatggtcgccgcgctgctgcacgtcatctccgggtacaccacgccgccgccggacttcttcccggcggccgcgagcaaagaggtgtgcccggcgtgcaaggtcgacagctgcctcggccgcgccgaaagcgacggtgaccgcgggcgggccgcagaggcggcggcggaacaagaagaacaagtaccggggcgtcanncagcggccgtggggcaagtgggcggcggagatccgcgacccgcgccgcgccgtgcgggtgtggctcgggaccttcgacaccgccgnggacgccgccagggcctacgaccgcgccgcngtcgagttccgcggcccgcgcgccaagctcaacttccccttccc

SEQ ID NO: 100194 - DNA, 607 bp, Triticum aestivum
  unsure (1)..(607): unsure at all n locations
  Clone ID: PAT_TA_100194
gcacgagggagaagcgttcctcctcccctcccatgcatggccacggcgagccacactgctgccaagctcctcgtccgatacctactccctctctcccccaccttccctcctcagaccacctgcaccccatgtcggtcggccaccagatcccggccgcagtgcacccccgcacccccagcgatgcccttcgctagatccaggccgcggtgcacccccgcacccccctgtgatgccctgcaccgaatccaggccgcagcgcacccccgtgccccctggcgacgccctgcgccggatccaggccgcggcgcacccctccccccaccccctccgcctggctcagcaagagtggacgctgcctaccgtcaacgcgatggctaccatgggatgggcggcactctaccacacaactccgcgcagttcgcttcatcggcgtccgctattcacttctttttggaaaaacaaaaaaagctctttaagggtggccatgctgccatttgcaattcgctagagggaaagagaaggtgctctcatcagggggagtcgatgccgtgaccttgcgtacacagcgagccgcgctgtaatcacattgctcgcgtgtaccatgann

SEQ ID NO: 100195 - DNA, 597 bp, Triticum aestivum
  Clone ID: PAT_TA_100195
gcacgaggcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaatgaaaaaaaaaaaa

SEQ ID NO: 100196 - DNA, 635 bp, Triticum aestivum
  unsure (1)..(635): unsure at all n locations
  Clone ID: PAT_TA_100196
gcacgagggattagtcctgactcctgagcggctgagccaanctacagtgcggcgtgtgcgagcagagcttctatctagcagagaagggaaggagcgggcaggatgctggaagggaaggcgacggtggaggacaccgacatgccggccaagatgcagctgcaggccacctcggcggcgtccagggcgctcgaccgcttcgacgtcctcgactgccggagcatcgcggcgcacatcaagaaggtgagcaactatcccaatcccgccgcccaaatctacacctcctgaatctgcaggtaacaagctaggacagtgcaagcgctgccgaatgattggatctgattcggacggctgcgctgcaggagttcgacacgatccacggcccggggtggcagtgcgtggtgggctgcagcttcggctgctacttcacgcacagcaaggggagcttcatatacttcaagctcgagtcgctccggttcctcgtcttcaaaggcatggcggaagagcagccgctnnngtgctgatctgctgcgccctctcctgttttaacnnnnngtgtggactactcgatgatnannnnnnngcagctagctactactagtatcaactccaaatgcgccaatgtaacttatttcnnn

SEQ ID NO: 100197 - DNA, 608 bp, Triticum aestivum
  unsure (1)..(608): unsure at all n locations
  Clone ID: PAT_TA_100197
gcacgaggtctcctggctttataaaaccggcggcattaaaccctccccacctcttcatatccgcttccagacacttctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaagagatcccgtggggtgaggctggtgccgattacgttgtggagtccaccggtgtcttcactgacaaggacaannccgctgctcacttgaagggtggtgccaagaaagtggtcatctctgccccaagcaaagatgcccctatgtttgtggttggtgtcaacgnnnacaagtacacctcagncnttaacattgtctcaaatgctaa

SEQ ID NO: 100198 - DNA, 205 bp, Triticum aestivum
  unsure (1)..(205): unsure at all n locations
  Clone ID: PAT_TA_100198
gcacgaggctctctcctcttccgtgtgatctgctctcgctccttcgcccactcgagagggcgacctcttctccctccttccttccttcgagctcggcagggacccttccttcgagctcggcagcggagccgagctgtgcgtgccgcggagggttgacgggcannncgacggggggaggaggaggaggnnnnnnnnnnnnnnnnnn

SEQ ID NO: 100199 - DNA, 512 bp, Triticum aestivum
  unsure (1)..(512): unsure at all n locations
  Clone ID: PAT_TA_100199
gcacgagggtccacttcttgccctcaccctcccccattctcgtcgcttccttcctgcgcaatcatcgcggccgctctgctctgctcctcgccaatcgatcggtccgccagggagatggacggcgactacgtctccggcctgctcatgggctccgcggggctcgacttcggcgtgccgggccttgacgcaggcttcttcgagacgctctgcggcgccggcggcgcggggctcgccgccatgttcggggaccgggcggccgggatgcccggcttcggcggcccgttcgggcccgcggaggggggcggcggcgggggcgagctcggcgccgcgtcccgggaggggtcctccgtctccgacccggcgtgggcgcacggcgcgaatgccaggaagcggaaggcgccggccgcgggcgccggcaagggcaaggaggccgcgtcctgtttcgccaagatgggagagccgacgggtcccgactcgaagaaatgcaaaatngannacgagacggtgnnncn

SEQ ID NO: 100200 - DNA, 282 bp, Triticum aestivum
  unsure (1)..(282): unsure at all n locations
  Clone ID: PAT_TA_100200
ggaaaaaacctaccggaaccggtaaccggaaccggcaaaatctgggcccctttttacangcgttttaccaaccaaaccgggaaacccttaagggttttccgcctccccccagccaacataaaaaatttgccgcctttggttgggtcccaacccccctaaaaccttacctaaaaaagggttcccaaacaaacaaacctttatcaacttaaaacccccccaatctgggtctccccttaaccccccaaagnccggggggggggaacccctanctcccagggggcg

SEQ ID NO: 100201 - DNA, 598 bp, Triticum aestivum
  unsure (1)..(598): unsure at all n locations
  Clone ID: PAT_TA_100201
gcacgaggccaccacagccccactctcagagagcacggacgccggacacgcacgagtcttcttgaagcaatggcgaccaccgcgatggcgctctccccctcgtccttcgccgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggacaccgcggggctgtcggccgaccccgagaccttcgccaagaaccgggagctggaggtgatccactgccggtgggccatgctgggcgcgctcggctgcgtcttccccgagctgctcgcccgcaacggcgtcaagttcggcgaggccgtgtggttcaaggccggctcccagatcttcagcgagggcgnnntcgactacctcggcaaccccagcctggtccacgcgcagagcatcctcgccatctgggcctgnnnnntcgtgctcatgggcgccgtcgnnnngtaccgcg

SEQ ID NO: 100202 - DNA, 600 bp, Triticum aestivum
  Clone ID: PAT_TA_100202
gcacgaggcagggatgagcagcggcagcaccccctacccctgcacatcctcttcctcccgttcttcgcccccgggcacctcattccggtcgtcgacatggccgcgatattctccgctcgcggcgcgaggtgcaccatcctcaccacgcccgtcaacgccgacatcatccgtccggccgtcgaccgcgccaacgactccaactgccacggcaccgactccccttcccctgcagtcgacgtctccgtcgtgcctttccccgacgtcgggctcccgccaggcatggagaacctcatgtcccttactccagcccacggagccgagtacccgctcaagttcatccaggccgtgcagctgctccgcgagcccttcgaccggttcatggctgccaaccgccccgacgccgtcgtgtccgacagcttcttcagctggtccgcggacgccgccgcggagcacggcgtcccgcgtctcgtgttcctcggcagcagcgtgttcgcccggtgctgcagcgagaccatgctgcgcaacaacccgctggagacgaccaccaaccccgacgacgatcctgatgacgacgcccggctggtctctctgccggggctg

SEQ ID NO: 100203 - DNA, 607 bp, Triticum aestivum
  unsure (1)..(607): unsure at all n locations
  Clone ID: PAT_TA_100203
gcacgaggcgtggagcaaactgtcagtgcaccaagagtataccctgcggcaggagcttcaagcaatgctcactctgctcaaattacgtaccctgccactgcaggtggctacctcccggagcccgatgcgccggagggggccacgatgtacgtcgggaacctaccctaccacattgacaatgagagactcaagctaagcttccaaggtgctggggtcgtcctgttctcaaaggtcatttatgacagagaaacaggccagagccgtggatttgggtttgtcaccatgagtactgttcaggaggctgagaaggctgtgaggatctatcatggctctgggatgtatggcaggcctctgactgtaaaaatcgcagctcctagaggaggcgcccgggtggatgcccctcgccgtcaatccggttccccactcagaatattcgtatgcaatctgccgagtcaagtggacaactctcggctggaggagctgttcagcaagcatggcaaagtggttgatgcaagagttgtctatgagcgccgagaaggggcctcgtgttcgnnnggatttggcttcgtcacaatggcgaccgannnnnnatcgtacnngnngatac

SEQ ID NO: 100204 - DNA, 421 bp, Triticum aestivum
  unsure (1)..(421): unsure at all n locations
  Clone ID: PAT_TA_100204
ggcaaggcaaccattggaatgctcttatttaacgataatcacactcacctaatgcaaaatatcaggctgatgaaatgaaccactacttttgaaaaatcagctgcggaaagaagcacaaattcaatcgattccccttccagcactaataccacttgtagttccagataaccagagtcgacaagcactgaagtaacagaaccagctacagtcgctactnnatagatagatagatagatacaagcaatgcagatgcaatctaggaggaggtgaacttggtgacggccttggtgccctcggnnacggcgtgcttggcgagctccccggggaggannnagcggacggaggtctggatctcccgggagnngatggtgggcttcttgttgtaacgggcgaacttggcggcctcngcggngngcttctc

SEQ ID NO: 100205 - DNA, 615 bp, Triticum aestivum
  unsure (1)..(615): unsure at all n locations
  Clone ID: PAT_TA_100205
cgaggcgctagctgagttgctgccagagctcgaggccttgttctcaggggatgcaagggatttcatcaaggaagaggcagaggggatacttgtcaggctaggggatgcggtgcgtggcacggtcgctgagtttgccaatgcgatacgtggggagacttctcgcagatcactgccagggggcgagatccacccgcttacgcgttatgtcatgaattatgtgcgactgcttgcagattacagccgctggctgaatcatcttcttgatggttgcgagactgagctggaaaatgggggtgacaatgcggatatgactccactgggtcactgtctgctcatactgatcacacatctattggacaagattgaggataaagcgaagctgtatgatgatgaggcactgcagaacatatttttgatgaacaatctgtggtatgttgtgcagaagatcaaggattcagagctaaagagtttgcttggggataactggatccgtaagcgccgtggtcagataaggaggtactctacagggtacctccgatcctcatggaccnnggtattagcttgcctgnnngatgatgggttgccacagacaacaggttcatcgagtgcactcnn

SEQ ID NO: 100206 - DNA, 389 bp, Triticum aestivum
  unsure (1)..(389): unsure at all n locations
  Clone ID: PAT_TA_100206
gnttnnncaacttcatatatttaagtaaagaaaactcgnnngcaattgctattctgaagtgattatgcttcaggaatgagcggcattgggaaaaataattcaagtggcgacgcagaactcnnngcacaaattgaaacaatagctacccggaatatttctggtacaaggagtatatactctacgcgtactagttcatcaggatagccttgtcttctttacatacgctaaagatttgagggctgacatcaatggcggaactanntcctagcgaccaggcacctgcctgggctgtccgcttccgcaggtttgaacaacggctctggcggcaagcacatccatgctgctgtgtaacaagagcagggcaatnnagtctnnnccagnnannnaac

SEQ ID NO: 100207 - DNA, 613 bp, Triticum aestivum
  unsure (1)..(613): unsure at all n locations
  Clone ID: PAT_TA_100207
gcacgaggatccccctcctcgacctgccttgccgccgcctaggtaagctccacacgcttcgccgtcgacctgcccgccatgtaccgaccaagcttcagctcgagctcgggatagccgtcgacgtcgcttccccggtcacctccagccaccttcttcaagtcggtctgcctccccgtcgtccccttcgtccgctgcttccactacatcgccgacgcagacgccaagttccgcgcctggctcttcctctgcttcctctacttcgcggacagcagcctcgccaggttcagagctcgtctgcgtcgccgcaggctcgactccgtcgatgtatacttgtccttggagccgggagacaagtacgtgcacgaggaacctgttgagtacgctaacgaggatcaagccttcgacaactctgagaaccttgcagatgcaggtgccgaggatactggcgcagatggcgcaactgagctgaagtgggaatttgatgaggcccttggtcgttactatgtatcgtttccagatgatcagtagtggagcccagtcgggacgatcggggatctagcatttggggttgtcttcttttcatttgaacctganngtagtcggtctatgagtg

SEQ ID NO: 100208 - DNA, 594 bp, Triticum aestivum
  unsure (1)..(594): unsure at all n locations
  Clone ID: PAT_TA_100208
gcacgaggccctgcacacaactctccaccgtagcccccaatccccacccatcttcccggagcagcgatggcccccaaggcggagaagaagccggcggcgaagaagcccgcggaggaggagcccgcggcggagaaggccgagaagacccctgccgggaagaagcccaaggccgagaagcggctgccggcgggcaagaagaccgcctccaaggagggcggcggcgagaagaggggccggaagaagggcaagaagagcgtggagacctacaagatctacatcttcaaggtgctgaagcaggtgcaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctctgtccgcctcgtcctccccggggagctcgccaagcacgccgtctccgagggcaccaaggccgtcaccaagttcacctcctcttagattccgttgcctgtatctagtaccagatgtggttgttcactctggttatcgccaagtagaagn

SEQ ID NO: 100209 - DNA, 399 bp, Triticum aestivum
  unsure (1)..(399): unsure at all n locations
  Clone ID: PAT_TA_100209
gcacgaggagaagggtcaaaccctagccgccaaaccttctcgtcccgagccccgcgtccccttcgcctcgtctcctccccgctccatcctctcccacgccgccgccccctctccccgcttgcctcagccgcctcctctcctccccgtgccgccgcccccctcctttctccctgtgccgccggccacctccattctccccgtgctggagcagagatgcctcagtaggggcagaacaccggggctttatctccccttgtctagcaccggccagtgaacaagacggagggtagccaanggcgcctcnnncagcggctgctcttctccggcttggaccnnaaccctggcgtctgggtaagtgcagaggagcgagcaaagcagatggtgcagccgnnnnnnnnn

SEQ ID NO: 100210 - DNA, 612 bp, Triticum aestivum
  Clone ID: PAT_TA_100210
gcacgaggcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcagctgcggccgaaccggaggccgaggcgcccgccgtggtcgagacagagaccaaggaggccgtggctgaggcagagccggcggcggccgaggaggtgaaggaagaggcggcgcctgctgccgaggccgagccggccgctcccgctgctgctgaggaagcaccggtggaggcagccgcggccgcggtggccagcgtcagcgtgtgaagcgccagcgcgcgcggaggaggagctggctgggtcagcgtcgacggcggcggccgtgtgctcctacgtggcacggcgtgatgctgagtcagccagtgga

SEQ ID NO: 100211 - DNA, 204 bp, Triticum aestivum
  Clone ID: PAT_TA_100211
gcacgagggagagaactagtctcgagttttgatttatttttttcagccgtccgacattttgatttttgagtatgtatgatcctgccgatttcctgattttttcattgtattcacaggtattgttgtaccacaaacgatgtttcgttctttttgtaacatagctcaaagcattagtgtgaatgagaatgatttaaaaaaaaaaaa

SEQ ID NO: 100212 - DNA, 277 bp, Triticum aestivum
  unsure (1)..(277): unsure at all n locations
  Clone ID: PAT_TA_100212
gcacgaggctcacgcgcgccctcttggtagcagccacatccgctgcggtgcatcccttctcgtccgccacctctcctcatctccttgtttcctcccaggtttccgatctggagtgagagaggcaaactggtaacaagcgccgacacctctcctcacttcctcccgtgttccggtgggccaccgaggatgaggggagcattggccatagcaggtgtggtgccggcgaacgcaagcagcagcaggcggcggtgctggcgcannngtgccggcgaatgcg

SEQ ID NO: 100213 - DNA, 604 bp, Triticum aestivum
  unsure (1)..(604): unsure at all n locations
  Clone ID: PAT_TA_100213
gcacgaggctccagccaccacccctcctaccacctccttcagcacgccggagccccaccagagcaaccctgctgccggccgccctacccaacacgtcgccatcctaccctatgcgctgccccgagcagcccccttcccacctcccaatctgccacccgagatccaccacctccagctctagctccggcgctgctctcctgtgacgcgccccctgccttcggatccggccagctgcgtcctcctgtgacgcgtcgccgtcgtcgcgagatccatccggccgccgcaacgccgccacacgtcctaaccttctccgctccagatccaaaagagcacatggcgcaacgcccacctcctccaccctggatccatggtgccccaaatcccccttccatttgtggattacttcttcccctccctggattgttgctcgttggcatccggcgaacctcccgacctcggatcctcctattctgctctttctctgaaccgcctcgccacacctgtgtcgttggcctccggctgctgtacttggttgtcgtgccagtgcagctcgccggggatacatggtccagtgcagatccaccatccggcnggagctcctttc

SEQ ID NO: 100214 - DNA, 600 bp, Triticum aestivum
  unsure (1)..(600): unsure at all n locations
  Clone ID: PAT_TA_100214
gcacgagggccgacctggcattcctcgacctgtcgatgaacgacttctcgggctcgatcccgccggaggtgttcgcgctcccgagcgcgtcgtcgctgctcctgtcccgcaacaacttcacggggtcgctggccgtgccggcggcgcccgcgtcggcgacgccgccgtggtcagtggtggacgtcagccacaacggcctcacgggcgaggtcccggaggcgctggcggcggcggggagcctgtacgtgaacaacaacaagatctccggcgaggtcccggaggcggtggcccgcagcgtgttcgacgggcgcatgacgaccttctacgcgcagcacaacttcctgacggggttcccggtgccgccgacgccgctgccggactccgcggcgctgtgcctctcctacaactgcatggacctcccctccgcctccgcggccgacgggtgccccacgatcggcgggcccctggagtccaggcccgcggaccngtgccggagcagcggcggcgacggctgagccgccgacgccccgtgggctgacaggtggggctcggtcgtctccggctcccgcgcggcacgggcgnnncaccctcacccaccgg

SEQ ID NO: 100215 - DNA, 303 bp, Triticum aestivum
  unsure (1)..(303): unsure at all n locations
  Clone ID: PAT_TA_100215
gtttttgttttttttttttattttttttttttttttttttttttttttttttttttttttttttttttttttttttttctatttctttcttaatttttttttgcctcttgcacatccccctgaaatgttacgtgttcctgctgtccctttaggaacattactttcaaccccttatcctatttcatttcgtgccccctacatattggcactgctaccctctcaaatttcnnccaaggatttgaaggatcctgaactgctttcaaagctcatcttgaataacttctgcacagtaccaacaaaggt

SEQ ID NO: 100216 - DNA, 587 bp, Triticum aestivum
  Clone ID: PAT_TA_100216
ctccatctctctccccccctcaccactccttctccacctccggccgcctccacggcccggccggcgtggtggtgcgcctccgcagcccatccacccaccagcaccaacacccagcgccaccatcacctcctgccgctagcgccaccagctccacttcgccgccgcacctcaccaggaccaccaatcaaatccctccctctcccaccatcagcaccaccagcgcctccaccgcacctccagcccacgccggcgtgcctgaccagacgagggcgaggcagtgtctggtgctccgcgcgacaaccctttgctctcttctctcctcttctccactcaattcttcctctttgctactgctactactctccatccccctttctatctcccttcgtcccccacggccctgctgctcttctcaatctatggtccttgcctctgcttcgctgaaccttctgctgatccccttgccccgctgctctctcaaccctccacactgctgctgctctttatccccatgctactgctgctcatctccagcgcctcctgctgctgctctatctcaagcgcccctttttgcttctcctcttgct

SEQ ID NO: 100217 - DNA, 610 bp, Triticum aestivum
  unsure (1)..(610): unsure at all n locations
  Clone ID: PAT_TA_100217
gcacgaggcttcgtccccgtcctctctctccctctctgcacctaatccagcgccaagagagaatactttgtttgcggaggtaatcatctgccagccatagccatgcaggaagcgctcatctctccggccaacgccgaccgcctccgctcggccttcgagctcaagccgtacggattcggggaccagcgcctctcctcctcgccgcgctacctcccgggcggcgacgacggcctctaccgctgctcctcccccttcagccccagcctgggcttctcctcgccgtcgccgctcgccacgtccgtctcgctctcgccgtcctcgtccgcctccctcgtcgacgacggggactacgacggcgcggccgccgccgccgccaccggccacaggctccagctcgcgcggctcgcgctgcagtaccaggaggtggccgatcgctacgagctctgcctctcccacctcgccgaggccgtcgacgaggcggcgatcctccgccgcgagaacgccgagctccgcgtgnccaacagcgacctcgcgcgccgcgtcgcgctgctcggtggcaaggagnccgnnnnngtcgtcatcgctgacgagatacgccggttccgcctcg

SEQ ID NO: 100218 - DNA, 617 bp, Triticum aestivum
  unsure (1)..(617): unsure at all n locations
  Clone ID: PAT_TA_100218
gcacgaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcann

SEQ ID NO: 100219 - DNA, 481 bp, Triticum aestivum
  unsure (1)..(481): unsure at all n locations
  Clone ID: PAT_TA_100219
gagagctgaggccctcgtctgccgtagcctgggcattgtacagaatggtgaggatatcaccgtgcaagctatggacaactttgccaagaaattcaaagatcgtcttcctgatgacgtgattggagctatgagggccctattcaagctggatgatgaccgtatctatgcggccgaagctgggctcatagcgcatggtggccccaatgcgctcgatcacgttgatgaggctactgcctgatgtctgctgctgtctttgggctttagtttctcatgttagtgataaaaacaaggggcgttggtggagcttgcctccaggttgcatttgttctttggtatggcctactcaacaagtctcttggtgctacgttgatgtttgctgctagtttagctgctacaacaagagttcttccttgtcgttggttagctgaggttgtacatccatgtacctgctgttgcatatctttggccgctgtgccgtgnn

SEQ ID NO: 100220 - DNA, 603 bp, Triticum aestivum
  unsure (1)..(603): unsure at all n locations
  Clone ID: PAT_TA_100220
gcacgaggcaggaacggaaccaacaaatccccagccaatctcgtctccgatcgactccaggctcgtcggatcctcctcccccaccgcctcaagatgcagatcttcgtgaagaccctcaccggcaagaccatcacccttgaggttgagagctccgacaccactgacaacgtcaaggccaagatccaggacaaggagggaattcccccggaccagcagcgcctgatctttgctggcaagcagctggaggatggccgtaccctcgccgactacaacatccagaaggagtccaccctccatcttgtcctgcgtctgcgcggtggcatgcagatcttcgtgaagactctcaccggcaagaccatcacccttgaggttgagagctccgacaccatcgacaatgtcaaggccaagatccaggacaaggagggcattcctccggaccagcagcgccttatcttcgctggcaagcagctagaggatggnngtaccctcgcagactacaacatccagaaggagtccaccctccacctggtgctgcgcctgcgtggnngcatgcagatcttcgtgannaccctcactggcaagnnnancactctggnnnnnnga

SEQ ID NO: 100221 - DNA, 605 bp, Triticum aestivum
  Clone ID: PAT_TA_100221
gcacgaggctccctcgctcttaccacgaagctcaagccggacctagctcaagaagatctagagctagcatccaggcttgagatcgatatatacgatcatatatacgatacgcaccgatcgggaggtcgatcatccatggggaactgcttgaagctgcagcgcgcctccgagtcgtgggtcgacgacgacgagtgggaggtggacgtggtggaggggaagacggcggccggcgagaacgagaagacggagcgggtggaggtgaagatcagggtgaccaagaggcaggtccaggagctgctgcagcaggctgccctggacggcaaggggaagagggcgacggaaaaggtgctgacggatctgatcaactccggcacggtgtgctaccacgacgatcacgagacgagggggcactggaggccgtcgctgcagagcatcaccgaagccgaagagccttgacttcgatatgtaggacagttccatggatctcttgattatcatgtgcgtatatatagttgctgtatgtaggagtgcaggcataggtttttggatcgagattctattaggagatgtacagactgcagaaatgctggtagcagagattattt

SEQ ID NO: 100222 - DNA, 568 bp, Triticum aestivum
  unsure (1)..(568): unsure at all n locations
  Clone ID: PAT_TA_100222
gcacgaggtgaagctatttttccgccatctggatgatcctcatcataaggttgcacaagccgctttttctacgcttgcagagattattcctgcttgcaagaagccatttgagagttatgtcgaaagaattttgccacatgtcttttcccgccttattgatccaaaagagttggtaaaaaaaccatgttctttgactttggagattgttggtcgattatatgcaatcgatatgttgctacctgccctagtacgctcactagatgaacagaggtcaccaaaggcaaagctggctgttattgaatttgcaaacagatcgttcagtaattacacggtagattctgaaggttatagtaacagtggcttccttaagctatggctttcaaaattggcaccgttagtgaatgaaaagaatgcaaaactgaaggaggcatctattgctggtatcatatctgtgtattctcagtttgactcaacggcagtgttaaattttattttaagtttatcagttgaagagcaaaacctattgaggcgtgccctgaagcaaaaaacacctcgtattgannnnngn

SEQ ID NO: 100223 - DNA, 617 bp, Triticum aestivum
  unsure (1)..(617): unsure at all n locations
  Clone ID: PAT_TA_100223
gcagaggaagatcgggaccctcgcctctatcatctcgcgccactgctaggcaccgagcccacgcgctcgtagatccgcgatcctcggcagtcagattcgacttggatgggcggaagagcgcgctgtctggatctaggtggcactacctcccttagagctggtcgtgggagaagttgtcacgcatcttgcggcctgccgccgccgcaggtcagctgctcccgccggccgcatgccccactccccggccgccgcgctccgctgtggcgctgctgactctcctgctcgtcgcatggtggcctcatctccccggtcgcccttctcatttgcatccagccacagctctgcctccttcctcatgtcgctcgagctgttccagtgaggctacaaagcagtctactactgtatgagccggagctatttactggtctgatttctcctgggtatactctactttcgggtgtctgatctgatgacaagaatattgtgtcgacggtcaacctggtctgtaaattggaactggaagcaatagctctccaggcacgcaatgcagagtataaccccaaggtaaaatcattatcctaatgcattcttcatgatgtttgctttttctcttannn

SEQ ID NO: 100224 - DNA, 207 bp, Triticum aestivum
  unsure (1)..(207): unsure at all n locations
  Clone ID: PAT_TA_100224
aaaaaaaaagaaacctgtcttggcaaaaaaaaaaacctaccttttctaaaggggcaccctggccctgggtctttcgctctttggtgacccacacttgggactgggcgtccaccccacaacccttttatttaacccacgttacgcggaccccgcgcaaagcaccccacccctagtagtaaaaagtagccctcnnntccagtccnctcc

SEQ ID NO: 100225 - DNA, 610 bp, Triticum aestivum
  unsure (1)..(610): unsure at all n locations
  Clone ID: PAT_TA_100225
gcacgaggatcatccggattgaaggtcctgaggttgcacattgacaactcggattccagttctgaagttaaaaagcaattgccggagctagtgcctctccaaaaaagtcagttgatgcctgctcattacgggctaatggctggcgctattgccctgacaggcgtcgtgctcgtggtttacttgaagcgctcaaaagtgtgagttctgggaggcacacttaactccaatccttacctctgtgactaacgtctctcagaagactcaaacgccccggcacttcagctggccaaggatgaagaactgaacccctcacaaaagacaaagaaaaagaataaggaaaagaacgaagaactgaagatcatgggctatacaccagatgcaccgaagtccagaaagtaatcagctgaccatctcaattttttgcataaatgagtttagttatataccgggaaggaagcacgaaactattgagtttagttatactgggaaggaagcacgaaactatgatatatattttcagttcatnnnagttccatgaatgcggtgaaacatgtgccttttgtaaccanctctaccacaaatccggnnnnnngnnnantnnncnnncaat

SEQ ID NO: 100226 - DNA, 590 bp, Triticum aestivum
  unsure (1)..(590): unsure at all n locations
  Clone ID: PAT_TA_100226
gcacgagggagaaacacagtgtgtgatatggcgacgtcatggctcctcagacatccttgtccacttgccaggccatggaccagaacaaggaatgatataggtctccaagtgaccggcatcacctactgctactggagatgcagtagggccagtgcaggaggaagaatcatggcggatatgagtatgaacaccaccaactgcacggcagaacccgcccttctaccccaagctgatgctgccgaccctcctcctagagttagtaagagaagcccgcgcactggccgtggcgccgccgttgcggctaggcacgaagaggagggcacagacgacgagtggctcatgtacctggagccggcgaagctagaggtgttcgaccatctggagccttgggcggaggcgaacgtggtgccgctccttaagcctgcggaggtggcgtggcagccgacggacttgctgccggacctggcgtcgctgggcgccgacggcttccatgcggcgtgcttcgacatcagcgcgcgcgcggccggcctgcccgacgcnnacctcgtgtgcctcgtggggaacatggtcacggannnnncactnnnnga

SEQ ID NO: 100227 - DNA, 583 bp, Triticum aestivum
  unsure (1)..(583): unsure at all n locations
  Clone ID: PAT_TA_100227
gcacgaggctcttctccaccacctcgctcgcgcaccttgcctgctgctccccgctgccgcgccgccgtctcgccggagtcccgcattatcgcgcgcggtgagagaatacggcggaagaagctgacaccgtggcaacaccgttaggacttaggagaaggcttggaggttcatccctgctagaagaagctgacagagtggcaatatcgataggagaaaaagtgctgcttggagactcatcgctgccggaagaagctaacaggatggcaataccgtcaggggaaggcttacagcttgtacattctccgcagcctcagcagcaagagatcactattgaccatagtccacacatgtcgattgatgagttgctcaaggtgataaaaggagccaatggcatgccggtgctgtttgtcccctccagcaatggccgactggcagcggtagccgtggatggccttcagagtctggtgcctgccaatcgcagcaacgaagagtctgctgaaaagaagcacgaagctttctgttcctggttgatgctcctgatgtcactggtcgccaccgtcacctnnnccgcanngnntcaccc

SEQ ID NO: 100228 - DNA, 611 bp, Triticum aestivum
  unsure (1)..(611): unsure at all n locations
  Clone ID: PAT_TA_100228
gcacgagggccgcaccccatgagcaggcgccgctgatgggccggccgtcccatgacaccgcgacgtccacctcgccgtccggctcgtgccgctcgtccaagcgcggcccgcggctggaccgccgcaacgcgtacaagagcatcggctacgagtacgaccccgccaagctcttctgcagctacccgccgtccccgtcgcgggcctcctcggcctcggcctccgccgcgccctcggtcgccagctccgtcgacctcagcagcttccgcatcggcggcagcggcgatggcggcggcgacgtccagctcctctgccgcaacctcggcctctccggccccgaggacttcgccatctccctcaccgactgggaggcgcacaaggccttccgctcctccgcctantcctccgcctccagctccccttccgcgcgctcgcagcccgaccgccccgtgcgggagtccccgctccgccacgaggccgtcgaggagccgaccttgcccgcggacgctgatttcgagctcccggccaaggaaactgccagggacccgccggttgaggcgccagtgcggccggcatggttggatccgccggagccagcccgtccggatgtgann

SEQ ID NO: 100229 - DNA, 620 bp, Triticum aestivum
  unsure (1)..(620): unsure at all n locations
  Clone ID: PAT_TA_100229
gcacgaggccaaaacccgcggaaattcggcccctcccccgggagatcgatccatcgatcccccgtcccatcccctccccccgtccccatggactcggcgccgccagccgccggcgccggctacccggagtcgaccgactcgtccccgcgcagccgcggcggggactcgtgggacgagcccttcccgtcctcggccgccgcggcggccgcgggcggcgggggcgggcggctgcgcctcatgtgcagcttcgggggccgcatcgtgccgcggcccacggacaagtccctctgctacctcggcggggagacccggatcgtggccgtcgaccgcaacgcctccctcgccgacgtccacggccgcctctcccgctccctcctcgccggccagcccttcacgctcaagtaccagctccccaacgaggacctcgactcgctcatctccgtctccaccgacgaggacctcgacaacctcgtcgacgagtacgaccgcgtcgccgccacctcctcctccggcggcgcctcctcccgcacctcccggatccgcctcttcctcttccccgccaagcccgagtcctcctcctccctcggctccctcctcgacgactcatccaagtccgagnn

SEQ ID NO: 100230 - DNA, 606 bp, Triticum aestivum
  unsure (1)..(606): unsure at all n locations
  Clone ID: PAT_TA_100230
gcacgaggcatagctcagatgatggtggcggcgtaggcaccagaatctccacgggaaaccaaaccatactctgccacgagacgcgagacgagaagatctccaatccgcagctgagccgcgaatccaagatccacacgaccgcacaccccaccctccccacgggcccgcctccctccctttaatcaccgccgattggatcccatcaccaccagcccaatcaccatcgtcatcgcctcgcattgaccaatccatctcttccggcgccatggccatggcgagccgcaagctgctactcctcccgtgcctcgtcctgctcttcgtcgccgcggcagcggcactggtcgaggcagcccagccgcagtccacgtacatcgtgcacctcgcgcccgaccacccggcgctgtccctgacccccgcgcgcggcggacgcaacgcgctgctcggcccactcctcggcctcccgcgccgcctgagcgcgccgcggccnngcctgctctacacctacgcgcgcgccnncacgggcgtggccgcgcggctcacggacgcgcnnnnngcgcacgtcgcgnnncagccgggcgtgctggccgnncancnnnnnnaggcgcg

SEQ ID NO: 100231 - DNA, 594 bp, Triticum aestivum
  unsure (1)..(594): unsure at all n locations
  Clone ID: PAT_TA_100231
gcacgaggagagagacgagcatcatagctagcagagggcatcgatccatccatggaggtcgcggtgagctcctccgatggcgtgatgggtcccctgctggggaagcttgccgacttgctcgccggcaagtacggccgcatacgaggggtccgcggtgagatcctttccctccaagctgagctgaccagcatgcatgccgcgctcaaaaactacaccatgctagaagaccctgatgtccaggtgatgtcgtggatatcgctgctcagggagctggcctatgataccgaggattgcatcgacaagttcatccgtcgcctcggcaaacgtgggcgtcggggaggcttcaaggagctcctccgtgacaccactcgcttcctcaaatcgctcaattctcgctgtggaattgccgaccatatcgacgagctcaaggcccgcatcaagcatgtcaaagagctcaaggattgttacaagctgagtgagattctgtgcagcaagaccgagcatgcggccgtggatcctcggttgtgtgctctgtttgccgaggaggcacaccttgtgggtgtggagggtccaagnnatgatcttgtcaagtgg

SEQ ID NO: 100232 - DNA, 615 bp, Triticum aestivum
  unsure (1)..(615): unsure at all n locations
  Clone ID: PAT_TA_100232
gcacgaggggaggacggcgcgccaccttaaagattcccacgccgcaagctcgctctcccgccacgaggttgatcggtgcttttaattcttccttcttgcagaaggcctcttccgctccattgcaagcttgaaccgaggtgctttcgtggggatggcgcggctcggcgctgtcgtcgtggtgttcttggcggccgcgctcgcggcggagggcattcttgacccggtggacttcctcgcgctgcaggcggtgcggcggtcgctcgacgacatgccgggttccgccttcttcgacgcctgggacttcacggcggacccctgcggcttccccggcgtgtactgcgacgggaacagggtgtcggcgctcgcgctcggcgacccgcgggcggggtcgccggggcnnnnnnnnnnnntcgacccggcgctcnnnnggatgtccgcgctcaccgagctatcgctcgtgcccggccgagtccagggcgagctcccggcttccctcgcctcctgctccaacctccgcttcttggccgtcagcaagaacctcctatccggcgggataccggacggcattggcgcgctgtccaacctccggacgctcgacgtcagcttcaancagnt

SEQ ID NO: 100233 - DNA, 244 bp, Triticum aestivum
  Clone ID: PAT_TA_100233
gcacgagggcagaacgagactctggccacgccgtcgccgtgcagcacggacgccggccagaggacgccgggagagtggcagctgggtgcgggcggagccggcgaccagctgtgggaaggcctgcaggatctcatgacgatagatggagaggacccgtggttcgcgccattttcgagtccagcataggtgtatttgagatcttgtatataaggatgattactgatagtgacagaaaaaaaaaaaa

SEQ ID NO: 100234 - DNA, 622 bp, Triticum aestivum
  Clone ID: PAT_TA_100234
gcacgaggcataaacaatagatgagcacacgggattgtgccagccagcctacttattaagctagcacacgtgccagctgcaaattgattcatctggaggtgcagatcgatcgatgggttagatttctggagcttcttgtctctgcaaggccttcatacaaacactagttatcatgcctcgagagtatatttatccggacaccatcgaagatgcggtgcaaacaatcatcccttatcttgaggatacgatcagtactgcacacaaggccatctattttgatggatggcaagggttgggtgcttcagcggtgcttagagccatagccaaagaccctccgtcgtctctgctgaagaaattcaacaagatagtccatgttgattgctcgaggtggaaaagcagacgagcactgcagaggacaatcgcacaagaactacagcttcctcaaagggtaatggatatgttttatagacaagatgaagaagatgatttcaaaggggtagacgaaagctccagggatgagatacaagatgttggggctgagatccatcatgcattaggacaacacttttgtttattggtattccataatgggagtgacaacacagttgacttcagcgatttt

SEQ ID NO: 100235 - DNA, 341 bp, Triticum aestivum
  unsure (1)..(341): unsure at all n locations
  Clone ID: PAT_TA_100235
gcacgagggggcagtctaacatgcccccccccccccccccctgtgcgaannnggtccggcgaccacagccnnnnnnctgcgtnngggcggtgcggcggccacaggcaccaaaatnnnggngtgtcgggcgacnnngnnnccgantncactccctgcctgtggcgccctctcgggttccccacgccccctccccctccaccgcgggatccagcgtgggatccagatctgtcaccgcgtcgggtgcttcgctcgggctcatcggtcgtcccggagtcgcctgnncacggggccgcggctatgggcggagcgcggggcgnnnnggggcccannngcgtgagctn

SEQ ID NO: 100236 - DNA, 346 bp, Triticum aestivum
  unsure (1)..(346): unsure at all n locations
  Clone ID: PAT_TA_100236
gcacgaggcggcacgagggctgaatgcataaaaaacatgcacacggccaaaagttaaaaaagtccgaggtattgggttttcatttttctcttagaattgttcatgttgatgctgttgtcattttttctgaaatttagacaactctttccgcttaataatagtttaccgatttcagtgcatcctatgtatgtttgactgattggtcgtcctctcatccagagttactcaatgttgcatttgtgtgttcctttaccccactttgcttattttttggtcatgtgagcgggttgtgtgttattnnntccatcgtcatttagtatgctgatgttttttannntgacttcta

SEQ ID NO: 100237 - DNA, 538 bp, Triticum aestivum
  unsure (1)..(538): unsure at all n locations
  Clone ID: PAT_TA_100237
gcacgagggtggcagcttacatgccgccgtcggttgacatacatagttatactacttcttcgtttgtaaccgtcggcactggtggtagtgtggacacaactcgtcaagctggaccgaagcatcttctttgctaaaataatacgacaaatcttcaaattcacaagaaaaaaaaatcttgtttcacaggaacattcaaccattcagtgtcattcatttcccgtccacgacaagacgactacggtgacttcgtaaatcccaaaatgatatgccggctcagtttgtcgaagatgctcatagaggtaaggtgtgcttgtgtgtgttcataggggtgattgtatgcgtgtatgtatgaacccttgtgtctgtactgtgttaagaaaaaacattcacagtgtcattcatttccccccaagatgagccctttttgttttttctcatttgtagcatcaaaactgtttctttgtatgtgccaacttagcccttctttgtatgtgccaccaaatgcatttctcctttcnnnnnnnnnnannnnnnnnnn

SEQ ID NO: 100238 - DNA, 619 bp, Triticum aestivum
  unsure (1)..(619): unsure at all n locations
  Clone ID: PAT_TA_100238
gcacgagggcccaccatcgcctactaggagccggtgctccgactcgcctaggacccaaatgtgatccgtccaagcacgagtcccaagtcctggccatccagccggcccggacgctgaagaagggaggtgccaccaccacccgcaccctgccatcgaccgccaaccgcagtgccgtgacgacaccgacgacctgtgcaaccaccgcgccaaccaacccgaagccacggagagccccactcgaaaccggaacctgccaccggaggagatccctagccaggttcagccgccaccgtgggagaagagccgagcgccaccgaggagcaggcggccagatctggtcataccagatcgagaccagacggccgccccccccctacgatgcatccatgcgcagcagcggtcgtgtagcacgcacgccccccccccccttcgtcgcgtcgccagctggagaacgcctgcccgcgccagcctccaacaactaaggtgagaggagatcccgccgtgccgacgccgccgggcaaagcgccccggcggcggcgaggggaggaggtgggannnnnnnnngctaccggcggctctagggatgccctcccggtcgcccgtgggagcgactcngctc

SEQ ID NO: 100239 - DNA, 557 bp, Triticum aestivum
  unsure (1)..(557): unsure at all n locations
  Clone ID: PAT_TA_100239
gcacgaggcacaccgggagtagtatcagtggggctatagagaggccagccacggcactcgcagactgcagagatccagagagaccatgccgctccttctcctgctcctcctactcggcctcgccggcccccgccgggcggcggcggcggacgagcagttcgtcttcgacggcttcacgggcgcgaacctcaccatggacggcatggccacggtgacccccaacgggctgctccagctgagcaacgccaccagccagctcaagggccacgccttcttcccgacgccgctgcagttccaccgggcgcccaacagcacggccatgcggtccttctccacggccttcgtcatcggcatcatcggcgcctacgacacgctcagcagccacggcatggccttcgtcgtcgccaagagcgccaacttctcctccgcgctgccgggccagttcctcggcctcgtcggctccgccaacaacggcaacgccaccaaccacctcttcgccgtcgagttcgacaccatcctcaactccgagttcaacgacatgagcgnnnnnnnnnnnn

SEQ ID NO: 100240 - DNA, 250 bp, Triticum aestivum
  unsure (1)..(250): unsure at all n locations
  Clone ID: PAT_TA_100240
gcacgaggctctctccctcaccctccttctccacctccggccgccgccacggacaggccggcgtggtggtgcgccacccgcctaccgcctcatcacccannnnnatacaccactccnnnacccatccatccatcaacgccaccaactccaccaccacaccaccgaacgccgacacacctacagacatctacctactgacgctgctctacaaccttcttacccaaacttnnnnctgnnnntaaccttctac

SEQ ID NO: 100241 - DNA, 285 bp, Triticum aestivum
  unsure (1)..(285): unsure at all n locations
  Clone ID: PAT_TA_100241
gcacgaggcccttctcccccctcctctctcccttgcagagggtatttttcttgtgccaggcttccttcctgtactagagctcctctattcctcttcctcttcttcttcttcttcttcttcttcttcttcgtccctgacctgcctaccaccacctcatctctgtttctttccctttccccccgctctccttctctctccgtgctctttctggctgtcctggcctcccatctttttcaccnncctctcatgtactgatcattccatcannnnnattccctatgcnnn

SEQ ID NO: 100242 - DNA, 604 bp, Triticum aestivum
  unsure (1)..(604): unsure at all n locations
  Clone ID: PAT_TA_100242
gcacgagggaaacacctcccaacctctgcttgcttgctcccgccgctccaaagcttcgcgtcgcctgcaccgcaccggtggtgcacagtgcatcagctgctcgagctgcggcggctggttccggcgccggcgagcgggtcgaccgagagggcatttccaagatgaacgcgcccagctcgtggctgttcgcggacaactccaagtacagcacccgcgcgcggctgatcttcatgggcctctccttcgccatcggcatcctcaccttcctcgtctacctcgccatctggtacacctgcagccggcgcggccgccgcagccgcgacgccggcgcgggcgcgggggacctcgaggccggcctcgccgcggccgcggccgagcgcggcatgagcgacgccgcgatcgccgcgctcccgaccttcttgtacgaggaggctgacgacgtggactgcgcggtgtgcctcgggcagctggaggccggcgagaanncgcggcggctccccaagtgcgcgcatttgttccacgccgagtgcgtcgatgccnnnntgcgcgcgcactncacctgcnnnatgtgccgcgcccccgtnnnccccnnnnnnnnnnnnnn

SEQ ID NO: 100243 - DNA, 615 bp, Triticum aestivum
  unsure (1)..(615): unsure at all n locations
  Clone ID: PAT_TA_100243
cgatgagcgcgatgagcggcgccatggagtggcacgcgtggctgtcgtcggcgaggctggagccggcgctggtgcacgagtacgcgctggtgctggcgcgcaacgagctggaggccggcgacgccgcctacttcgaccacgacttcctccgcagcatgggcatcgacgtcgccaagcaccgcctcgagatcctcaagctcgcgcgccccggccccggagagcggggccgccgtagtacgtcctcctccgccgcgccgctctcgggcctcgtggccgccgtcggccgcgtcgccaggtacgtgcgcgcgctcgtccgcctccgcggggagtcgtcgtcgtcgtccacggcgctcgtgctggtccccagccagcagcagcagccggacggccacgtcgacgtgggccgctcgagcttcgggcgctgcaaggcgccgaagcggaccaggtccatgcccaaggcgccaggtacgacgtgcgcgcgctcgtccgcggcgagggccacgcgggcggccggcgggtgcaggggcgccgcgacggtgcacgccatgagggacgccgagagcggcggcggcggcggcgacnngactgtccagtgggaatgcctgttccannnnn

SEQ ID NO: 100244 - DNA, 313 bp, Triticum aestivum
  unsure (1)..(313): unsure at all n locations
  Clone ID: PAT_TA_100244
aaaattatcnnnccggggtgctgcnnnnnntcaccaccccatatggcatctnnngcaaaatatcaataagctaactagtggggtattttgggaaaacaaaaacatgctgaaacaaatttttaaaaaattcaactgatgaaactgaatgaacaagggcggatttaaaaacaaatcacagcaggagttgaggggaaaatcgtcaagtcgaataagttaaaattggccaggtnnccccccatgttgtcttttcctttcaaagtncngnantttcttaacccgttcattaacacctgatgnnccccccctnannttt

SEQ ID NO: 100245 - DNA, 565 bp, Triticum aestivum
  unsure (1)..(565): unsure at all n locations
  Clone ID: PAT_TA_100245
gcacgaggatctccccagcccccaaccaccagagcctcctcctcccctccggcgcatcgacgacatggcccgcaccaagcagacggcgaggaagtcgaccggcggcaaggcgccgaggaagcagctggcgaccaaggccgctcgcaagtccgccccggccaccggcggcgtgaagaagccccaccgcttccgccccggcaccgtggcgctccgcgagatccgcaagtaccagaagagcacggagctgctcatccgcaagctccccttccagcgcctagtgcgcgagatcgcccaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcctnnnctgctgcacctgcaatccgtgttnnnntgagttcatcggtggaaaatagtggtgtttcagaatgtgcgtcgtgttanntncatgttaga

SEQ ID NO: 100246 - DNA, 614 bp, Triticum aestivum
  unsure (1)..(614): unsure at all n locations
  Clone ID: PAT_TA_100246
gcacgaggcagtcccctccccgacctcaccgggaaacctcccatcgaagcgaagccaaggctctctcctcctcctcctcaagatgcagatcttcgtgaagacccttaccggcaagaccatcacacttgaggtcgagtcctctgacaccatcgacaatgtcaaggcaaagatccaggacaaggagggcattcccccggaccagcagcgtctcatctttgctggcaagcagctcgaggatggccgcacccttgcagactacaacatccagaaggagtccaccctccacttggtgcttaagctccgtggtggtatgcagattttcgtcaagaccctgaccggcaagaccatcaccctggaggttgagtcctcggacaccatcgacaacgtcaaggccaagatccaggacaaggagggcattcccccggaccagcagcgtcttatcttcgccggcaagcagcttgaggatggccgcacccttgcggattacaacatccagaaggaatccaccctccacctggtactcnnncttcgtggtggcatgcaaatctttgtcaagaccctcactggcaagaccattaccctggnnnnngagtcctcggacaccannnnncatg

SEQ ID NO: 100247 - DNA, 571 bp, Triticum aestivum
  unsure (1)..(571): unsure at all n locations
  Clone ID: PAT_TA_100247
gcacgaggctagtctccaccaccccaccaccactcgccagcaggagtggcagctctcccgtccatggctgtccctgctccatcccacacacctgctgcacttgcctctgcgagcatgtactgactgcctcccgtccactcccttggcgccatctctcttgtctcgctgctcgctggctcgtctgtgcgcgtgtgcgctctgctctgctctgctctgctgcctccactccccccatccctgtcgggataggccgcggctgcatgccccgctgcacgttcacgcttccgtttgttcgcctccggtgcgatggtggtcgccgcgcaatgattcttgcttggtcgctagcttccctcgtcgcggagtgaggtgacggggccggccggagggagcggacaaaccggcgagcagttgcctggccctnnnatagggagagagaaaggtctgtggtggccaagaagcgtcaagggaagcggtggggctgcctgcttgcttgggctgcgctggtggtgactgnnnnggcgagagagcgtgcggcatggannnnnatctcaagatgcnnnnctcttnnnac

SEQ ID NO: 100248 - DNA, 577 bp, Triticum aestivum
  unsure (1)..(577): unsure at all n locations
  Clone ID: PAT_TA_100248
gcacgaggctggctctctccatcccaatcccgacctaccgtcctctctcgcacgccatggacgccacggccaccggcgccaaggggaagaagggtgcggccgggcgcaaggccggcggccccaggaagaagtcggtgacgcggtccgtgaaggccgggctccagttccctgtcggccgcatcgggcgctacctcaagaagggccgctacgcccagcgcgtcggcaccggtgcccccgtctacctcgccgccgtcctcgagtacctcgccgccgagctgctggagctcgccgggaacgccgcgaaggacaacaagaagagccgcatcatcccccgccacctgctgctcgccgtcaggaacgacgaggagctcggcaagctgctggccggcgtcaccatcgcgcacgnnnngcgtgatccccaatatcaacccggtgcttctccccaagaagacggcggagaaggagggcaaggcgcccaagtcccccaagaaggccgccaagtcgcccaagaannccgccaccccgaannnngcttaagagngatgcgatctgtatcgnnnnnnntgtgtgctnnnnn

SEQ ID NO: 100249 - DNA, 597 bp, Triticum aestivum
  unsure (1)..(597): unsure at all n locations
  Clone ID: PAT_TA_100249
tcagactaagtttttgaaagaaaccgcagttcattacaatgccaattatggatatggatccatcttgctgtgctggatgaaggactggatgtaataagaattgcatgtgacaaacaggtgcctcctctatgcataaatttttgctaatatcattgaatttctcctgagatctctctagacctttccaaatgtattttagttaagtgtttgtattaactagcagaagaagggatgcaaatggaaagaatttgagatgcataaacataaaagcactaaaagatttgcttgaagcaaagatgtctagccggcatacatatggcaagaaccttcagagattgtcttcttttcagctgctattcagatatatacttgctcatanntcacaactcatgaagttacttcttttggttttgattttgaaatatatgtgtcataagtcacgactgatgaagttacttccttttggtgaaagtctgaatatcatcaaggtcttggctgagnnnctgacatttcgganagttctcgtctgtatagattagttgatagaatgacagtttaagtttattgaagctcttctctangnnnnngggttctgcn

SEQ ID NO: 100250 - DNA, 275 bp, Triticum aestivum
  unsure (1)..(275): unsure at all n locations
  Clone ID: PAT_TA_100250
gcacgagggagattagttttgtctgtttgaaccgtcggtccaaacatataaaccatgaataatcatcggagtcnnnnctatgagttgtaggtgctcttctaacataattaacataacaggatactctgattcccattttgtctcttgtagtaccgaatgctatgtgtttttactaaagtcatcagatagctaactaactatgaaatgtccactcggaacttggccatgttcattgggttactgttatctgtttatgtaatgttcacangcacaaa

SEQ ID NO: 100251 - DNA, 479 bp, Triticum aestivum
  unsure (1)..(479): unsure at all n locations
  Clone ID: PAT_TA_100251
ggggcgcgaaccgggttattgggaccccatgtttccggggcaaattaaccccccaaaaacacaggccttttttttgtagcagggggggcattactttccccccgatctaccttttggccagtttattacacattttcctttcacaaatcaggcccgatttcttacttaacaagccaaaacccttanaggcgggcggcccaggggcaaaacaacccggggctggggtaagggccccggaagattccttccncgaaggggtgggaaggggcccccctcaaggggacccccccccaattggggtacccccacgggggggggcccaccctggatccccccaccccccaannnnnnttgggggtgaaattggaccggcccccccccccccaaaacgtttttaacgggccctggttgaaccccaactggttgggggttttggggaaaggcctgggccccccntaataatcgngggacatgaaccc

SEQ ID NO: 100252 - DNA, 530 bp, Triticum aestivum
  unsure (1)..(530): unsure at all n locations
  Clone ID: PAT_TA_100252
gcacgaggcacagacacaagcacccttcacatatcagacggacgccggtgataagagccacgagcgagctagcgagctagcctccgtccgcgtcgcacgcactacacgacaccgccgcggtagaggaggctgtgcttgccggtgcggtgcagtgccatgccggaagcgccgatggcggcgggggcgggggcggggggcggagtctcctgggaggaggcgcaccgccaggtgctcgacctcatcgagcgcgtgacccggtgcgccggggagatacagcgccaggtgctggtggagatcctggcgcagaacgcgccggccgagtacctgcgccgcgtcggcgtcccgggcgccgcccccggcgccgacgacgcgttccaccgcctcgcgccgctcaccacctacgaggacatcctccccgacgtcatccgcatcgccaacggcgactcctcgcccatcctctccggcaagcccatccgcgagttcctcactagctccggcacgtcgggaggggnnncggaagctgatgccca

SEQ ID NO: 100253 - DNA, 525 bp, Triticum aestivum
  unsure (1)..(525): unsure at all n locations
  Clone ID: PAT_TA_100253
gcacgaggcccaaattccccaattaaaccaaccctcgttcgtccgtccgtccgccgtctccgtctccgtctccggcggcgccaccccgccatgtcggtggacgactgcttcgtcccgttccactctcctctccgggagccgaccgcctacgaccgctgggggaagggcccgcaaccctgctggtcgcagctcgatctggacaagtgcgcagcgggaggctcgcaagggcaaggcggcgccgacaggcgcatcctgcagtttctgaaccgccccctcgccgtccccccaaggcgcctgccgccgccccttggcccgctgcccaagctctcggagccgccctcccagncccagcacaaggagaatttgccagaggagccaaagcagcgccaccctgctcaacctgcagtctcatccgctgcttccagggggaggtacgcaaggagtcgggctgggtgggcttccaaggacaggagtaccccatgcatcnnnngccgagctgcctgtgctnnnnnnagaggagcgctc

SEQ ID NO: 100254 - DNA, 636 bp, Triticum aestivum
  unsure (1)..(636): unsure at all n locations
  Clone ID: PAT_TA_100254
gcacgaggcctcgtgccgaattcggcacgaggctcaagggtcgtactaaaaaaagaactacatcagcaagttgattcaataatccatcctctgttttgcccctcgttggttagttattcagttatgggccggggtgggagtgggagtattgatggctgtttgttcttcacaaagttttgggtgaaagagcaaattggcagcaattagtgagatcctactggtggtggtttgcgagtacacgtgaataggaaatcagatgagatcaaatctcatgattccatctcgtcccggtcctcggcggacggggtgtcaggaggaatgagtgtgaagctcaagaccccatttaatggagccgtctatgatgcatgcgatgaggtcttattattgatgatgccatgtactacattttgtttgcataatccatcacctagcatgtatttgttataaccgagcaccgcaacgaatctgttatttaccttnnnnngattcaagatttatttctgtacatagcagtgattagtggattactgtcacacgctcctgnnnncatccatgtcnnntcagtgaatttctggcgtacatgtgaatatctcatgtatatacaatcagtacactcacctgaangnnnatgnnnnn

SEQ ID NO: 100255 - DNA, 342 bp, Triticum aestivum
  unsure (1)..(342): unsure at all n locations
  Clone ID: PAT_TA_100255
gcaaactaaaaacctgcctttcncaacaaatcaatctcaggggccccggagtttacccccccccggaataaaaatcccgtaattaaaccaccaacaaatcattggtccctcgggataaaaatctgaaaccaccaaagccatggcccggaacaaaaaccttttgctaaaaaacccccccttttttttttgaagggnaccctgggaaccctgggcccggggggggcctttttttccnnccccttgatgacaccaacaacaacccgttgtttcatgtcccccccnncgaaacggcccaaaagaggggagggggggaaaggccccccaaccctgggcctgggggga

SEQ ID NO: 100256 - DNA, 589 bp, Triticum aestivum
  unsure (1)..(589): unsure at all n locations
  Clone ID: PAT_TA_100256
gcacgaggctttttcccggcgagcaaggaggcgtgctcggcgtgcgggatggacgggtgcctcgggtgcgagttcttcggcgcggaggccaccggcgcgatcgcggcatcggacgcgccgagagcggcgaccgctggcgggccgcagaggaggcggaggaacaagaagaaccagtaccgtggcgtcaggcagcggccctggggcaagtgggcggcggagatccgcgacccgcgccgcgccgtgcgggtgtggctcgggaccttcgacacggccgaggacgccgccagggcctacgaccgcgccgccgtcgagttccgcggcccgcgcgccaagctcaacttctccttgcccgagcagcagcagcagcagctaggcggcagcggcaatgccgcggccaagtcagacgcgtgctcgccgtcgccttcgccgcgcagcgcggacgnngcggaaacaggggacctgctctgggacggcttggtggacttgatgaagctggacgagagcgagctctgcctactgctcccggtcgacaacactttggataaatttcacacacagggaaagagacnatcnnnntcnnnnctacctc

SEQ ID NO: 100257 - DNA, 606 bp, Triticum aestivum
  unsure (1)..(606): unsure at all n locations
  Clone ID: PAT_TA_100257
gcacgaggcataccaaaccctcgcgtcccaccatggccgacggcgccgcctccctcctccccaccgccggctgcgacggcgaggaccgaatcagcgccctccacgacgacctcctctgcgccatcatctcccgcctctccgtcacggacgccgccggcaccaccgccctctccccccgctggcgccacctctggcactccacaccgctcgtcctcgacgatgtcgacctccacgagtccgcccgtgacgccatagtctcctgggtgcttgccgaccacccgggccccttccgcgccgtccgcctcgccggatgcaggttcgcctccctggaccatgacctcgccgagtggccgcgcctcctcgtcaccaagggcattcagaaactcgtcctcgtcaacaagcacatccagccccagcacgcctccccgcgcctccccgctgaaatcctccgctgcgactcgctccagcgcctcttgctgggcttctggacgttccccgccgacgtctcncnggcgccgacgtctttcttccccacctccacagtctcaatatgataaggattgacatgagcgatcatgacctggagtgtttgattgctgcnnntnn

SEQ ID NO: 100258 - DNA, 611 bp, Triticum aestivum
  Clone ID: PAT_TA_100258
gcacgaggccgggtcccaaactggattgaggaactccataatctccagagcttgcatatcactgttgataagctaaacaacgatgatgttggtattcttgcagggttacccgctctcatggacctggaattaacgttcagtagagccctggaagaaacaattgtcatatatgggacagcattcgcaatcctgaagcggtttgttgtctactggactatcatgccacaactgaccttcgaagccggagcaatgcctaagctccagagcctctctctacctttgaacgccagggggtggaagaaggacgagagcgccacacccacagagattctttcaagtgctattcgcgttgattttcctcgctccttctcaaccagcggctccgctccatccatccatccatccacgctgctgctgctacttccctccaccatctgaacccccctccccccacaacctgcacctacgtcggctgttcttctatctctccatcggaaaactgccgctgctccattgcttcagcaggtacatcacatgtataacgagagagcaaagataaatacttgtccaaccagagatgactggaataatggtgagcgcttcaaccgggg

SEQ ID NO: 100259 - DNA, 608 bp, Triticum aestivum
  unsure (1)..(608): unsure at all n locations
  Clone ID: PAT_TA_100259
gcacgaggtcccaatccgctgaagccgacggcgacgccgacgccgtgcccctccacttccttcgtcgccgatgccctgctccccaaccggcaacaatgtctccccttccttcaacgccgcctacttctactgcgtgaacacgttgacctgacctggatggtgcagactacctggccaccactgccgctggctcgcgtagaccaagatgaatgcaacgcgatgtggcgcagtcgtgtccgtcggccgagcacaaatcaggggttgacacctgcaccggcaagccgtccccagcgcatagatcgccgacgccctgctcccctcacctccttctcctccctccacctgccatctaaagttgaatcggatccagtggtctcccactgccgctaatgtcctcaacgacccactccaacgcaagggtgcaggtcgaggtccatatgtccccaagttctcccatgtttgccttcggttccacccaggctagggtgtgaaagggcatgtctcaagtgataacctggtagaaaaagcctctgnnncagagtctgattctgtgtttcagccctcagactctaatttctacaacacgtcaacgcatgttcattggtann

SEQ ID NO: 100260 - DNA, 528 bp, Triticum aestivum
  unsure (1)..(528): unsure at all n locations
  Clone ID: PAT_TA_100260
gcacgaggcccatccctcccctcgtctcccacatcgccgccgccaccccgccgatcccatccctcccgatttagatccgaccccgccgcccgcgcccgggcgccaccacccgctcctcctcgcctcccggaggacgtctgtcgctcttccttcgcccgtcccggaggcctcagtctgcgccctccgttgcagggccgccgcgctcgtcctgccctcggcgccgcacctccaccgccatctccgctggctcctcgccgacgcctccgcccttccccgtctagcgcaccgcttgggaacgagcactggaaggacctggtggtcaccgtccgggacgacgtgctcatcccgcggcccaagacggaggccctcgtggacatggtagccaccaccgactacgagcnnnnntcctggtcctgtccctcgtcgtcctcggcggcggcattacgnnntggctccatcnnngtgccctgngtcgacgtctcgatcagcttcacggatcgccgtcttcacgngnnnggtcgannnngn

SEQ ID NO: 100261 - DNA, 223 bp, Triticum aestivum
  unsure (1)..(223): unsure at all n locations
  Clone ID: PAT_TA_100261
gcacgaggcctcattgacctcgcacctcacctcacctcctgcttgtcgtcccactcgagcctcgcatccagaacgaccatctgacccggaatggctgcggcggcggagggcgtggaggcgttcctggcgacgtgcgcggcgtcgggcgacgcggcgtacggcgccnncaaggccgtgctggagcggctggacacgccggccacacacgccaaggccaggcgnn

SEQ ID NO: 100262 - DNA, 558 bp, Triticum aestivum
  unsure (1)..(558): unsure at all n locations
  Clone ID: PAT_TA_100262
gcacgaggggaggaggccggttaagccgccggccgcagaaccggcaagggagcagaaaaagaagaagccgctggagcgggcgacgccactgccgccggcgcccgcggtgaccgaggcgctggacgacctcgagcaggagctggcccggagctgcctccaggacctgctgcacgcgctggcaccgccgcccagcagcctgccgctgcccaggttctccctcgtcgtcaaagcgtctccccactccgccacggccggcaaggtggtgccggctgccccgtcctgcaacgctgaggcggccaccgccgacggcctccgccgcctcctccgcctctagtatcatgacaattaccctgccgcaccgcgcgcacgtacgtcatctcggtgtaccgttgctactgttaattatttccctccaatactattatttcctggctgggaaaatacgtactactagtagaagacaaggaaagaagagttatgtgatgctggagcgatggtcggtggcgtgacccggtgaccgtgatgtgggcgttgaatggacnngntgcgtgcnnnnnn

SEQ ID NO: 100263 - DNA, 547 bp, Triticum aestivum
  unsure (1)..(547): unsure at all n locations
  Clone ID: PAT_TA_100263
gcacgaggccgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgatggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcnnngagctggaggaaaa

SEQ ID NO: 100264 - DNA, 612 bp, Triticum aestivum
  unsure (1)..(612): unsure at all n locations
  Clone ID: PAT_TA_100264
gcacgaggcccacactcccgattcccttcctctcttctctccccttctctctgtccagggaggaacaacactccagtccctctcaatggccaccgttgcttcaaggattccccacagagctcttgatccagatcagatcgaggccaccaccgagctcctcgagcgcctcctccttcctcttcgccctcgcgcacgccgccccaccggagctccagtgcctccccgcagcaccttcttctccctgctttctccttcttcctctcttccccccctgcatctcagtcctttcgttttcccttggtcatgagcagaggaagcatacaggaagcctcgccgctgccgccaccacggccgtcgtgccgccaccgccttcgagttctccggctgttggcgaacatcttccctgcgaccggcgccgcggccctctgcctcgcctccatcatacgcgaggatgatgacgacagcgccgtcatcgacccgtcccggtccgtccctcgcctcgctcgcgtgggatgcacatgcgcatggactgccggtcaagcaagccgtccctcgccggcgggagcgctggtgccgctagcctaaagcatctgatggcggaccnnncgttnn

SEQ ID NO: 100265 - DNA, 514 bp, Triticum aestivum
  unsure (1)..(514): unsure at all n locations
  Clone ID: PAT_TA_100265
gcacgagggaaaatctcattctccaaacaccagagcgtcgcagcagccagatccgcagccagcccagctccgatggcccgcaccaagcagactgcccgcaagtccaccggcggcaaggcgccgaggaagcagctggcgaccaaggcggcccgcaagtccgccccggccaccggcggcgtcaagaagccgcaccgcttccgcccgggaaccgtcgccctccgggagatccgcaagtaccagaagagcacggagctgctcatccgcaagctccccttccagcgcctcgtccgggagatcgcccaggacttcaagacggacctccgcttccagtcctccgccgtctccnnnnnnnnnnnnnnnnnnnganncgtacctcgtcgnnntcttcgaggacaccaacctctgcgccatccacgccaagcgcgtcaccatcatgcccaaggacatccagctcgcacgccgcatccgcggggagcgcgcctaggctgttcgtccgnnnnnnaccnnnacggtt

SEQ ID NO: 100266 - DNA, 557 bp, Triticum aestivum
  Clone ID: PAT_TA_100266
gcacgagggttaattttcacttggacgacagcgatctggagatttctccacgaccaagtgaatgtgaaaatcgagatcgaagaaatggtgccactgtgagagttcaacacataccaagtggagttactgccgaaagctcaggtgaaagaagctattttgcaaacaagctaaaagccgtgagcaggctgaaagcaaagctactcatcataacaagagaactaagactaccagacccgaagatgatcggaaaacaagccgtggaggaaggatgcaaccgcgagacgagacgatatacgtttggcccccaggaattggtccatgatctgaacacgggcatccagttgtcagacctcaactcggtcctggaaggcgacatcgaaccgttcatcaggggtcgtattgtttcaagacatggatgacgatatgcaagaatttgtgtgcagttctgtaaatccatttttgctgatacaaatatagcacattaccagaggatgacctctgtaacatgggtcacatttcaagccaaaaaggcaaatataccaggtaaaaaaaaaaaa

SEQ ID NO: 100267 - DNA, 598 bp, Triticum aestivum
  unsure (1)..(598): unsure at all n locations
  Clone ID: PAT_TA_100267
gcacgaggggccgccgttctccgcggtgctcgcgctggccgtggcggccctggccgcgctcaggggaggcagaggggcgccgccgtgcagcaggccccggcccaggcagcagcccccgtcctcaaccccaaccccaaccccaacaggtagatcagcatttagcacttttttggacaacggtgatggagaacctgaaagatcaggatcgggaaggcatcaaattttatgaattccttcaaaagtccgcgttagttgatcccatggagttgatgaagttcggtatttcggatggtctcgctgcccagcgaccagaggaggttatcaagctcagaagcgtgactgatgtgttcaataacatgatgccaatcaggcaaaggtacctgtataaatacatacatggtgagcggggtagtggagagattactaagatggagaaacgtttgaggaagggagtagaactatctgatcagaaaatacaggatatcnnnnatgggaacgcattctgccctcaacggcccaagctcttcnnnnctacccgnnnncccttaagaactaataaatgtgtcctgcaagacnnnnnaaaccatggcgtcttcnn

SEQ ID NO: 100268 - DNA, 594 bp, Triticum aestivum
  unsure (1)..(594): unsure at all n locations
  Clone ID: PAT_TA_100268
gcacgaggagcagagcccgcatcggtgaggagatgagcagcccccgcagccgccgctcgtcggcggcgccgccggaggacgaagacctcctctcagagatcctcgtccgcctccacccgctgccatcctccctcccccgcgcattcctcgtctgcgagcgctggcgcggcatcgtatccgacgcccgatttctccgccgcttccgcctccaccaccgccgcaaccctcccctcctcggttgcttcgtccaaggtatctcccccatccgtttcgaacctacgctagaggcccccaatcgcgtcccggaagcccgcttctccttcccgattgacgccgcacacacctatgtgatcctcggatgccgccatggcctcatgctcatcttcctctggcggcggaaccagctcctggtgtgggatcccgtcaccggtgaccggcaccacctagacgtccccccagggtttgacaatgaggagaccaggatcaaaggaggggtgcttcgtnnnnngggagttgcccaccacttccaggttgtcttggtgggcaacagcgacatacaacttacacaggctgtnnnntcggtgtactcgtcgg

SEQ ID NO: 100269 - DNA, 546 bp, Triticum aestivum
  unsure (1)..(546): unsure at all n locations
  Clone ID: PAT_TA_100269
gcacgagggccaatccccacctccacctcctcgctcctcactcacacacctccagcccctctcagctcaaccacactagtaccaagagcaagccaagtctccatggacgcggtggagtcctcctcgccctactcgccgccctcgctgcgccacaagctgcggaccaccgtctgcggatgcttcggctccccgtcgtccccgggcagcggcggcagggccaggtggaggcggcgagtcgcggccgcgggggatttccggtacgacccgctcagctacgcgctcaacttcgacgacggcggcggcgacgacggcgacgccgacgcggaggacgccgccttccggcatagaaacttcagctcccgcctgccnncctcgccggtgccggcctcccgagccgtcgcaatagcctgaactgaattctactagtaccgatcgtcctttttaacttttttgtacgtagcttctnnctctctgatttttcttctgtatgaacgagactgaatcagtnactacatctgtaaaagcagnnnatacgnnnngggaaac

SEQ ID NO: 100270 - DNA, 481 bp, Triticum aestivum
  unsure (1)..(481): unsure at all n locations
  Clone ID: PAT_TA_100270
ctagcagagacgcacaatactcttcttcctttcttgataatcgagaagcaggctatgtcaatcatcatataaaactgaaagtgcatccacccctgcattggacacaaaatgaagcagcgggggcagtggagatggctacacatatacggtgatccctatgaatctgtcctgtatagggaggcagttgagcctagccgcagagggaggggattctgaaggagaagaaggaggagggcaggtggccggtcctccggatgtagtccgccttctccgacgtcctcgccgcgccctcgttcagcgtcgcctccgccaccgcccgcttctcctcggccacccgccgcgccgtcgccagcttgctggccagcttctcctgcgcccgcgccttcatctgctccnacttcatctctattttcttcatctacagctcggcttttctcttctcgtggttcnnncaggcctnnntctnnncctacnnacgctt

SEQ ID NO: 100271 - DNA, 532 bp, Triticum aestivum
  unsure (1)..(532): unsure at all n locations
  Clone ID: PAT_TA_100271
gcacgaggtcgcgacggccggacctgccggcggccggccaacggcgaggcgccgccgccgccgccgcaaggtatccgtccatcccgccccgtcctctccaccaccgccacgccgtcctgacgatcctccgcctcgcaccgcagcgccgccggaatgcctccagggaagaggcacgggagcgcgccgccgccggtgcgcggcgcggaccgcatcggcgcgctcccggaccccatcctgcagcacgtcctctccttcctcccggcgcaagcggccgtgcggacgtgcgtgctggcccggcgctggcgccacctctggagatccaccaggggcctgcgcttcgtgggcctcgacggcgcggacgccgtccagggcctccgcaagttcatggaccacctgctggtcctgcgcgaccgcgccgccgacctggacgccgtcgagatcangttcgaccggttctcggtnnncgacgacgaggcctacgtgaacctctggacccgcttcgccgtcacgagnnnnnnncgcgnnntcaccg

SEQ ID NO: 100272 - DNA, 514 bp, Triticum aestivum
  unsure (1)..(514): unsure at all n locations
  Clone ID: PAT_TA_100272
gcacgaggggttgttttgcaagtgaatgttggtgttagcaatatggtagatccagtgcttgaagttcttcaatttgagaagtgtacatcaagcaattatatgcgtgagaatcttgtaagcgggcttcctaatggttatgaggatccttgtcaggagctgcttagctggttgctccctttagatcgcacactacctcctcctcgttctttatcacctcctactctcaatcccagtatatcacacaagcaatctttttctgcttctgggtctcaaatattttcgttaagtcatttccgaagctattcaatgccttcatcctcctttgcccttgcccagcttcccaacctaagatcacccccaatatctgaaaatcaagaatttgtgcctgaaaagcctgcaaaaacacctgatgttataaatgatggacagctttcctttnnnnnagttcctttggagcctgaacggtattctgtacgctgtggtctnnnnnnngtatatctaccanggaaaagat

SEQ ID NO: 100273 - DNA, 507 bp, Triticum aestivum
  unsure (1)..(507): unsure at all n locations
  Clone ID: PAT_TA_100273
gcacgaggtcccctcctccggcctcagatcaccgcgcgcaaggtcccagctgagagctcgcaggctggggatcgatcggtcaacacggaggatctagcagtcgtggaccccaccgccgatggcgccgccgttagcagactgcatcgaggccggcgacggtgacccgtcctctcagtgaatacaccgccagattattactagcagtgagtctcgcacaatacaacggtggcaacagtttctagcttgttgggattggaataactcactgtagctttgagttttcacggccatggagggtgctaaatccaacaagagagcagcagaagctcgtcgagaggggcagagcagcgtcaagaggcggaatgtcaacgtggcagtggacggtggtaaatcaaacgggcgacaagcagaagtccggcgagagggacagagcagcgcaaagacgcagagtgtcaatgtggcggtggatgggtggtgaatccaatgcgcnnncagcacaagttcggc

SEQ ID NO: 100274 - DNA, 314 bp, Triticum aestivum
  unsure (1)..(314): unsure at all n locations
  Clone ID: PAT_TA_100274
aaaaccgggggccaaaccccaaattaaagggtttaaacaaccccnnnnnaacccttttggaacccccccccaaaccaaccccatttttttttttaggggtttggccccccccccccaaaaaaaatttggcccaaaaacncgttcgaacctttgggggccccaaaatggggcccccccttaatnnncccaaaaacctaagncttttggganacccttcccttttggccctttttggggccccctgccccctnaccggaaccccnnncccggggggcggggccaaaatctttgggcccnnnnnccaatctcccccc

SEQ ID NO: 100275 - DNA, 576 bp, Triticum aestivum
  unsure (1)..(576): unsure at all n locations
  Clone ID: PAT_TA_100275
gcacgaggccgatctcttccaaggcaacaaatcaatgggcgagacgatttaggatttggcacgcgatgtctcggcggtgcttctgcaggccaacggtgagcaagaaggggccgccatggacatgcagatatgtatgctgcgcgagcgggtgcgcgagcagatggacgaactagtgcagagtttgatctcggcagacagggaacaagagaagcggcaggcgatccccaagttgcagtccatcgccgatactatcgggcggctctgtgtagcccacggccaaccgccggccatcgaggagttggatgacgagaaggtcgaggtgacggacagcggcaaccagctgaaggagaaggaggagaaagaggaagatgatgagacggacatgagcggcggggaaggcggagtcgcggaagaatcggcggtgggcggagacaatgcagccgccgagaccaacgcgtccacggagaccaaccgggcannnnncnaagtcgactacgccgagtacgnnnaggaggcattcgctcgcttccgcnnnggcnnnnagcatctctacggcaacaccaaaaacagcttcga

SEQ ID NO: 100276 - DNA, 631 bp, Triticum aestivum
  unsure (1)..(631): unsure at all n locations
  Clone ID: PAT_TA_100276
ctcctcagaaagaaaagaaaagaaaaatcgcgccttgcgctccgccatggccgccgcctccctcctcgagcccgcccgcttcctctccccgcaccacccgcgctcgctcccgcccccgccccgccgcggcccgcaccacctccgccgctcgccacttcccgcccacgcccgcttcccgcgcctccgcgcccacccgccagcccccatccccccgtgccccgtcgccgccgagccggcagcgaggccgccaccgccgcacccactactcgacgcgctcaagcggtccctcctcgactcgctcgcggcgctcaagaagcccgcgctggcgctcctcctggccggcgcgctgctcgcggccgcggcgccccaccacgcggcgctggcggcctccggcggccgcatcggcgggtccgccttctcctcccgctcctcgcgctcctccccgtccccgtcctacgggtacaccgcaccggcgcccaggatggggggaggctactcctccgcgcccttctactcgccctcgcccttcgtgtccgtcggccccgccttcggcatcggcttcgggggctcgggcttcctcctgaccctcgtgggcttcgccgcgttcctctacctcggnngcntcctcacc

SEQ ID NO: 100277 - DNA, 507 bp, Triticum aestivum
  unsure (1)..(507): unsure at all n locations
  Clone ID: PAT_TA_100277
gcacgaggctagaatcgatactgcttcttggctacttctctttgttccatcccgggaatcaagcagttcttcgatggggtaagagccccacaatacttcataaggtgtgcgacctgccttttgctttcttcagcgatccagagttgatgcccatcttgactactgctctcattgccgtctgctacggctgtgatcagaacagaagtgtggtacttcaagaaataagctcagatatgatcagtactttgcttaggtcctgcagagcgtcagtactggcaacttcagattccgtcgccgcggatggttctggagccaataattccggtgacagcactcatatcttgccggacatcagaaactcactatctgacatgtcgatacggtcaagccgcaaaggcgtgcggccagtgttaggaaaaggcgtttcagggcccgtcaagttaaacagaaacaagaatcaaaaggatggcagaggagcacgagctggtgannnnnnggggcccttga

SEQ ID NO: 100278 - DNA, 599 bp, Triticum aestivum
  unsure (1)..(599): unsure at all n locations
  Clone ID: PAT_TA_100278
gcacgaggaaacactcgccagtcgccattgcccaagcccgactagtcgcaaaatgcctgtcgccgcggtgccgagctcgggtgagcaggtcagaggtgcaccggcaccgcatttggtcttcgtcccgagcgccggcatgggccacatccagcctttctgccgcttcattaccgccctcgccaacatgggcgtggaaatctcagtcgtgaccgctctcccgaccgtcacggaggcggaggccgaccacttcgccggcctcttcgctgccttccccgccatccgacgcattgacttcaacctcctgccgttggacgacgccaccgtcgccgagactgaccccttcttcctacggtgggaggccctgcgccgctcagcccatctcctcggcccactcatcgccggcgccgcgccgcgcgcgtcagccatcgtcacggatgtcaccctggcttcccacgtcatccccgtggccaagaacgagctgcagattccatgccacatactcttcatctcctgcacaaccatgctgtccttcctcgcctacttccccgcctacctcgacagcgccaacgcggaccacctcgtcggcgnnntcgncgnnn

SEQ ID NO: 100279 - DNA, 203 bp, Triticum aestivum
  Clone ID: PAT_TA_100279
gcacgagggaggcttgctggtaatgcagtgcgccaaacgctggtcaccatcaccattggcagatgcatgctgcctgatctgcttgaggagatcagttgcactccgccggtcatcaatggacacagactgagcacaatgaatgaggagagtctccaagtcgaccacctccttcttgggctgtttgacttgtttcttgccacggc

SEQ ID NO: 100280 - DNA, 615 bp, Triticum aestivum
  unsure (1)..(615): unsure at all n locations
  Clone ID: PAT_TA_100280
gcacgaggcagacacgacaagggcgacggcgatggcctcgccgaagctcgccgccggcgacggcagctacgacttccacctccgctcgctctccgccgcatcacgggactccgccgcggccgccgatcccgcctccgaccccaacctcctccagtctgtgcggatggtgttcgagatgtgcaaggaggccaagggggccaacgacgagatggtggcgcgggcgttccccgtgatgaacaagctcttccagcgctgcgccgccgcgcccacgctctccacggcctccaccggcgtgctccttctgaccattctgcagttcttcctggactttggggaggcggtcttgcacgacgctgatggtagcttgaaaaccttcttccgctcttgcttaagtagggagttttcagaccctattgtcgcagaacgcacgcttgaattcctgatagcgaacaagacgaagatcttgaactgcttccccaccctggnnncgcagttcttcccattgctgctgaagttgattgcatcaaatggtgataggttgnnnnngaagttctcagaagtgctaccattgatgatgtcagcnnnntcttttcttcctctcttcctgtcccnnnn

SEQ ID NO: 100281 - DNA, 557 bp, Triticum aestivum
  unsure (1)..(557): unsure at all n locations
  Clone ID: PAT_TA_100281
gcacgaggcaccgcccatcctcctccgccgccgccgagaagactccaccctccccctcgtttccgctcatttgccttcttccccgggaagctttctttcaaccaagatttcagccgtggcgtggtgagcctctccgttctccggtgcctggttgggttgttggggagcaatcagcatggcagacagcagcggcacaaccgtctttgacaacctgccggagtggctcgtcgtcgatgagatccttgtccggttgccgcccaaagacatactccgctgccgcgccgtccgcaagtcgtggctcagcggtacttccaccaacacattcatccttgaccatcaccgccgtcagccctcgctccccatcatcaaacaccataagggcatctgccnnntcaccggagcctccaatgaacgaaagatacggcccgtcctccagtatgcacgccatttttcaagcaacaacgttacactccacgccgcctgtgatggcttcctcatcatgtcgcagcagcgatccgatttccgcatctgcaacccgnnnnnnccgcagtgtgctt

SEQ ID NO: 100282 - DNA, 553 bp, Triticum aestivum
  unsure (1)..(553): unsure at all n locations
  Clone ID: PAT_TA_100282
gcacgaggcaacaaccaaatcaccctccctctcccaccaccaccatatgaaaatttgaagatctcgatagtgaaatatttagatcaatccatggccaatttgatttgatatgacgatattgtggtgtgggtagcctaagcatttcgagcggtgtcatagttgagagaattttctagattttgttaagcatcagtgtcttttttctggttgttatgatttgtgatctatgggcgagttcaccttaaatgtaggtttgctcaaaattgattggaatcaaacttaggaaggactaggtgttggaggcatataggaagatttatgagcaattttccatggatcatgaagcactactctctcacgaagtagttctatgtcaacatggtgtaagatgaaagtgaagagtgaatagtcactatatcttcacctaaaagttgaaaatattaataatgtggcaatgtaataattacacttacctttgcannnnggtttgtggcatttcaattattgtaaataacacatatttaaatatttactacnnnnnnnnnnnnnnnnn

SEQ ID NO: 100283 - DNA, 409 bp, Triticum aestivum
  unsure (1)..(409): unsure at all n locations
  Clone ID: PAT_TA_100283
gcacgaggccccgtcgtcgccgccgccgccgccgccctccctcgtcgtccctccgccgccaagtggacggagagtagcagatccagtaccggccgatcccctctgcacccgccgtttccctccgcctctgccgtggcccgagcaggagcaggagctcctccagctgccgtggccattcccctcctcccctgcccttggcctccgcccccgcagttccggacgctattcaggtccgcaggagcggcagctccctgcagttccaggcgctgttcaggtcatccaggagcgggagcggcagctcccctctgtncnnntgatgcacgcagctctcctctgttccttcnnntgaagctctcctatgtccttacttcttagcacatacgaatagaaattgntnantnnnntagag

SEQ ID NO: 100284 - DNA, 584 bp, Triticum aestivum
  unsure (1)..(584): unsure at all n locations
  Clone ID: PAT_TA_100284
gcacgaggtccgagaaaacactgacggcgctgaatgattctgacgacgatgcgatgcaacgccactctgaccgaccaatctcagggctgcccgggcgcctacagcgaggccgccgccaggaaggcctacccgagctgcgagaccgtgccctgcgagtacttcgagaccgccttccaggccgttgagaagtgggcggctgaccgcgcggtgttgccgctggagaattccttgggcggcagcatacatcgcaactacgacctcctgcttcgccatcggctgcacattgtgggcgaggtgcggctggcggttcgtcattgcctgctcgccaaccgtggcgtcaagattgagaacctgcggagtgccatgagccatcctcaggtgagttggaccgttttatcagctcatccccaaccctgtttgattcacctgtttaaatgctagctgttcctttcttataattgtttttcaggctcttgcgcagtgtgagcaaacactgacgcagctgggaattgaacatagagaagctgttgatgatacagccggtgcagccangcaaattgcagaagnnnatctccaagacacnn

SEQ ID NO: 100285 - DNA, 541 bp, Triticum aestivum
  unsure (1)..(541): unsure at all n locations
  Clone ID: PAT_TA_100285
ttcggcacgaggcctcgtgccgcttcaatcgtcgatgtgtgcactacattgatgcgccgtcgtcaggtaagttaccgaatgcaaattcagcatgtgaagccatcaggctccctgtgtgtcttggttggtattattgcaacccttggcaaatgtgaagaggagtgatctaagaccatgtcaaacctcagatcacattttgatccaaccctctacaaacagtaatctctttctcctcccagtatcaaggtttgacaccgagtctggtcatgttttagatcacttctcttcacattttatcaagattactgtcaagaaaaccgcgtgacaggggtgcatccagtttgcgggctcgtggtgtttatgtcccttgccgtagttcatttgggtagcagttgtacatgtggtatgtgcttatgatttctggtggattcatcatatttactgtatgcctgtatgtagcacatttctttgatgcacagaactgtaccagtcttgttattagtctataagattatnnnntgatctgtgtaaaaaaaaaaaa

SEQ ID NO: 100286 - DNA, 607 bp, Triticum aestivum
  unsure (1)..(607): unsure at all n locations
  Clone ID: PAT_TA_100286
ctcgaccagtgcggcggccactgaccaccggccgctttcccctccgcctccggcattctcgtctccggcgattgcctgctccccgccaccgccctcgcgatgttttcctcaaagctgcgccccgccgcctccagctccggcgacctgcccgtggacgcgctgtgcgaggtcctcctcctcctcccggccaaggagctctgccgcctccgcgccgtctgccccgcctggcgcgccctcacctccgacccgctcttcgtcgcggcgcacaagtcccgccaccgtactgcgctcccgctcctcgccatgggctactgcgacggcagtggggtcaatggcgttgcgatttcggatctgtcgggcaacgtcgtgaggaggattccaagcaccgggtatgaggttgttagggtgaacactgcgtcgggtgatgccattggccggttcacaagcaaggacnnnnagcatctgtgttgtgcgcacgcggctagacctcgtctgtttcaactggaatttcttttctgggtnnnntctgggtgttgaacccagccactggagctaccatcgacttgccattgggcttctctgnnnaaattgcgcatgagctagnnnn

SEQ ID NO: 100287 - DNA, 283 bp, Triticum aestivum
  unsure (1)..(283): unsure at all n locations
  Clone ID: PAT_TA_100287
gggaaaaaaaaaattttcctttattggcccttccccaattggggccaaaaaaaattttcaattatacaaggccttcctgaaggattccccccctttttttcccccccccggtaaacggggttttataaaaaaaaatttttccttatgggccaaaaatttngnttcccacccaaccccatngaaatggttgnaccggttaaacgggggggaaaaaccggcggggggggaaaacttttcttaagggtttcggggggggcccggacccaatttccccttttatgaa

SEQ ID NO: 100288 - DNA, 528 bp, Triticum aestivum
  unsure (1)..(528): unsure at all n locations
  Clone ID: PAT_TA_100288
gcacgagggttctccccagatcccgatctgcgctgtcgattgttctcgccgtcgccgcctccgccgccgtcgcctcccatgtcgaggccgccgccccctttcacgccgcaaaaccctacccccgcccccaaccctgggggtcccgcctccactctcccggcttccttctccaacctccagatctcgcgcgctccaccgccatctgcttccgccgggccgccgccaggggatggccccgtgccgtcgtcgatccgaggtccgcaggcaccccctcctggcgcccgcccgttccctggcagtccgccgccgccgttgcagccgggctcgctcttcgcccggcctgcggcgccggtccagcagtcccctccctttggcggtccacccgcggcgtcgctccagcagtcccctcnnnnnnggcggcccacccgctgcgcagccgttgcagccgcagcagagatctcccttcaacgnnnngccgtccgtgctgnngctgcaggtgcagcgagcnnnnnnngnnnnnnnnnnntg

SEQ ID NO: 100289 - DNA, 577 bp, Triticum aestivum
  unsure (1)..(577): unsure at all n locations
  Clone ID: PAT_TA_100289
gcacgaggagaaaacctcccaccgccggctccggcggtggtgacccctccgctgccggtgtcgtgcactgtccttgcgcgccgcggtggtggtggtgggcctgcgttgcgtggacagagagggaggcagcagtaatggcgcgttaaatgcgcggcctgccgaggttttaatggcgggaggacgaggcgtgtcctgttgtgcgcaggccttgacgcgttcgaaattttcaacccgaaattttgaccaaatgctcatcgtggaccgcgcggtgcggtggtaaaccaagtcggtggccatctgagccgtccgatcagaaaacgaacggctctcggcgacgannncgatggaccggagcgttcgttttctcgtcggacagctcaaatggagggcagcagtggaacctttgccatgtgttcttctctaccggtagaaaactcagttatatagaagcagtgtgtttgagtttaagaagtcggcgtcctatttgtggtattatatatttgttcacaaatatttgtcaaatttttctgcaagaaaaagaatattcatcttcgttgaccggactaaaaaaaaaaaa

SEQ ID NO: 100290 - DNA, 524 bp, Triticum aestivum
  unsure (1)..(524): unsure at all n locations
  Clone ID: PAT_TA_100290
gcacgaggccactcacagggagagagaggagcagagccctcgcgccgcccctcccctatgcttctcctgctgcaagctccgccacaccggcgacccctctgaccgccttgccgccttccccacaccccttctcctccccgacttatcctcgcccgcctcctcatctacccagcgtcgcctcctcgccagctcctccgccggatgtcgcctctgtcagagcgacagcaacaacagctgcaccttccccgatgccatctcgtgctcgccttcgacccgattcgtcgccgccgccatccttcgtgcctccacgcggttcccctcgccgcacctctccgagcaggagctccgcctcccctgctccgcgccaaccggtgccgagcgccgctcctcccggcctcctcgcacccatccgccctgctagcattgcttagctctggccccgacctccgtctcgaacagcagtgttgcctgctgctattttgcccgtgctggtgacccctcgggccnnngngttgccattcgct

SEQ ID NO: 100291 - DNA, 536 bp, Triticum aestivum
  unsure (1)..(536): unsure at all n locations
  Clone ID: PAT_TA_100291
gcacgagggaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagctgtcctctccgtgaacgacggtagtggatcgggatgagttgattccgnnngnagtttgttcntnnntgctnnn

SEQ ID NO: 100292 - DNA, 445 bp, Triticum aestivum
  unsure (1)..(445): unsure at all n locations
  Clone ID: PAT_TA_100292
gcacgaggcacctagccaagcaaagcactgagagcaaaagttgttccactctctccattgcaaagcaaagcgaagccaccaaagccagctcctcgatctcggtgacgcgacctgcagcgggctcgacggtgatctctgccgtccgcattgccacggatcacgcggtggtggccatggcgaccgacaggaggatccagccggcccgcagcggcgggggaggcgggtcgtcgcccggagggggaggcgtggagcccgggctcgggaggcgcctgctccacgtgctgcgcgccgtctaccacatgctgcgccgtggcctctgccgcaagcgcctcatgatggacctccacctgctgctcggccgcggcaagctcgccggcaggcagttccgggacctcctcgcgcaccagccgctcgccgggggccacnnnnnnnncnnnnnnnnnnn

SEQ ID NO: 100293 - DNA, 508 bp, Triticum aestivum
  unsure (1)..(508): unsure at all n locations
  Clone ID: PAT_TA_100293
gcacgagggaagcacacacgaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcatatcgatctactactaccataccatgtaaccgcaacctgatcgagggcctttatgtacgcacctgacctgcatcagcagtcnnnngccatgccatgattnnnaacaggcccccctaaataaaacctcccttgattaacnnnnnnnn

SEQ ID NO: 100294 - DNA, 522 bp, Triticum aestivum
  unsure (1)..(522): unsure at all n locations
  Clone ID: PAT_TA_100294
gcacgaggattccctccgctccccactccgcagcagttccgcaccgacgccctcgccctcaccctccccaaagccctaaccgctcgcccgctccgccgccatgaggtccaaggccaacggagacaccgcgttcaaggcctccggcaagaacaagacggccaccggcggcgtcgccaagccgaagcgcgcccccacccccttcttcgccttcctggctgagttcaggccacagtacatggagaagcaccccgaggcaaagggcgtcgcggccgtcaccaaggcggctggggagaagtggcgcagcatgtcggatgaggagaaggcaaagtatggcggcaagaaggcagatgccccagcaagcaaggcggtgaacaagaaggagagcactagctccaagaaggccaagactgacgctgacgnnnnnngttctgacgttgnnnntgatggcgaggaggacgaggagtaaatagtagatgnnnnnacagcagtggtgcaaatcagcgtttgctgcnnnnnnnttag

SEQ ID NO: 100295 - DNA, 430 bp, Triticum aestivum
  unsure (1)..(430): unsure at all n locations
  Clone ID: PAT_TA_100295
gcacgaggggcacatgcacacacagtgagccccgcaaacacgtacgacgtgctcgccgacagagtttaccaaggcaggcaaagatggttcgtggcgcccattacggtggtgcgtgcgccgtcctcctggccgccgccgtcgcgctcggcctcggcgtccgcggcggcgcggcgcagctggacgacaagttctacgacgggtcctgccccggcgtccacaagatcgtgcggcgggtgctnnnnggnnncgcacaaagccgacgcgcgcatctacgccagcctcacgcgcctccacttccacgattgcttcgtccaagggtgcgacgggtcgattctgctggacaacagcacgagcatcgtgtcggagaagtacgccaagccgaacaacaactcggcgcgcgggttcacggtggtggacgacgnnnnnnnnn

SEQ ID NO: 100296 - DNA, 441 bp, Triticum aestivum
  unsure (1)..(441): unsure at all n locations
  Clone ID: PAT_TA_100296
gcacgagggcgattctctccctcccggcgttgacgcagctaaacctcgctgaaaaccggctctccgggagaataccgcccgccattgccaagagcgggaagctgcagctgctcttcttggagggcaacctcttcaccaaagagctgccgaacgtcgacataccatccctcttgtcttttaacgtctccttcaacgacctcaccggcgaggttcctaaaggcttcggcggcatgcccgccacgtctttcctcggcacgacactgtgtggcaagcccctcccgccgtgtcgaacaccatctacccaaccaccgtcccagcctcccacggttgcccccgaagccgcggtcgcgggaaacagccgcgggcgaggccggcgacacctcgccggcggtgccatcgcgggcattgtgatcggctgcgcnnngggctttctgcttatcg

SEQ ID NO: 100297 - DNA, 604 bp, Triticum aestivum
  unsure (1)..(604): unsure at all n locations
  Clone ID: PAT_TA_100297
gcacgagggtgcagggcttgtttgtgcctgtgcgtgcggggtgctcacgtctccggcctcgggcgttgccgttgctcctcgcgagcgcgctgccgccgatgacatgtgaactcgtcgccatccccgccccgcagcacgaaccagaaaaaggaagctttggcgccgcgctcctgctggcgactcccctgagccccaacaaaacccaggcaaaatcgaaaccgtcgccacccaaatcacacccaaaccctcgagccgcttcccaatccccagctccctactgcccctcttcccccgatggccgacgccgcctttccctctcccgcgatgttgccgccgtccgattccgacctgctcctgccgncaccgacgccccgacccccgaagccgnnnnnaggacccccaacctccccgacacccccgcctccgccgcggatccagagacccccttccccgacgccaacaccgcctccgacgccgacgtttccgccgtcgccccgctctacgcggcggccgtggatgacgccgnnnacgacgggatcaacgacccctcgggcgccnnnaggaagcacatgaccctcgcgccnnngnccccgnnaccaagaag

SEQ ID NO: 100298 - DNA, 614 bp, Triticum aestivum
  unsure (1)..(614): unsure at all n locations
  Clone ID: PAT_TA_100298
gcacgaggcggccgctccagagctcgcggcatcagcagcagtgaaggccatcgccgagtggggtcgtccggccaccgacatcacccacctcgtcgtcagcacaaactcagcggcccatgccccgagcgtcgacttccgcttggcttccctcctcggcctccgctccagtgtctgccgcacgatgctccaccttaacggctgctccggcggctgcgccgccttgcgcctagccaaggacctggccgagaacaaccgcggcgcgcgcgttcttgttgcctgcgtcgagctcaccattacctccttccgtggccccgacaaagaggactgcttcgacaccctaatcagccagggactgttcagtnnnnnngcnnncgccgtcatcgtcggcgccgacaccgtgcgctccgtcgagcacccgctgtttgagatggtgtccgtnncgcnnnncgtgataccggagagcgagcacttgctcaacatgcggctcgggaacagcggcatttgcggcaacatttccaccgagctgccacgcctcacgggggacaacattgaacnggtntttgctggatgcattggagccacttggtatccacgtcaaatggaatgacctctnn

SEQ ID NO: 100299 - DNA, 588 bp, Triticum aestivum
  unsure (1)..(588): unsure at all n locations
  Clone ID: PAT_TA_100299
gcacgaggcaaatttcctcaacagccttccccttccttcctcctccgctccgcctgcgccccagccgaacaagcacctcgccgcccgccgcccgccgcccgccgaccgcgggctcggatccggcccgcccctccccgcgccgtcgcggccccccgaccgagcgcgccatggacagcgacgacgaggagatgcgcgacgcctcctcctcctcctgctccgccgccgccgacgacgacggcgcggggttcgaggaggtggaggacgaagagaaggacggggtgatggtgatggaggtccggtggttcgaggtggacctcgactacgagtacgacgcgccgcgctggttcgacctcgcgcaggccgaggcccccgccgaggccgccgccgccgagctctggttcgccaccgcccccagctacccgccctccccgttgattgcaatgatgttggctgaagaccttgggctgccaaacctaagaagcatcacagttgcagatatagaggctgtgcgttgccctaaaccatctcaacgttgttctggtgcaactgaacaaagtatatatcgatcacatgtaccaaatgannnaa

SEQ ID NO: 100300 - DNA, 390 bp, Triticum aestivum
  unsure (1)..(390): unsure at all n locations
  Clone ID: PAT_TA_100300
ggcacgaagagtccctcggacnnnactcacnnnaccaannnacagcccacagcagacaagcacactagctagtttctgccatggcagctcgccgtgcccacgccgtggaggacttggccctgctggtggcggcgctcgtgctgtgtgcagcaccggcgccgggcgagggtgcgggtgctaactgcagccaggtggtgagctacctgaccccgtgcatcagttactccatgggcaaggtgaatgtgcctggcnnngnnnnctgcagcggcgtgcgtggacttaacgcgnnngctgccaccccnnnngaccncaagaccacctgcacctgtctcaagcaacaagcgagcggcatgggcggcatcaagcccaaccnnntnnnnggcattcgcg

SEQ ID NO: 100301 - DNA, 576 bp, Triticum aestivum
  unsure (1)..(576): unsure at all n locations
  Clone ID: PAT_TA_100301
gaaagcttgtgcgcccttcttttggagtaaataacaccactggtacttctggaaatgatctccaagggaatgccatagttgaagtgcgcccttcacatgaagaaaataacactactggtaattctggaagtgacctccaggggaatgccattactgaaaggaatcaaagccctgcttccatagttgaaaggaatcaaagctctgcctccatggttgaaatgaatcatagccctgctgccataactgaaaggaatcaaagccctgctgccatagttgaaaggaatcaaagccttgcttccatagttgaaaggaatcaaagccctgctgccataattgaaaggaatcatagccctgtcgaaactgatggtaacaagttcatcattgacctaaatgaaccggcatctgtagaaagtgatctggcagaggatggtagcattgcaccgtgtcctgttgctaccaacacacagacagaaaaatcctgtgaagtagatgtcaaaaagcaaaactgctcaaattcgnccggggtaatcaccaaacaagatgtacagtnnngacagtggtgcacctacagagnnn

SEQ ID NO: 100302 - DNA, 549 bp, Triticum aestivum
  unsure (1)..(549): unsure at all n locations
  Clone ID: PAT_TA_100302
gcacgaggctcttcggctccgtcctccaaaccccctcaccaagaaagcagaggtgaaccaaccagcgaaaccgtcatcaaattggtcgcgagtttgcgtgccgatctacctctaaccttctcctccgcattgcacctgcgaacggcgggcagatccatggcggcgctggcgtcaaggatggcgctgcagtccagggcggcgttggcctcgaggatggcgcagctgcagtccaaggcggccgaggcgacgaggttcgcggccaagcacgggggtgcgctgcagtccgaggcggcaagcttcgcggccaagcacggggccactctgcagtccaaggcgtccgaggcggcaagcttcgcggccaagcacgggggcgcgctgcagtccaaggcgtccgaggcggcaagcatcgcggccaagcacggggccacgctgcagtccaaggcgtccaaggcggcgagcttcgcggccaagcaagggagcgcgatgcagtccaaggcggccgaggcggcgagctccgcggccaagcaagnnnngcgagtaccacaagac

SEQ ID NO: 100303 - DNA, 577 bp, Triticum aestivum
  unsure (1)..(577): unsure at all n locations
  Clone ID: PAT_TA_100303
gcacgaggaaagagcaaggcacctccctctcgatccacctagcaagctagctacagtataattgaagatgaactgagttaaaatcaggcaggctcatcagagatcctcgacgatggccgccctaacccaaggcgccattgacgggctgctgggcgtcccggccaaggcgatcaccgacgaggcacaactgatcggcggcgtccccggcgacatgcagttcatcaaggatgagatgaacagcatgaatgggttcctgctgcacctgaccaagacggagggccagcacgacgaccaggtccgcgcatggatgaagcaggtgcgcgagatcgcctacgtcgccgaggactgcgtccagcgctacatccacgacatggtcccgaatgaagctgcttgttgtagatccctgggcgcccttgccgccatggcgcacctactcctcctccaccccaagaagtttcgtcggctccacacagggccgtcttngaaatnnnnnnngcccgggacgaaaatcgaaatagggctctaaatttccaaaaacaaaatacatataagtgaagacccaacgtaagtgaagcaa

SEQ ID NO: 100304 - DNA, 592 bp, Triticum aestivum
  unsure (1)..(592): unsure at all n locations
  Clone ID: PAT_TA_100304
gcacgaggctctctcgaccgaaccctcccgccgcccccgcccccaccccccacccccaccgccggccggcgctctccttcaccgcgagatccagcacttccagggccatcccctctggttcccgtccaggacgtcaccccgacgcagcatccccaccccgacggcccgacggccaggtccaccccgccgccggccggtgctcacctcgacggatcccgcctcaacctctgagccccctctccgacgccataaaccctaggacgaactgggctgcttccagccggccatactagcgcccagccggctagcagcctccaccgaacgtttctgaaatcgccacttggagttagaagctgcgtttggaagctgaatttgaggagttttagaagcttggaggggttcagaacaagccctgaaacttgtgctggaacaagcggccgagaggatgcaccgaaaccaagaccaagnnnccgtcgtgaagcatnnntgggaggtgatccaacaaggggtaattcattataagcgatgtggctctgttagtttccctgttgctctgtaaatttaaccagccttgtttcataccctggttcnn

SEQ ID NO: 100305 - DNA, 279 bp, Triticum aestivum
  unsure (1)..(279): unsure at all n locations
  Clone ID: PAT_TA_100305
gcacgaggctccgggtattattggcgatcgatcggtnnatcgcaacatgcatgggaggccnattcgcatttggctanntagcgcaggcgatcaacgtaacgatgccacgggaattgtcctcggacatgctcgtgaacatcgtactgcggctccctccgaacacccggcggctgacccgcctggtctgccggcactggcgcgacgtcctggacacgctcacggnnannatgctgagctgcgccaagcttctcgtccgcaccggcganggctccgcgtaca

SEQ ID NO: 100306 - DNA, 617 bp, Triticum aestivum
  unsure (1)..(617): unsure at all n locations
  Clone ID: PAT_TA_100306
gcacgaggctcatcaccacccccttcctccctccctccataccataggatgcctccacagtgtcacaggtgacccagcagcacaacagtcccttctcggcaagcggcggcagagccactgccactcactcactggaacgaagtgagagcatctatttatggaccataaaacatggctttggagaaagaaggcatcagaaaggacagttttagtaaagaataaaccaaatatatcagataaggaacaggaggagaagattgcacggctagagagatcactgcaaggcttaaatgaacaactttcatttgctcatgctgaatgcttcgagaaggatgctattttatccaagcaagcaaaagtagctgaagaagccatactaggctgggagaaagcagaggctgaagctatagctatcaagacagaacttgatgatactctacatcagaaagccatggttgagcaaaggatttgtcagcttgatgaggctctaaatgttgcagcggaagannnnngagttgttgataaaggatactgctcaaataatttcttgtgagnnnnntaaagtttggaatctagaacaaaatgtcgcggagaaagagaacataattgctagctnn

SEQ ID NO: 100307 - DNA, 602 bp, Triticum aestivum
  unsure (1)..(602): unsure at all n locations
  Clone ID: PAT_TA_100307
gcacgaggctggttactgtcggtgatctcatcatcaacatgtacgtgagatacttgttttcagaggggcaggaagagttggttggagtatatgcctctcagcttgaacgtgatgtttgcattgatttgtttgtggacatgatggaactaaggttaaatagcagcttgcataccatgtacaagcttttcctctctgctgtggagtatctgccattctcatctggagatgcatccaaggcttgttttgaagagataattgagagagttctttcaaggtctcgagaaacaaaaccccatcagtacagtgaagatttttctgatgttgtggaacagcatcacctgcaagcacttcagaaggcaatgatcattcagtggctttgcttcacaccgccatcctcaattccaggctttgagatgatcacagggaaacttctgatacgggcattgatgcatagcaacacactattcagagagttttccttaatatcaatgaggagagtccctgaactaccagtaggaccacataagttgcttgccatccttgccgaaccattgaaacaaaaggaaaatttattttcgctggaannnaagnnntgtctgata

SEQ ID NO: 100308 - DNA, 481 bp, Triticum aestivum
  unsure (1)..(481): unsure at all n locations
  Clone ID: PAT_TA_100308
gcacgaggagaagccaacaccaatcaaggcctccatccaatcccaagcaacctcgaagatgtcttgctgcggaggaagctgcggctgcggcagcgcctgcaagtgcggcaacggctgcggcggctgcaacatgtaccctgaggtcgaggccgccggcgccaccctcctcgtcgccgccaccgccacccacaaggcgagctccggcaggatggagatggcagcggagaacggcggctgcggctgcacccagtgcaagtgcggcaccagctgcggctgctcctgctgcagctgctagatcatcggtcatgcatgcaccgcgtgcctcatatctatgatctatctatatatccatctaccaccatgtaacgctacctgatcacggtctttgtatgtatgtacgcacctgcctgcatgagcagagcaggtgccatgccatgcatgtaaacccctaaataaaatctctcgtggtttaaccccttnn

SEQ ID NO: 100309 - DNA, 524 bp, Triticum aestivum
  unsure (1)..(524): unsure at all n locations
  Clone ID: PAT_TA_100309
gcacgaggctctctctctctctctctctctctctctctctctcactctccaaactcctcagcgcagcagcagacagatccttccccatccatcccaagggcccgcacgaaacagacggcgcgcaagcgcaccggcgggagggcgccgaggaagcagcgggccaccaagggtgcgcgcaagnnggccccggccaccgggggcgagaaaaagccccagcgcttgcgccccggcaccgtcgccctccgcgaaatccgcaagtaccagaagagcacggagctgctcatgcgcaagctccccttccagcgcctcgtgcgggagagcgcccaagacttnnagacagacctacgcttacagacctccgccgtctccgcgctccaggaggccgccgaggcgtacctcgtggggctgtgcgaggacaccaacctgtgcgccatccacgccaagcgcgttaccatcatgcccaannacatacagctcgcccgcnnnatacgtggggagagggcctnnntgtgggnncgctnntg

SEQ ID NO: 100310 - DNA, 413 bp, Triticum aestivum
  unsure (1)..(413): unsure at all n locations
  Clone ID: PAT_TA_100310
ctattaaaaaccagttagcgaatctttatttacagtaatattagcaagcacagtactatagtgttaaacatcataatcagaacaccaacatcaaggcatataatggacaatatatccacaacatcagcagttcggtagcaaccaacactgcttcacgtcgatggtattggcatcttcatggtggaccatccccatcagctccaccaccacctcctccgtcagctcttcgagcacagcaaccgctagctcggcaccgacgtcccaccgccccagcccagcatcccccctctcaccgggcatgtccaacggtacgaggtcgtgctccttggcctcaaacatctggttcaaatgtgctacgctggtagcacggtcggtnntcgcgggcgccggtgcgnnnnggcggcgccggcgtc

SEQ ID NO: 100311 - DNA, 582 bp, Triticum aestivum
  unsure (1)..(582): unsure at all n locations
  Clone ID: PAT_TA_100311
gcacgaggcactgattcatacagctagcgagtgagctgagcttagccaaccacacgcctcctagctagctcgccccggctttctcttcttgagcgccgaccgaccactcactcgggccatgatgagcggcggcaggatgaacccggcggcgagcgacgacttcccgttcgcggcaatgcagccgccgccctacgtcggcttcgaccacgccggcggaggaggccagcgccaccagggcgcgatgatgtacgacaacttcgactacgcggccaccttcggccagttccaggacgcgccgaaccaccagatgctgggcgctgccgcccagcggcgacggcgccggcgggctggtccccatggctccgccacccatgcccgggatgcagctgcagatgccgcctatgccccacgggatgcatggccacggcgacgtgtacccggctnnnggggatggtgaagcgcgagggaggcgccggggacgcggggagaatcgggctgaacctcgnncggcggacctacttctcccccgacgacatgatgggcggtggaccggatnnngatgcggtcccgtctcgnnngnnn

SEQ ID NO: 100312 - DNA, 591 bp, Triticum aestivum
  unsure (1)..(591): unsure at all n locations
  Clone ID: PAT_TA_100312
ctctcctcctccccccctgcccagctgacagcgacccgtcatccggccggacagcgacactccctcccactcccgtcgccaccgtcgccctccgccgccgccggccgccatgggctcctcccaccgccacctgatgcgcctgctcgacgaccccttcttccccttccccccgccaccacccacctcctccctctccctcacctcctgccccttcctcccacccccacccccatcccccttcgccttcccccaccaccccgacctcctcgacctctacctccccgccgaccccttcttcgcccctccctccccgcacgccttcctcctccacgacctcacggaccgcgtggcggccctggagctcgcggcccgcgcggcggccccgcagccggcgcgccgcaagtacacctacgcggccacggagcccggcggccgcaaggtgaagtggacggcggaggagaagccgcggggcgggggccgcgcgctcaagtgggaggcggagctcgcctcccccaacgacgacggcttcgnccgcaagtggcggtgggaggccaagtccaagggcgccggagggaagacaaagaccaagnn

SEQ ID NO: 100313 - DNA, 467 bp, Triticum aestivum
  unsure (1)..(467): unsure at all n locations
  Clone ID: PAT_TA_100313
gcacgagggcggggagtgagatagcgaggcagagagaggaagaggcgctcggggcagcggagcgattccttgctgttcatgtcgattccgggatcccccaccagtggagcttgatttctctctccttcctcttcgattccccactcctgctgttggaatttctcaatgtcttcttcatcgaggtctgcatgccaggggttttcttctgttgcaccttcttcggttggtgtagtttcagtttcatttcgtcgaatgtctgcagaatagttctgaagctgaggggtggagaggggtttcctttccttttccgtgcgtggcaagttgatggcaagcagggaagttgtggccagctgttagctgtggtccagcgagggtttggtggggctggtttactggaaaccgggtcannggttttgcctgacccgtttttgccgaaatacagaaaataaagtggctggtnnngnnnn

SEQ ID NO: 100314 - DNA, 583 bp, Triticum aestivum
  unsure (1)..(583): unsure at all n locations
  Clone ID: PAT_TA_100314
gcacgaggattgaggaactcccaagttctttctgccagcagttcatccaaaagtagaagcagccagaagcaattacctgttacttcaagtcgatcatctcagaaccctatttttatggattcttttccgaagttgaaattgtggtaccggcagcaccaagcttgcctggcctcgcctctctctggacttgctcatggaacacctgtacataacattgtagacagccttctcaacttgatgttcagaaaggccaacaaaggaagtacatctattggttctgtatctgggagtagcagcataagtaactcctctggtcctggtggtgacggttcacatctttggccccagttacctgcttgggaaatactagaagctgttccatttgtggttgatgctgctctaactgcttgctcccatggaagactatttccgcgtgaactggctacaggtctcaaagatctagctgattttctgcctgcttctactgcaacaatcgtaagctacttttcagctgaagtgacacgtggtgtttggaaacctgcattcatgaatggaacagattggcctagcccggctnnnnntn

SEQ ID NO: 100315 - DNA, 605 bp, Triticum aestivum
  unsure (1)..(605): unsure at all n locations
  Clone ID: PAT_TA_100315
gcacgagggttgcactgcataactggtccaacgtcttctcctttggcctcatgcttttggtgatcatcaccggcaagagactggtcctctccgacgagcccgacgaggtcgacgagactctggtctcttgggatctatactataaggacctggagcatctattctaaaatcatagctacaagttgttgctgtcgatggtgccatggtggtgcacaatgtctttggacttctctgagctgaaggttcattcaagattaaccaatgattcatattcgcatattcagaggagagatacccaggtcaagcttgcatggtctctgtttgttgtggctgctgacatggtcgatgctgaactggaattaaccctggttccagcttatttgaactattattattataacatgtcctaatatctaccattgaactggcaacaccattgaactgatgcttgcctacctagtgccagcgccagcgccatttccatgtccactatttattatctggtatatgacgatgagcagagtgaagcctagtattggtgctgcacatatagattgcttgccactttgctacctgaaacagagcctcgattccatttnnncgcn

SEQ ID NO: 100316 - DNA, 582 bp, Triticum aestivum
  unsure (1)..(582): unsure at all n locations
  Clone ID: PAT_TA_100316
gcacgagggctttttactctttttttccatggcaagtttttacttttaatggcacgacaatttttactttttttgccatggcaatttttactctatttttgccatgtcattttttacttttaatataagctgatgcatgaaataaatctctagttgaccttctgctagctgccatgggaacatggcatattttgtagaaaatgtttaaagatggtaaatttgagtataacataacatatatgtttggtgcagaacatggcaaattgttgaacacctgtttagtagatttcccatactattttactgtacttacattttggactcatgagcatgttaacttttttgtagcatggtaaaaggtcatggcattttttttcgtgcaaacgaacaatgtctattttgtcatagcaaaactagggcttttttgttcttatggttttttttttttggtaagcctctccttctgaacgatttggttcgtagggggctgcctatcgtaccgaactcctcgttcggactgggagnccaccagnnngaacgttcggttcttatcgatgtcctacttnnnttgcaactgnnnnn

SEQ ID NO: 100317 - DNA, 540 bp, Triticum aestivum
  unsure (1)..(540): unsure at all n locations
  Clone ID: PAT_TA_100317
gcacgaggcctctcctctttccccgttggtggcggcggcgcaaaaccctctcctctttctcaggcggcgaaggccagacgtagggcggcggatacagtgccgtcaccgggaagaggcggcgggcggcgggcggcgggcggcgcaaacccgggcggccaagatcacgacgtaggacgacagcggcacaaaactcgagcagcgaagggccgacgtagggcggcggatacagcgccgtcgccgggcagcggcggcgggacaagagaggaggagatccccacagcggcgcagatcttggcatggcggcaccacctccgccgccgccactccgttcacctcgccagcattccttggaggcaggtttatttaatttgtttttacgtaatactaataatatttatggtataccgatctgattaatatattttctagaatcatccggatnnnnnaatacgcgaggaatcaaatcaatttccaggccctgtttggttaatcccctcaccannngnattgagtgggattgannnnnnntgnnnnnnnttt

SEQ ID NO: 100318 - DNA, 521 bp, Triticum aestivum
  unsure (1)..(521): unsure at all n locations
  Clone ID: PAT_TA_100318
gcacgaggagcccgtcgaagataattcatgccatcgcgtggcatcggtctccgtcgtctgtgtcatcttcatcctataggagcgagctgggagcaagctcgaacagcttgtcatggacagagaagagtgagactaataagagtgatatattcgatgactacggtgggatgaagtcaggaagtcactcgcagacattagggagattgtatgcctgggagaagaagctgtatgaagaagttaaggtgggttatatatctgctggagtcatttgatcttacctgtgattgcatatatatacaaagacacctcatatctttcttagcaagttgctattgatctacctatggttaaggcaactgattatttgaaaaagactgacccaccttgaaattaaaaatgtatcttgtctttgggttcgtgtgtctttagtaaatgaggctaagttgaaggtcttgacaaggtcatactactgatagcccaggtctttgggttcgtgtatcttnnnnnnnnatatttatatt

SEQ ID NO: 100319 - DNA, 556 bp, Triticum aestivum
  unsure (1)..(556): unsure at all n locations
  Clone ID: PAT_TA_100319
gcacgagggccgcctcctgcacgcttctcctccgctccccgccccgcctcgagcagctcaggaacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccaacacgctcacgatcgtcgacagcggcattggcatgaccaagtcggacctcgtcaacaacctcgggaccatcgccaggtcggggaccaaggagttcatggaggccctcgccnnnggcgccgacgtgtccatgattgggcagtttggtgtcggtttctactccgcctacctcgtcgccgagagggnngtcgtcaccaccaagcacaacgacgacgagcagtacgtgtgggagtccnnnnnngnnngctccttcaccgtca

SEQ ID NO: 100320 - DNA, 576 bp, Triticum aestivum
  unsure (1)..(576): unsure at all n locations
  Clone ID: PAT_TA_100320
gcacgaggccgcgccgccggcggaagagatggcggagcttcggcactcgacggcggcggcggccgcccgcgcatccaactctccggcaaagcgcgactccgacgcgtcctccgcctcctccccattcgcttccacctccgccgcccgcggccgcgacgacgacggcaaggacgcccaccgctcctcacctctcctcccgcaccaccatcaccacaagcagctccttccgtcccccctccgctccctcctcgccctcgacgagcccaggccccccaccgcctccctctcctaccggatcttgctcgccgtcctcgcgctcctcctgctcgcggccctcttctccgcgccctccctctggtcccgcttcaacgtgccctacttgtgccagaaggaggggatcacgctgcattgccctcagacgaaggagcctctctcactgtgggagaacccgcgtgctnnnaccgcgtcnnnnnngccctgcgcagagcgtcgaagtgatgagccctcagatgttccacctgannnnnaaacctctgggtatatttttattcatgccgnnnnnngactgaacnnnnn

SEQ ID NO: 100321 - DNA, 616 bp, Triticum aestivum
  unsure (1)..(616): unsure at all n locations
  Clone ID: PAT_TA_100321
gcacgaggccatccagaatgatatttgaagatacggaattagtatgagatcgctttagggggtttaaacacttggataagattaaacacatgttgtaccgaattggcagtccttcatccaaattttcttgataatggtacaccatttggcgatgggttctctaaaaaaattaaaattccactagatatcatttagatataatggaaaagggatcagaaatgcggtttgtatgaccgaatacatccttaacatatggttgttcattatactctggtagtgagatcggttagtaatgttacacataatatatattttccagttgtgtccctcactctcttaagcatgtttctgttgtatactggttagttgtcacaatgcatgtatttgaggctgtcgtcgggtctccactgttgtacatttgtcttgccactttgttgttcaaattatttttaggaaactatttgaactcttctgaaggccatttgttcttaatgtttcttttctttataagtatctccataatggcactttccaccnnnnnaaagcatcaaggtcagcgatccagtttttgttctatnnnnatctcttctttgaatgnnnnntggcnnnagatgat

SEQ ID NO: 100322 - DNA, 547 bp, Triticum aestivum
  unsure (1)..(547): unsure at all n locations
  Clone ID: PAT_TA_100322
cgtccacccatttcacctcgtccccaacctcctccggcgtcgtcagatccgccggcgggagccccctgctacagcgccccgacccggctgcccctcctcctcgaatcctccccgccgggccgccgctcctcgactcctccccgcccgggccgacctccttcagtgccgtgcggcaggacgcgcccgggagcaggactcgatcggccgcccgcctgcccggccctctctgccctccgcccggcagcaggaggcgcccgcacgcccggccctcccttccattcgctggttacaacacttctgaagttatttcacttgtttaccagaaagaaaacagagttaaactgctgattgtcaagttaatgttcagtcatgttccaccactcagtggcggagcttgatgaagattgttcagtcatgcccttattttggatgggccctaggctgtcacactcaccgcccttacagggttctgaagggctgatgggttgaactttaccatcactagcactaccggaaagtcatcaatataatgtatctacaaggnnnn

SEQ ID NO: 100323 - DNA, 534 bp, Triticum aestivum
  unsure (1)..(534): unsure at all n locations
  Clone ID: PAT_TA_100323
gcacgaggctccctccccaccccaaccatccccgtctcctcctccttcctcctctcccccgaccctggatccaaatcccggcccgccccagagccggaatcgaggcaagcaaaagcttgagatagatagagaggcgaggtagggaggcgagaggcgagatcatgaagcgcgagtaccaggccgcccctcccgcccgccccgcagctcaacgcctccacctcctccaccgtcaccggcggcgggtacttcgatctcccgccctccgtcgactcctcctgcagcacctacgcgctgcggccgatcccgtccccggccgtcgcgccggccgacctctccgccgactccgtcgtgcgggatcccaagcggatgcgcactggcggcagcagcacctcgtcgtcatcctcatcgtcctctctcggcggtggcggcgccaggagctctgtggtggaggctgccccgccggtggccgccgcggccggtgcgcccgcgctnncggtcgtcgtggtcgacacgcnnnnnncngggattcggctg

SEQ ID NO: 100324 - DNA, 592 bp, Triticum aestivum
  unsure (1)..(592): unsure at all n locations
  Clone ID: PAT_TA_100324
gcacgaggaactgcagagctggaccacgccagtggagccaataagggtgcaattttgttgactatggacggtgcggtgcacaacctgatcgcgacaacgttcctagaaaattcaagctaccatctagccaccaatcatcatgggaaacttgatgtgccttatggtaagtacataagagcactgcgctgtgtcggctgtagcaacgtggagtttaaaggtggctcatttccacatgagaagtggctacgtgtcctggaactaacggagagctccgtgctgaagctaccggactacatcttgcaactgaagcacctggggtatcttaagatatcaaaatttactggactggtaactcttccagagtctgttgggcatctgaaaaatctgttccatattgacttatcaggatgctccaggcttgcagctcttccggaatcatttggagatctcgtaaacttaacccatgtcaatctgtcacgatgccatggactgacagagcttccagaaccactccagaagcttggcaaactggtacacctggatttatcattctggtcttgttttgannntattggggaacgccttggtnnnn

SEQ ID NO: 100325 - DNA, 605 bp, Triticum aestivum
  unsure (1)..(605): unsure at all n locations
  Clone ID: PAT_TA_100325
gcacgagggagggagagagcatggcgtccaacaccgcactcgcacccgcacccgcacccgccgccgacgagctgctgcacgagttcggcccgctcctccgagtctacaagagcggccgcatcgagcgccccctggtgctcccgcccgtcgcgccggggcccgacccctccacgggtgtccagtccaaggacgtagacctcggcgcctactccgcccgcctctacctgcccccatccgccgcggccggcacggcggcgaagctccccgtcatcgtctacgtccacggcggcggcttcgtggcagagtccgcgaagtcccccaactaccaccgcttcctcaacgacctcacctccgcctgcccggccctcggcgtctccctcgactaccgcctcgccccggagcacccgctcccggcggcctacgacgactgcctcgacgccctccgctgggtgctctccgcggccgacccctgggtcgcggcgcacggcgacctcgnnngcgtcttcgtgnccggcgacagcgccggcgccaacatctgccaccacgtcgccatccagccgggcgccgcgcgcctcgggggcgcnntgctgatccacccctggttc

SEQ ID NO: 100326 - DNA, 486 bp, Triticum aestivum
  unsure (1)..(486): unsure at all n locations
  Clone ID: PAT_TA_100326
gcacgaggcctatccagtatccacatcgatcgatggctccgccgctcctcctcgcactgctcctcgcggcggccgccgtcgccctcgcatcctcggcggccaccgtggtgttccccaaggaggcgctgccgaccagctcgggttacctctccgtcgacccgtccgccaacgcctccctcttctacgccttctacgaggccagcgccccgctcgccgccgcgccggccgacacgccgctgctcctctggctgcaaggagggcccggctgctcgggcctcgtcggcgacctcttcgagctcggcccctacctcgccgcccccgacggcgcctcgctctcccgcaaccccttcgcctggaaccgccgcttcgggctgctcttcctcgacagcccgctcggcaccggcttcagcgccgcgccgacgcccgccctcatccccaccaaccagaccgccgacgccgcgcacatcctcgccgccctccagtnct

SEQ ID NO: 100327 - DNA, 333 bp, Triticum aestivum
  unsure (1)..(333): unsure at all n locations
  Clone ID: PAT_TA_100327
acccacaaaccaaaactatngtatataattcaattttaagtctaaaaaccttaacaaaattatgcaactaaacctttaaaaacataaaaaaaatccctctaacaaaaatatttcctataacnatcatccatacctgtcccttttttttttttccattgcggcatatttgttgttgtatgtggcttattaccctgttttacccaacttaaactncctaaatacttttaaccaacctaaaaaaaaaaaaaaaaaaaaaaaaattntttgggggggggggggggcccccccccccccannntnnccttaaaacccccccccccccnnnncnnnnnn

SEQ ID NO: 100328 - DNA, 224 bp, Triticum aestivum
  unsure (1)..(224): unsure at all n locations
  Clone ID: PAT_TA_100328
gggacaacaaaccanagctttcaaacaaaaaaacaacgggacgggacgggacaaacacaaccgcgacctgcgcaaacatctggcacccgcgaaaacccgataactgaaaaggaacccaacacaaaaaccggctacaaataacttaagacaccccatgcccacatnnnctctgaagcaccaacntcctcgctggggggccaaaccctatnnntcttgcatggatg

SEQ ID NO: 100329 - DNA, 489 bp, Triticum aestivum
  Clone ID: PAT_TA_100329
gcacgagggtgaggttggcttcctggagttcttcttccggaatgcgagggcgctgaagaccgcatctgtttccatggccatccaagcttcacaccgttctcggcggaggaggcgcacgccaaagtgaaatattgctacaggaacaaggcgagtaagtcctgccacatggttgtccgtgggagtaccggcccttcaggaggtgaagtttggaggttcaaagatggggcagatttttctttccatgaccccttttcccaggtgttggtcaggtgagcttagtttctgtggagaagtgggctggctgttttctggtgcaaactatgaagtaagtatggtgtctgtctcttgctagccgtgcccttgtgatggtccgtcgaatttgaggcttgatgagctgatattttgcttgccctgcatgtaacctgtgttacctgttacccggtctatctatgtatgctccacgagccatttcatttgaaaaaaaaaaaa

SEQ ID NO: 100330 - DNA, 574 bp, Triticum aestivum
  unsure (1)..(574): unsure at all n locations
  Clone ID: PAT_TA_100330
gcacgaggaaatcttgctattgttggtcatgttgattctggcaaatcaacattatgtggtcgtttactgcatgccctggggagaatttcaaaaaagcaaatgcataagaatgagaaagaagcgaaagaaaagggaaaagggtcatttgcatatgcttggactatggatgagagtgctgacgaaagggcacgtggcattacaatgaatgttggcgtagcatactttgacaccaaaaattaccaagttgttatgctcgactcccctggtcacaaagatttcgttcctaacatgatatctggagtgacgcaagctgatgcagctgtcctagttgttgatgcctctctnnnatcattcgagtcgggtatgggcgttaatggggttggacagacaaaggagcactcacagcttattcgaagctttggtgttgagaacttgatagttgctgttaataagatggattcagtgggatattcggtggagcgcttcaattatgtgaaatcacaacttggcatttttctccgatcatgtggcnntaaagagtcggcgataacctnnnttcctttgagtnnnatgg

SEQ ID NO: 100331 - DNA, 571 bp, Triticum aestivum
  unsure (1)..(571): unsure at all n locations
  Clone ID: PAT_TA_100331
tcctgcagctaatcccgctgtccctatcccctcccgtcccctcgccgccggcccggcgcgcccagatcgcgacccctcccatcccctccgccctagccgatcgtcccgcccccgccgcgcgttcctccggggactcgccgttgtccggcgcttcgcttccagcgtcgcctctcccggcccggctcgtccccgtcgggcggttgctccgcgcctcgtccatgggcgaggagtcgcggctgcgggggttgagggagccaacgagcgagctccggctcccatcgtcgacatccacgaagtgcgccgtggtgctcgtgcaggagcccgaccatgcgggggcgggggtcaanccggacccgtcctccatctccgctggcgcctggcggccctttgaggatgcccgcgcccgccgtcgtgggccggatncaaccgtctgtctcctccgaggaccgcccgcaaatccgccgtgggagcaaaagggcaagcaaggaaacagtgggaggcggggggtnctaccccncgcgggaaaggaaggcgggccggaccttggcaataaaggggcgggaacgaacgg

SEQ ID NO: 100332 - DNA, 565 bp, Triticum aestivum
  unsure (1)..(565): unsure at all n locations
  Clone ID: PAT_TA_100332
gtgaggtgtgagatttacacacctggaggccgctttggggatcgctggaggccgcctgcgggaggagtacccttgagcttgcatcagtttgtatatgccgctgttacaaatgcggaattgaacaaattacctcctgtgtttgccaagggttgcctgcactggttgatgagacctgcctctttcaccacgactccaagtgttgctgtcgtgtccttctcggtcacagaggagaccttcacatgtctccggtcaccgcccttctgggtaccaggagcgccgccgatcaggtatgggttgtcaaaagagcaactagtgggagatggatgaccaactatgtttggtccgagatactcncaacacaatgctttatgctaatgttttggagatctggaaactgccgggactaaaactccgggtgactgggntactgantcaccggatnaantttgtncagccacctggcaaaganatttaacncnaatcacaaattctgaaaaantattggggtgttttggnaacaaatccaacccccccagggaagnaaaattgtccntcactactaacn

SEQ ID NO: 100333 - DNA, 579 bp, Triticum aestivum
  unsure (1)..(579): unsure at all n locations
  Clone ID: PAT_TA_100333
gctagtctcgagtttttttttttttttttttttttttttttttttttttttttttaaagaggctggcaacaaaagtcatccagcctggtcaaaatctaagtcatgcaagccacaaaatcattggtagaattcatgttatatacagtctacactttgacaaaggtatagctagccaggctattcaagttccatcctcgctttttgaggttttcaaccagcaaattcagtacgaaaccgaattagactcaaacgaagcaaccttctacatagacggggccttccccaagcagccaaaacacacatcacaaaatgtgcacatttactgccaaccanctcaatgggattaaattgcgtccgcacaaaatggatgccttttccttccaantgctggaaaaaaagcttctgtgctncnacaattctccaaaacactcgcaaaggcaaccaaatttgcaaggacnttgttcccccctanaaggtccgtttaagggctcaaaacaagggtggactaaaatcaagnggttnccantggantttcccccaaaccgngcccctgnnaaaactttgangtcctcctccgng

SEQ ID NO: 100334 - DNA, 560 bp, Triticum aestivum
  unsure (1)..(560): unsure at all n locations
  Clone ID: PAT_TA_100334
ggtctttctaattatttgataatttgatttgccatagattttgagaacctttgctgtaattaaacatctgtttgcagcattattttgcttacgtacattggttaatctctactcacattgcgcagttccatattttatgcatgccagtattctacctctttataatattacatgtattgtgtctggttgtcaggattcttcatatattgttcgcaagtcattcattcacaaactttttggccttttgaagaagcatgcaatacctgttagatatgcatgtgcttttgcattggcatcaacagattgcgctggagatgttcgtactgaatcacttaggtacttaaccgaagtggtaaaagagcaaagaggagtttctgttcaccaagaacaaaaccaagcaatgactccgattgtagaacacccagcatatgctgtccttttcttgatccatacgctgcatatgaatgaggaggttccctttaacntttgngaaaanganaactggctccgctgagttttggggcccacttattgggatgtttananaacctagtttaaan

SEQ ID NO: 100335 - DNA, 593 bp, Triticum aestivum
  unsure (1)..(593): unsure at all n locations
  Clone ID: PAT_TA_100335
cccgtcccactgacggtggtccccaccgccccccgccccgcccatatctcgtcggcgacccgcgccccctccccgccccannccaaacgtctccgggggcgagggcacccggccgtctccggttttctggggccgctcgtggctggngccggnatggaaccggtcggggcgcgccggtcncccggatntcaccntccgggcgccgtctccctcaggggcagnctttgancctctgaaattttgtgtccctgggtctgcgggtgataagtcagggaaaacaatggnagatttaaannattgcaactccaaantgcttgtngctgttnctgggtctctanatctgcacctcttcatggctgttaggtcaacaagataaatcctggggaaaagtacgcctttggcttacttttctcttgggncaagaatgaatacttcccgaagggagccaaaggnaaaactctgctgtgaaatgggcaaatttgttcccctgcnngtgaaaagntnaaaattttggggangtaaatnaacntggaattggaaaaanaaaaatgctttttttaaanaagcaatcaangaggngntttcaatttcaa

SEQ ID NO: 100336 - DNA, 570 bp, Triticum aestivum
  unsure (1)..(570): unsure at all n locations
  Clone ID: PAT_TA_100336
gggtgatcattgtcatgccaccgacaaggacacaaagtgggaaacactgaggcaatcattcaagcgcaagatagcgtgcaaggatttccctcacccgcggcatttatgttctgaattgccctttagcaccactcctcacccaaagcattgtaaaatgtgctactgttatgtgtgtgatgctccagctccatgcaagagttggggcaaagggctcttgaatggtgatcattgtcatgccaccgacaaggacacaaagtgggaaacactgaggcaatcattcaagcgcaactttgagctgggcaaggaggccactgtgtccgctgggaacctaacctatggctttgacaccgagcgccttcgccagctcttcangtatgcccgaactctcacgttctcatagatnatttacgacaagggaacaagcaagaattgtggacaagggaactggttttgaaatccattgcctttggcaactccttcaaatnantttcgaaaaagggaaaaangcaaaaatttttggncnaaggnaaatggcttangtatgctgtgcaaaaaatttcaaccgtgttt

SEQ ID NO: 100337 - DNA, 578 bp, Triticum aestivum
  unsure (1)..(578): unsure at all n locations
  Clone ID: PAT_TA_100337
ggtggcagctccggaaccaccgggctgggctgaggcagctgccgttgaatccagaggttgtgaagcttgtcctggataaggtcaaggacaactaccacaggaactttgttgttgatgcggatcagcggtggttgctacacaggtggaaggggcgtgtgctctacgcctggtcatcatgggttgcagctgatgccacctagcttgttttctcaatctaatgttgattgtagacatanattgatntacccacgcctatattngtaataagtaacacttatctcttgtaactccccgcccgtccggaaaatacttngtnctcaaaaaatggggataaaattgggatgtaanctattaatttaaaantaangtcctaagattccaaccaattttcgggggaanaagtttttttccgggncgggggggangtaccttgacnaagcaantttcacaanattaaaaatgcngtttaaanttgttaatttnttattaaaaaatttgggnggcctcctaaacttnaattncttgttnaacaacaaaatttttaaaaaaannttttccttttggggnggnaaaagtaa

SEQ ID NO: 100338 - DNA, 567 bp, Triticum aestivum
  unsure (1)..(567): unsure at all n locations
  Clone ID: PAT_TA_100338
gattctctgtaactgttccttcctaggagagagggagagggagggagcacaaggaaggatttctcccacagttgttgaattttcttcttgcttgtcccaaatccctacctgcctgccgcatttgctcttgctcccggattccagcgcccccatccagccaaattcctacttcttcttgtgcatttctggtccaagatctttggctgccgcaagatctgaagaatcaccccatcgacggcgacggttatgaggccggaggcgaggctcgattcggcggcgttccaactcanccccacccgcaacaagtgtgatttggttgtggtgtccaatgggaggaaggagaaaatngcctccgggctgctcaaacccttcgtcgcccaactcaaggtcccccaaggagcaaatnnccaagggaaggtacaacaacctgctccaanccggattcgggtgccgacgcgccaatgggtcaacaaaggggaacaanncaaaaggttcgtccgggttcgtgaacaaccccgggaggtcctggagcgggtcaacaacaaccaagtccgaaaatatngcanc

SEQ ID NO: 100339 - DNA, 499 bp, Triticum aestivum
  unsure (1)..(499): unsure at all n locations
  Clone ID: PAT_TA_100339
ttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccgggganaccggcggctgcgactgcaccacctgcaagtgcgggaaccgcgtgcggctgctcctgctgcaactgcaaactgagccggcgcccaaagaaggccggccggcaaaaggcgaagcacnangattaaggaggacaagcaagcaagcaacatcaancaacaagtttancaacanaccaanngttttnaacaccaaacncccccaaagggcctcccgggggccccgcgctttaaaaaaaanaaaaaccnccgttcggggttccgttaatttgttaagnccccctttcccggt

SEQ ID NO: 100340 - DNA, 571 bp, Triticum aestivum
  unsure (1)..(571): unsure at all n locations
  Clone ID: PAT_TA_100340
gccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcaagccttctcactgagagtggtaacactaaggatgacctgaagcttcccactgattatttctgcttgggcaaattaaaactggatttgctgatggnaaaggacctgatcctgtccgtgaagtccgccatggggtgaaanaacanattttgcgccttttaaaggaaatccgtgggnggcaaantaaacaactgtgccgtgggttncccaactgcgaanan

SEQ ID NO: 100341 - DNA, 348 bp, Triticum aestivum
  unsure (1)..(348): unsure at all n locations
  Clone ID: PAT_TA_100341
gaaacgttcctcgtcgcagctcctccacgtgcccgtgcccgccgtgccacgctcgcgtcgcgcgcgcgcgcagctcggtgttcagtacactagctanctagctcacgcgcccacgccanctttgctccctcccccgcgcttgtttcgtggctcctctttctttccggcgaggcggggcacggannttggcggcgtcnggggagggcaaatgccntcgcggagcgagggcgtaaggcacgatgggggtgccggtatctccncggntggganccgtgcggtacggtgttctcccgtgggccgctgctctgncccngggaagccccncnaacctgatncctccgcgngcgg

SEQ ID NO: 100342 - DNA, 578 bp, Triticum aestivum
  unsure (1)..(578): unsure at all n locations
  Clone ID: PAT_TA_100342
ggtactctgtagagatccagagaccatgctgcctcccgatcgagccatgccgttccttctcctgttcctcttcctcggcctcgccgccccccgcccggcggcggcggcggacgagcagttcgtcttcgacggcttcaccggcgcgaacctcaccctggacggcatggccacggtgaccccgaacgggctgctccaagctgtccaacgccaccaagccaagctcaaggggcangccttcttcccgacgccgctncagttccaacgggcgcccaaaancaagggcatgcagtccttctccacgggcttcgtcatcggnatcatcgggncctaacaaaacgctcaacaaccaagggatgggcttccgtctcnccaaaaanggcaaattnaactccggcgctggcggggcaatttctccgggctcgtccggtnccgccaanaacgggnaangccaacaaacaactcctccgcccntggggnttcgacaacaatcctcnaatcccaanttaaaagaacatgaagnggnaacaacttcgggggtcaagttcaaagggcttcaaattccntcgaagccnaaaaag

SEQ ID NO: 100343 - DNA, 581 bp, Triticum aestivum
  unsure (1)..(581): unsure at all n locations
  Clone ID: PAT_TA_100343
gccgtcctccgccccacctccctcccatggccttctccccgcgctcgccgtggtcgcgctccaaaaagcccgacatctactccaccgttgtggtccacgacgacgaggacgacgcccgcggcggcggcgccgcccgcgcggaggatgacgacgacgacgacccctccgcgctgcccccgctcctccaagcgcctccccaaggacttcggnggngcgtccttcgaacgacgaanaacaaccttactcctcggacctcgaagaagcctcgctctccggcaacgtngtcaanaaagcggcgggggccccgcctncaaattgtnctcctcccgattcccgtttctggatttgnngcgnttcaagccccgnggcggccaaaggcgaaccgttntncaacttnctcgtccaagggaacgngcgctncgggggggggcctncaaaccccgngaattcgtntcccggaagnttanaacccantncgggngggcccccaaaccccgngagtcctttttcgggaaaaattantcggcaaaaancgtgggttctccaaaccccaaaaanntntttccgggaagnttaattaa

SEQ ID NO: 100344 - DNA, 565 bp, Triticum aestivum
  unsure (1)..(565): unsure at all n locations
  Clone ID: PAT_TA_100344
gcaggggtcaacccactagtgcctctcccgagctggccgagccccctggccgacctgcgactgctcccatttcgatccgccgccagcccagccgtcgcggcgtcgcctcgccggccccgcttggccgcccggagccaccgccggaccgccctgacgtccgcccatagccgctgagcccgtcgccttcttccgagagagacccagcagctcctcgcgtccctgacgctccttggacagtctggaaccagagatcttctctgcccctttctcccttaataaagaaatgttttgaggtggcacgtcattgttccatagtaaagaagaggaagtcagggtcagggcaagcgaagggaagggaaagtagccatcctaagctgggaaaggctggcaagatgaaantgccggctgctgcaagaacgtgcgatntctgctcaagaaatngaaggccgcaactcaantcaanttaaangnctggtaaaccaancanatttcaaacccnatgtntcaannatttggccnncaaattcctgggaaaaaaaaaaaaaaaagggaccncaatcncngn

SEQ ID NO: 100345 - DNA, 208 bp, Triticum aestivum
  unsure (1)..(208): unsure at all n locations
  Clone ID: PAT_TA_100345
ggccccgctccacctccccccgcctctgccccgcacgccacaccanagtacccacctctccggacgggcgnccgtcgccgtcgccatcgccttttccccctccctccctccccgcgtcggataatgtangtcgcactcgcttncagnggacgccggnaccttnangntcccaccggncggcagattgnttcctacaccaattcctggc

SEQ ID NO: 100346 - DNA, 595 bp, Triticum aestivum
  unsure (1)..(595): unsure at all n locations
  Clone ID: PAT_TA_100346
gctccacagtcgtgtcccactgaccactgtccttccccaaaaccctcgtccatggcggccgcggcaccgccgctcgcggagttcgcccgcgacgctatggcctacgtagccgaggaggaggaggaggaggaccccgaggaggtggagccgtgggtttcctccgactcggagccggacgagcacccggcgcccaagccgcggagcccttcccccgacacgcaaccggagcanccgccgccgccgccgccgcctgcgccgacgaattcggcgtccgangtggcggaggaaggggaaaaaagcggcgccttggcccgggtttcccggcncgaacgtgttccgggctggtccgttggccggggaacaaaggtgggcggcctcaacnggccgccggggggcgaanattngttaaagcgtcttctgccgaagaagaacccgcgcccggcgtccggcgttctcnaangccaaaggggacgggngtctccaagccgggatttgtntttgatattccnccaacaanaaanaaaaaaaaaagcaaaaaattgggaactnncnaatgggttnctgcaaatttaggntttttcnaanaatntaaatt

SEQ ID NO: 100347 - DNA, 223 bp, Triticum aestivum
  unsure (1)..(223): unsure at all n locations
  Clone ID: PAT_TA_100347
gctccactcctgcacagtcctctgcaccagcgcgcgcgcggccggcattggcgccgtaagatggcgagcggctccggggagcacttcctgaggcagctgagctccagcaacgggctgcaggccgcgcaggacgggtacggcggcgggggagggaggangangggctcnaggcngtggnccaataaacgggccggganagggtanggcggtccgcgggaatcct

SEQ ID NO: 100348 - DNA, 631 bp, Triticum aestivum
  unsure (1)..(631): unsure at all n locations
  Clone ID: PAT_TA_100348
ctgcagcctacacacacacacactagcagcgcaactcccaagcgatggcgacggccgttggcattggccgcggtcggctaccactaccagtaccaccgatgccggccgttccacccggcgtcgtcgaccggcggcgcaaccacgcgctgcccttgtgcactctcactgccagcgtcacctacacggccgaaccgagcctgctgggcaggttctggtccggcatgctgcccggggcgaagcgatggaaacgcccancaaggctctgaggaaatatcgaagcacatctgctcctgctcggggactcttgcggcgaagcgttgctggttatccaagcgggccgggncgttctgggcaaagggcgaaanncttnaagcaacaaaagctggttgttttcctggattctttgggccaatcctgcngttcccctccgccttaanggtaacaaangctcaanggctgaaagnattaaaggattctcccaacaataaacnaaccccgtnattgggaccgcctntgggttngtcaagtgggaataattttccaatgntttcccgggtnacgggtgggggaaancaanggaaaccgggaaacgaagggaacnattggtcngggnggcttgaaaaaaaatnaa

SEQ ID NO: 100349 - DNA, 200 bp, Triticum aestivum
  unsure (1)..(200): unsure at all n locations
  Clone ID: PAT_TA_100349
gctcgagttttttttttttttttttattttgtccaaaatattttacatgtcatgtacnctcacacattcgattccagacggaaacaaagaagctcnacaaaatcaattactatnacactacaaaangtcacttgatcagtccnaatgtnacagaagtgtatgtacttctctgtacataccatctggagctgaaccttaaa

SEQ ID NO: 100350 - DNA, 596 bp, Triticum aestivum
  unsure (1)..(596): unsure at all n locations
  Clone ID: PAT_TA_100350
gcacaaaccccaagtttgctctcagcttgtcctgcgtgctgccatggctcgccctcgccctctccctctccttctcgccctcttcctcctcgccgcctccaccgcccactcccagtctccggccgccgcgccctcgtcttcctcccactccggcgccgtcgcccagtcccccactgccgcctctccgaccaccacaggcaccccagtcccttcatcgtcccaaaaccccatctccacttcccccgccgcctccccttcccactccaagcaccaagctcacctccccggcagctgcccccgtccaaggccaacgctccacccacattggctccccccacgccctcccccgttaagctccccgccgcccanatttgccgggccccgggcaacgngcccgcccgaagttcttccccggngncgggccccgggttaacggccggggccaaaaatttgccctcaaccgattgggcgcaancggggttctcttggcccccaaggnggttcggcccccggggccgggggatttggtccnaagttcttccctncggggccttcncnccggggggccccgttggtcctcgggccggccccnggnt

SEQ ID NO: 100351 - DNA, 583 bp, Triticum aestivum
  unsure (1)..(583): unsure at all n locations
  Clone ID: PAT_TA_100351
ggtaatatctctcctccctctcccatcccctctctctcctccacccgacgtcgccgtcgccgtccaatctccggcgagatcccctcccccgccggcagccatggcctccaccttcagcggcgtacgggacggcgaagagcggggtgggggtggcgtcgatgggggtgatgcggccggagctggtgatgaagtccatcgtgcccgtggtcatggcgggggtgctcgggatctacggcctcatcatcgccgtcatcatctccaaccgggatcaaccccaaggncaaagccctactttctcttcgaacgggctaacgccgcaactctccttccgggcctcgcctggcggggcctcgcggggggctcccccgccgggcaattgggcaatcgggcaatcgttccggcgaacgcccgggcgttcaaggggccaaacggcgcaancaaancccaaagcctgtttcgtccnggaaaatgattctcaancctttatccttngccgaaaccccntngcctggttacgggcttaaccgtngggaatcaatcctcnccctccccgtngcccgggccaaatcccggtggccgaact

SEQ ID NO: 100352 - DNA, 315 bp, Triticum aestivum
  unsure (1)..(315): unsure at all n locations
  Clone ID: PAT_TA_100352
ggacgctcatttctctcgtttcgtttcctcttcaatcgctgacccgcanccaccancgcaccgcaacaatcgccgacccgcgcgcaaccgggcagcgttactanctagcgtgacgtatatgaaattcccatccggngcccgtcccaacaacggagggggggcaacaacaaacgaacgaattcnccttctactactcttttcttcaangaagcccgcccgcccgcgttcgccgcttccaaatccgcgctccgaagggagnccgccaatgccttaanaanccgccngganggaaaccccnggaggggaacaacaact

SEQ ID NO: 100353 - DNA, 447 bp, Triticum aestivum
  unsure (1)..(447): unsure at all n locations
  Clone ID: PAT_TA_100353
gcctcgtgccgaattcggcacgaggtttgcatgttgtttggaaatccctcttccaactagtgaaatgtatttcattattattagagaacagaaccaaatgggacttggccaataagttaaataccagagccactcaatctttaagcatgcagttactattggtcaaaaatagttttcctatcgtgctctcaaataatttcacatcattatcattgtgattgcaagttggataggtgcggagcanaaacagtaccctacctgcatgtccttccaatttcncccttaaaatttaaattccctggtagattcactgatagtcaaaaaggngaattatgattatcnagcaaactggttcctaacaactaacttgccggaattaatttttggtttggcaaannacntttccaaaattattggngaaacaaaattggnattaaaataanccct

SEQ ID NO: 100354 - DNA, 339 bp, Triticum aestivum
  unsure (1)..(339): unsure at all n locations
  Clone ID: PAT_TA_100354
gcctgaatcctatacatgtcactatgccactccccagtttctctttgcagttcacaatctgatatattctgctaaagtctataatcctatcatcctgtactaaacacatacaaacggggcccgccgcacacccaanagcctcgatcaaccaggaancccccgttcccgggagcttcnaggtttaggggatgtgttcctgttnttcaagctgncntgnagaagngaaacncccagtgttcctnaaaaggtcctgngtgtccatcncacaattntctctggganngcntctatntnctggcgttngggantacccttngtggcaaaccgtccttnttttcc

SEQ ID NO: 100355 - DNA, 589 bp, Triticum aestivum
  unsure (1)..(589): unsure at all n locations
  Clone ID: PAT_TA_100355
gagagaattgaaaacttagctctggttgaatcctgagatgccgtagcgggcggctagctggcaagctcgcacgcggcgtggttccacctcctcctcggccttcctcttcttcgctgcacaagccacgctgcgcgctggagctggacggcgttccaggatcctgaagaagcgccggaattcttcgtcgtcgatgaagacccggtagtcgagggcgcgtaggaacagcaactcgagcgggcacagctcggtggaccggatggactcgcccgagcatacctggaacgactccacccgcctctcgtagtacctcgggctgctgaacttggcaccgagcaagaccgccacggaaatcaagcggtgcgcgggtggccgggctcgacgannattcccggcctccaagcgcgggcgggggctncncatgaanaagcgcgaaggtacgcccnccgccgaaggacgttaaacggggcccatcaaaacaaantaatttcaagcgcttggaaggggctccaaggaactccggngaattggggaannggccggggggtccccccccccccccgggaaacnccccgggannaaaggtctttct

SEQ ID NO: 100356 - DNA, 447 bp, Triticum aestivum
  unsure (1)..(447): unsure at all n locations
  Clone ID: PAT_TA_100356
ggctcaagaaaaacaaaatccctctttcgtgaaaccctaagataggcggcggcggcggcggcggcggctgggtgcggcgggcggcganggaaaccgcaaaagggcgagcgatggcgggtggcagcccggcaaaagaggaggtgcggacgcctcatgagttggagatgcagatggaagagggggtcgtgcagcggaatcagcctccgtctcaagaggaatcgagctgaccttgctgatnaagctcnagttcttcacgggacctccgcaataacgctgatnaaagaaanaaagaaacaaancaagaagaaagggagaaagggcaacgccccgaanaaanggaaaagnttnaatttctttcaaactccctaacccgttaaatctggggcaacgcaaaaaaggggncttggntttntccnaanaatcctnttcnaaaggcctttgcccaaa

SEQ ID NO: 100357 - DNA, 506 bp, Triticum aestivum
  unsure (1)..(506): unsure at all n locations
  Clone ID: PAT_TA_100357
ggcgttcgtccaccttctagtcccactccaagatccagctcaagatccaggcaggctcaaccagccatgtgctgcagcgagtgcggctgctacgacgcgttctgcaactgctgctgcccctgcatctcccacgacgcgcgcgagaccatcctctgctgcgcggcctgcctcgccgtcctcgccggcgtcgtcctcttcgccgtcctcctcgcggcctacggcttcatccgccacgccgaggtggccgtcaccgacgcctccctcacgcggctcgcgctggccaccgcccccgccaacgccttcgcctanaaacctctcgctcaggctcaaccgttcgggaaacaagaactggggcatgaagngtcaagaacaaccaacccggctccgaaggccgactaaaagctttcgaacgggcaancgccttcgaagcngggtcaaggctcccccggacnaggggttnccacgcaaccccggctgggggaanganccnaaggttgtancaacct

SEQ ID NO: 100358 - DNA, 612 bp, Triticum aestivum
  unsure (1)..(612): unsure at all n locations
  Clone ID: PAT_TA_100358
tttttttttagacaggacatacagtttttttttttgaggggtgacaggacatacagctgaaacagatgccgaagttcaacaacggaatgaatgagtaatcagcccggcccaaccaccacaatcaggacacttccatactgatgagaaatgccttccctggagctcanagacctccaagcttctgaagaaaatcgtaactgtgcaaccgcgcgaccaatatgctccgttcgagtacactttcgttcacacgctgctggaactgctcacctccgtgtccgtccgtcgaacaaggtctttgacacggacccaatcgacatcatcttgtcaagacccccgacccgtcctgctccggctggctgcctctttgcgggccgtcaatngggcngttctcgcaagacaatgtccgggtgcaacgcccgcggcggccggcttncccccgcttttgaaatggccggccctgggaaccggaaggnaaaccgccaaaccggccaagggggaangntncccttaccggggggtgcttggaagccncccanaccgcggggggcaaaggtnccgggaacccaaacttgntnaaagggggganaaccctgcccnnccctgttncnnccg

SEQ ID NO: 100359 - DNA, 561 bp, Triticum aestivum
  unsure (1)..(561): unsure at all n locations
  Clone ID: PAT_TA_100359
ctccgccgagacgagcgcatcattccaccacctccatcccatcgcaaacacacgacacgagacgagaacgcgcgcgccaccgctctgccaagccagccaggaatatgggcaccacgaacgagctgatgcaccgccacgtccaggcggccgccgtgccgccgccgcccacgtccttcgcggcggccggcggcaggagcatgacgcccgggcaggggcagggtggcaggcagcgggcggggctgccgccgacgccgccctcgggggccggctcccactccctgcacgtcgcggacgcggtgcatgcagatgcaggacgactcggcgcccgcgcaagggcgcaaccgccggtcccgcagcgaacgttccgtttcgggctactttcccgccggccgttccccaaagaacggggtccggcttgggggcctnccccttgccgccggcgggaaggcnggcgggcgggcnaaccaagcttgttcaaacgcgnttaatnaaacaaatggngggggnatggganngggccttaaacaagcctcccaacnggggaacaagncnncggggaag

SEQ ID NO: 100360 - DNA, 567 bp, Triticum aestivum
  unsure (1)..(567): unsure at all n locations
  Clone ID: PAT_TA_100360
cggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaaagactggtgagaactacagggcttctgtatgacaacaagggccgcttcccgccttcaactcctgttaagggatgaggatggcttaattcaaagctctgcaaaggtcaaggtcttgttcaatttcgggcaanaaagggcatccccctaactttaaacaaccttatnaatnggccggcaacaatcccgcttaacccaanaaccccc

SEQ ID NO: 100361 - DNA, 585 bp, Triticum aestivum
  unsure (1)..(585): unsure at all n locations
  Clone ID: PAT_TA_100361
cagtcgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccggcgggttcgagacggccggcggggagaccggcggctgcgactgcaccacctgcaagtgcggcacggcctgcggctgctcctgctggcaactgcaactgagccggcgcccaagaggccggcccggcgaggcgagcacgaggatnaaggagggacaactgggacaaagcaaccaacaacaacaacaacaacatcactagcccgcttgcaatgcgncccgcccgcgcgcgcggctggaataaaaaataaaaaccgtcngtngtgtttccnttaactcctgttaccttgtnacgccccgtttttttccaacaaacaannngtcccttggtcaangcctnccaaactcctnaaaaaatnggggcccnccctctaaaaa

SEQ ID NO: 100362 - DNA, 596 bp, Triticum aestivum
  unsure (1)..(596): unsure at all n locations
  Clone ID: PAT_TA_100362
gcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatncaggacaaggagggcatccccccggaccagcagcgtctcatctttgctggcaagcagctcgaggatggccgcacccttgcggactacaacatccagaaggagtccactctccacttggtgctcangctacgtggtggtatgcaaatntttgtcaagaccctcaccggcaagaccatcaccctggaggttgagtcctcagacaccaatnacaatgtgaagggcaagattcaaggaaaagggagggnatcccccccggaccaacaagcgcctgatntttgccggggaaancaactncgaaggatgggccgcaacccnttccggataaaaacaatccaaaaaagggggtccnaccccccaactttgggggctcaaaggcnccgttggggggnaatgcaaaattttttgtnaanaacccnccaaccgggaaaaaacaataacccctggggggg

SEQ ID NO: 100363 - DNA, 559 bp, Triticum aestivum
  unsure (1)..(559): unsure at all n locations
  Clone ID: PAT_TA_100363
accctagccgccgccagcagcaacccacccaccatcctctcctctcctcgccgccgccggcagcggtcgccgggcaaagcccgcgcggctcggcggcggcggggcccctttccccttccgtccagaggtggctggcgcgggccggtggcctcggngggagcctgagctgctgcgcgcgctcgggcggcgcggctggccgtcggggcggcgcacggaggcncgggcgcggacccggtggnggggcgcgtatgtggatgcgcgggctgggcgcaaccgccgcacgaagatgctttgcggctgggcgcgccgcgctggttgccngggcgcaaatctggcaaggcggcgaccgcctcnaaggatncgcgcgaataaggcgccgaaggaaggaagtgcnggntggggcctccattggtgcggccantggnttgcnggcngtgcctngccaaccgggcttcaaaatttttggcaatggcggggnggnncggttggttccttcccctncgggggggccnaagngggccaaggttttggnattccnaacggnnttcgggccttgggg

SEQ ID NO: 100364 - DNA, 311 bp, Triticum aestivum
  unsure (1)..(311): unsure at all n locations
  Clone ID: PAT_TA_100364
ggagaactagtctcgagttttttttttttttttttttttttttttttttttttttttttttttttttttttttttttttttngaggagtacacntgcttttcttgngggaaagtanacgtgttaatgtcanaaanaanccggattgccaggtgttaccaanctattacatcaaccgaactttcataaccctattacccctacaaagagaccccangtcatacaatagaacacaagcaaancaacccttggttantaaacctgttccgcncccgaagntgcagggccnattccngnatctccaaacnantgt

SEQ ID NO: 100365 - DNA, 588 bp, Triticum aestivum
  unsure (1)..(588): unsure at all n locations
  Clone ID: PAT_TA_100365
gctgantcaanggtggtngagcacagcggatncanctttggaaccaagaaccatggnttctgcggtggcgagcgccttcctgaagagcgtgatgnggcggntgttccatgtgctggngaaggagtacaacaagcaaaagggcctcaggcaggacactctctccatccaagcaggacgtccgcatgatcgccgccgccatggacgaaccgcctccaagcccctggngtcgtgggggaagcgccgcaancgcccgtcgccaangctctacaagcgaaggagatgctcggnctggcngcnacgaanntccaatttattggaatcggacnggaatcgtccnaacgggcctcaacctggcaaggcccccgccntttggcnggcggccgganttttnggggaaagaaaccggcaactttattccgcccngggtccgcccggccgttcgccccaannaaagcttaaagttttttttaaaacccgngcngggggatttgccctcaaagattntcnaaactcaaagggccncccncaaagctgggggcaanaaaacgcgttcttccgggaatcccccaanaaaacggcccnccaatg

SEQ ID NO: 100366 - DNA, 473 bp, Triticum aestivum
  unsure (1)..(473): unsure at all n locations
  Clone ID: PAT_TA_100366
gccaccaccgttcctccgattccaccacatccgctcgcagctcgagatcgtgagccatgtccgggcgcggcaagggaggcaaggggctgggcaagggcggcgccaagcgccaccggaaggtgctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgaagcacgccccgccgcaagaacgttcaccgccatnggacgtcgtctacgcgctcaagcgccanggccgcaacctctacggattcggggggtangtcctggcgaatgttcgcctgtctctgtcnccgcctgcaaattccgcaaagcttgatgggaactctnaatttttcantttcgctgnttaactcnaaccggt

SEQ ID NO: 100367 - DNA, 539 bp, Triticum aestivum
  unsure (1)..(539): unsure at all n locations
  Clone ID: PAT_TA_100367
gatcactcacgcctacgagcgaggcctcctactctttcggcgccgccaccgctccatcccttcgccgccgccctccactgcaggagacagagccgatcgcgttgaggatctaccgccctcgcacgtcagagccttcgccctcgcacgagggatccagcgacggtcccctccaggaggacgccaatcccccagatccggcactgttcccgttgagggcctgctgccgatcgcgtccaggttccctcgaccagcccaaccccctgccgctccgcccctcttcctttcccgctcgtcgcagttgctccctccttcccgtcttcgtgctccaacgagattcacttgaaaccctggagcttaagggagtcgacatggggtgtgggcgagcgcaancgcgcgggtgctgggagccgaacaaagtcaangggggcaagcgctggagttagggggccgcnaaaggacacgtaaccagatnangcacntgagcaaaagggaggtangttaanattgggggnatggcggggaacgggncccncttaacg

SEQ ID NO: 100368 - DNA, 565 bp, Triticum aestivum
  unsure (1)..(565): unsure at all n locations
  Clone ID: PAT_TA_100368
ctggattaaattaactgtcagatatttgtaaacttgtgtaattgcttgggaggatccatctaatgaattttcttggagtatatatatcctaagaaccagatgctggttccctggaaacatactttaggttccctgtcttgactattcctgcactgaatcagaaagctgtgtggatatcatctgtttgtggatggcatgattcagtttggggttttgagtgtctttgcctcctatgaagaattaacctcgtcctagctggctttggagaagtttgacatgtatttgattctggtaaaaaataggaccgtaaaaagtaaagggaggcaagctgggaactggactaaatacaacctataatgcttttactttgaatttttcaaaagccgcaaggattcctcctaatttgctggtaatggtccgggatcacacacatcccaaatacctccgggtngaacctnccttggtgtgcatttggaagggtnacaatnaagaaaattaacaaggtccctaatgggttgntgggaaaaaatgttccttttaatgaaaaatgtttnatgggaagatc

SEQ ID NO: 100369 - DNA, 219 bp, Triticum aestivum
  unsure (1)..(219): unsure at all n locations
  Clone ID: PAT_TA_100369
gagagagagagagaactantctcgagtttttttttttttttttttttagttcaaagttcacttattcatacttgaccgtactgntatancancaactgtttanncnaaaccaatacatcanananctgtttanncnaaaccancacatctcacacttgtttaatccanntccaacacatctcacaactggtttatgngannccaacacatctcacaggg

SEQ ID NO: 100370 - DNA, 559 bp, Triticum aestivum
  unsure (1)..(559): unsure at all n locations
  Clone ID: PAT_TA_100370
agtaatcagaggtattgttgatctttgtctgtcgggtgctagtgctatagttgatcacgagaatcagatgtacaacaaagagaaaactaaaatttcacactggaaattcaaaggaacacctcttgagtttgacttctatgatcaaagtgaaatcaatattgagttcttgttgctgtcatatgctgcatctcaagtcaagcggctttttccatgggatccaggagaacatgaccatttagtgaaaattactgcgatgatactagttggaactgcgggacaggttatttctgaacttatcagcagcaaagtgatcactcaaatggcccgacgtagcacaagagaataagataccacaagtcgggatgcctcgctgtcgcctttgtctgtcgattgcnttgtaccattccgtcaacaatctaatacaagatctgtgagaaacaatctgaaaagctaagcctctccaagttcaaaacgttcaaatgacatgnaaatggcaaaactaaaangggaatcntatgcaagctttttgttgttaccaaangggaanactnggncgtnc

SEQ ID NO: 100371 - DNA, 544 bp, Triticum aestivum
  unsure (1)..(544): unsure at all n locations
  Clone ID: PAT_TA_100371
gattatatcccactgttttttaacaggctcgacctatttctggtagcacttgaagctaccatggtttttggacacccaaaagacttatgtttttgcattttcttatcctttggcttgatcctgacacgctgaattttcattttgcagtgtctccctaaggtcctaaaacatttactgttaattctatataaaaaaaccatttttttgcaaaaatggccatgtagaaagtaacatgatattttgtcttttgtattaaaatctaaaaaatagtaaatcaaaaaaatactatgcgccatccgctgctccttactgttctttgcatattgtgtatttaaaatatgatttgtattgatatttgcaatttgcaaatcnaagtaagtataaatattattttttggctcaataatgtgtcaagttatatgaatggggaattaagnggtaaataaaattaangggaggnnccntcctgttttttaaggctaancgtcaatggttgggngcaaaaaaatntacctgcaatgaccaatgtncccncttanggtng

SEQ ID NO: 100372 - DNA, 313 bp, Triticum aestivum
  unsure (1)..(313): unsure at all n locations
  Clone ID: PAT_TA_100372
tcggcgtcgtcacgatcttcttcttccacgaccccccctgttcgtgttcgcacaaccagcagatagatcttccgatctccaagcgcacaaccagcaganggatatatattcctgcggatatcncggaggcnnncccgggcgtttcaaanttggttgggagagcgacgcggcattgacccgccgttccgatcgccgcgtgccatgatcatggggtctcgcgcagctcctctcgtcctgctcctcttcttcgatggtngcaacaatgttcgnagtccccttgcggntttaagtttcaaggagngangctccccgg

SEQ ID NO: 100373 - DNA, 571 bp, Triticum aestivum
  unsure (1)..(571): unsure at all n locations
  Clone ID: PAT_TA_100373
gcaaaagcacgcaccaccaccatcccaatccccaacgcaagagcaaagcagcagcagctcccctctagtaggtgtccccgcggntcgctcctcccccacccccccgcccccgcccccgcacacgccaccccatggaggcgccgccggggccggagcccatggtgctggacgcgccgcccccgctcgccgccgccgtcgtcccggnccacgcggccaccganaanactgaggacggnnggggggcgaccctgttcaccgggncatatcatctccacaancaatcggttggnatannaacgggcgagccgnnttaggacantttngntacatggcttgattggggtgggcaaggaacntgggttcaatttggggnattggtcctncaaggntnaaggtgcttgggnngactgggtngtagaantggttnccatccaacgnnggttgttgcagggattcgnccggttnccatngaatccgntgnangtgcnagatttattncncgtccaatggancantcccaattggtcggccttctcctgnaaggaanctgntttttttttntacaacaagc

SEQ ID NO: 100374 - DNA, 573 bp, Triticum aestivum
  unsure (1)..(573): unsure at all n locations
  Clone ID: PAT_TA_100374
gcgcacaattccagcatcagcaatgcctcctccccttcgcctcctcgccctcctcctcctcctccacctccccttcgccctctcctcccgccaccaccacaaagccccggcgccgccgccccggaaggcgcctcctccggcggccaactacgcggcgccgctccccgtcctcctcgcctgcaacgccacccgcttccggcccgcctgcgtcgccacgctctccgccgccaacgtcaccgccgcgtcctccccctccgacctcctcggcggcaacgctctccggcgctccggcgcccggctccccgccggggcgtttccaaacggcgcggcttccgttctcggcttcctncaaagaaangtnaaanctnaacggccggccggccaaacaaactggctcaaacgggcccttctcccctctcctncgaaancggggnttnngggccggccgggcctttggccgntttggggggtttaatggccggcntccggcttnggttccttcnaactttaaanaatngngtgggnccgccctaaaaaattaagttaaaanttntccccgggnccaatttaaaa

SEQ ID NO: 100375 - DNA, 633 bp, Triticum aestivum
  unsure (1)..(633): unsure at all n locations
  Clone ID: PAT_TA_100375
ctcctgtattatattggagtctcgtcggcgaagcaaggttgttacacgcaggacgtcgacacattgcagcttgagagggtgtgctattcatgtccaaaacagtcacaagtatattggaacttcccaccatcgttatgatcatcaccgacagtgtcaagtgtcccacagcacgctgaccacccaggagtggatgacgctgtgtcggcactagaaccacgagaatctgaccctgcaggcgtggaaggacatactggtcaagaactgacggacgtcgccgggttaccgccgtgcaagcgcggtcgtcgcagcggccgctcgggctccagaacccgcggaggcgggttgtggtggacggggagaaggaggctgaggcttgacccgtggtggacgagggcctgggggcggatgaggggccagatcaaggtgttgtccaggacggctgcagccaagtctttgggcggcagttagctagatggccgctgtggccaagtccattttataaagtttatactgtcgtctactgcgtgttggtctttttggtttgccgcctggtttcagaacacaaaatggtaccattgtttcttgtttgtcaacacgcaaacgcccgtttnnnnnatgatgaactgcggtttc

SEQ ID NO: 100376 - DNA, 637 bp, Triticum aestivum
  unsure (1)..(637): unsure at all n locations
  Clone ID: PAT_TA_100376
cctgacctaagatccatatattaataacaaaatatacgagcagcaaaataaacagatatagcatatcagcagccttgagctctacacaagtaacccatcagttcatccccaccagaacagaaccggcagtccaccctcatataataagaagtcatactatcctcaaaagaagtagaaaaatccagagcagcacaaccaccctttcaaacatcaagctactccctaatttatacagaagcattggatccatccgttgcttcccggtaacactatagttagctctgctacggtcaatgagtccaagttgatcacaaaaagggatcggattgtgcaaactgcttgcaaactacgatttttgtattcgggggaccgccgtccaaaggttcccgataaaggccgnnncacgcgcaagccagctcaagaaagccatggcagtagcgttcatgaagcttgcacagggatttaccgagcaagctcggaagtcattggaaaggnnngnggtgatggctgctgatccacacgctgcactgaagatcaatgttcctgtgacccagtccccganggcaagtatgatgacagccccggcagttcggaaggaacgtttgacaacaattgcataggcatccnnnnnnnnnnn

SEQ ID NO: 100377 - DNA, 633 bp, Triticum aestivum
  unsure (1)..(633): unsure at all n locations
  Clone ID: PAT_TA_100377
gcacgaggagcagaggatggacgtgcataaaaaggatgagactcaatgagaagtcacatctcgagaaatgtgcatccgatgactgacaagatcccaacactgatagcccttgtgctcatcactgtaacctaagaagacattcaacagattgaccagaggatggacgtgcataaaaaggatgagactcaatgagaagtcacatctcgagaaatgtgcatccgatgactgacaagatcccaacactgatagcccttgtgctcatcactgtaaccttagaagacattcaacagattgaccagacagtttggtgcgtgaagaacgtagcaaacacaaccaaacaaagtgtttagtactccatccgtccgaaaatacttgtcagagaaatggatgcatctagacatactatagttctagatacatccatttttatccattgtggggggggnnngagagcnnnggatggatgtgcataaaaaggacgagattcaatgagaagtcacatcttgagaaatgcacatctgacgactgacaagatcccaacaccgatagcccttgtcctcatcactgtaacctaagaaggcattcaatagattgatcggacagtttggtgcgtgaagaacgtngcaaacgcan

SEQ ID NO: 100378 - DNA, 426 bp, Triticum aestivum
  unsure (1)..(426): unsure at all n locations
  Clone ID: PAT_TA_100378
gcacgaggggagagcgcgcgagagagatccagagagagcgcgagctgagcacagcaggcagggtggcacgagaatgtaaatactaggcaaggcagaagagaaccgtcggatgggaggttgatgcacggcaacgcgcgtgtccgtaagaaaaacagcgagacagagataaggtttgggctagcccacccagctacaatctccctcgctcgctgccccccaccaagctcacagctcgcctctcctccctaccctacctcgccggcgtcgccaccccccgccgcccccatgctccacccagtgcaccgcctccctgccaccccttcccgcccggcngtccacccgcacgtannncccgcgccgccctcccttcgtnnnnggcgagtggccggnannnnnnngacnnnncctnnnnnatgctnnnncgnt

SEQ ID NO: 100379 - DNA, 575 bp, Triticum aestivum
  unsure (1)..(575): unsure at all n locations
  Clone ID: PAT_TA_100379
gcagaagtgagctacaaggttgcttggaatcaaataaaaaactaactagggaaatagctgatctgcacaaagaattgagtaccatcaaaatgacaaagagggaggaatgccaatttgagtatggttctaatgcacgtgcagaagtggaagattgttgtgatgaggctttcatggacaacacagaagatatattaaacctgcagctggagttggacatacttaaagcaattcttgcagaagagaggacagtccgtggagaggttgaggaaagaactactaccttaagtgatgagctgaaagcagcaaatttacgtatccttcaagcttgcaagcagagtgatgccatagaaagcgaactgaatgatgcaagatctgttattgaagctcttgagtcgcagcagattttgttgataaatgaactagacgagttgaaaaagaataatcagaaaagctttgagattctaaaaaggaggggcagagaaatctcaagattaaatactgagattgacaaccaccgtagacagnnnnctggtggctagtggagaacccaaaatgcaacnnnntgaagtgtattg

SEQ ID NO: 100380 - DNA, 626 bp, Triticum aestivum
  unsure (1)..(626): unsure at all n locations
  Clone ID: PAT_TA_100380
gcacgaggctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagacgttaacattgtctcaaatgctagctgcaccactaactgccttgctcccctagctaagntcattaatgacaacttcggtattattnnnnnntttgatgaccactgttcan

SEQ ID NO: 100381 - DNA, 622 bp, Triticum aestivum
  unsure (1)..(622): unsure at all n locations
  Clone ID: PAT_TA_100381
gcacgaggcggggctccgccaatataaccctccgccctcccttttctctctccaaccactccgcctcgcctcgcctcgcccagcccccctgtcctgtcctgtgcgcccgtcgcgacaaccatctgactaagcagcgccctccgcgcagcggcccatggcgccggcggtggggatcaagcgggccgccgcggcgcaggccgtcacggtgcaggcgccgccgccgccgcccgacgcgcggctggtgcgcgaggccgtgcggacctccacgatcgccgaggccgtcgcccccgccgccctgcaggctcccgcgcccgcgctcgagggcttcctctgcctcgaggaggtggaggggcggcggtggaagtacgtggtcgatgcagcccccgggaagggcaggggcaggggccggggcgggtccgctgttcccctgggggcctccgtccgggccgtgccgctccagtcgccgnnnnngcccgccgaggaaataatggcgttcgtaagancgtatgttgtgcctgaagggtttccagacagtgttactccttcatacgtcccatacatgacctggagagctctcaagcatttttttggtggagcaatggggtgtgttcacaacaagann

SEQ ID NO: 100382 - DNA, 596 bp, Triticum aestivum
  unsure (1)..(596): unsure at all n locations
  Clone ID: PAT_TA_100382
gcacgagggcattacccagcagatcgggaagatccttctcacctcgtcgtcaagcagcagatcgacctggccgcctagatccattccccatctccttcccatcacatttcctctccacctgcaggtgtgtcattatggcattaggaggatgagccccctctccccgtctcatacacgatttggtgcttcaccattttacccatcggatggatctgctgcaagagtcggatccaacaccaggagaacctgcagctacttctgacattttataagttaactcttgtttcctctaattttagtataaatgtgcctccccatttggcgatattgtaaggatgtctaaaggactacaaccggatggcgctcgactctttgttcagcacattccttgttgacaacaaactagcagtatatgtggagctcttgtgtggcattgctacaatggtgctagatgagagtggaaacaatgtcttatgttttgttcttattttatgttgcaaacataagtcagtaacaatttgttctttacggacaactctgtaattcccttgaagcatatgtaattgttgcacnnnnnnnnnnnnnnnnnnnnnnnn

SEQ ID NO: 100383 - DNA, 416 bp, Triticum aestivum
  unsure (1)..(416): unsure at all n locations
  Clone ID: PAT_TA_100383
caacaatacttcaataattagttcgggggactggggttttaccccccngnnnnncgaaacaaagaaaccaanggacaactggacacaaattaataattattattatagctggccaccgggccgctgnnccaaagctcaaatgcttgnccnngacggactaagnaccggtaggcgggacaggcagagggggnncgggcgccggcaggccggtaaccatgaaagccttannntcttccacggttgaagggcttacagctccatcgttttctccaatggtgaaagagtgggcaagggcactggggcaaaggggtggctgcattccgggatcaaatcctcctaccctgatgccgtcatccccggggtaggggtgggcatgggcgctnaccnnaagntggccnnnnnnnagcgccaaaagg

SEQ ID NO: 100384 - DNA, 263 bp, Triticum aestivum
  unsure (1)..(263): unsure at all n locations
  Clone ID: PAT_TA_100384
caccacccaaaaggggctttagaagggtattttatnctngggggaaaaccccggcccttgtttggcagtttactccctggtccccgtaaaaccttcggggggggggtttgaattttcagcacccaaaaggggctttccaggggtaaattaagcttctttacaaaaaaanngggggccagagcttagtttacttttttttttttgggggggggggttcctccttgttgaacaagggctcgttggggggggcctaaacgatttta

SEQ ID NO: 100385 - DNA, 621 bp, Triticum aestivum
  unsure (1)..(621): unsure at all n locations
  Clone ID: PAT_TA_100385
gcacgagggcagagaggagctaggagagagtttgattagctagcgagaagataggcatccccttcatggctggcctgagcgttctcctagagacccaggagagcaactccatcaaggccaagatcatcagcaaggccaccctccatagccccaagatctcctcatccccttggtcaccggcagcgaggcccaccgcaagcacgggttccttcttgcagcgctgcttgctgtgccacaaggatctagccgagaacaatgacatctacatgtacagaggtgacaaggcgttctgcagcgtggagtgccggtgcaggcagatcttcatcgacgaggacgccggcagcagcttctgcgccaagggcgcctccaccgccgccgtgcggtccggccgccgcgccactgccaccggcggcggcgtgagcttcgcgtactgatgtgctacctccaacaccaagcaaccggatgcacgtagtgctagcacgtaacgtacgtgtgcaaaagcaagaagaaaagaaaagagagctgtttaaagaatggagttaagtaccgccgttatgtgacagctcgtcggcgggggcccacaagcgacggggagcgtacgtgtctcatggccgtacctnn

SEQ ID NO: 100386 - DNA, 609 bp, Triticum aestivum
  unsure (1)..(609): unsure at all n locations
  Clone ID: PAT_TA_100386
gcacgaggatcagttatttgcgcaatgtattcacatatgcctcttctactgtaccagttttctgaactagcctggtggtacttcagaacaacattgtattctccaaaaatatgaaggtatgaaaagaagtattctacactttggaaattcagagattaattggctacattggtgcattacgtatcggcctggggtggcctgccatggagatcgacgaggcagcagcgcgactgtgctcagcgcagtttgaggggtagaagacagagaagtccatcgctgcacgcagcggcagctgcacgcagcgcatccacggctggcggagcatcgcgattaggactagctggaagtgctacttcgagtatagagcaccgccaactagcgtaatgtttcgtattcgttttatccgttgtactatgcacttttcgtattcgttttatccgttgtactatgcactgacagccggactgactcatctgccgcaagcactgcatatgtatagtacaggcgaaaggacacaatattactgttgcaccgaacactatataaagtaaacacttcacccagctgcatgtatttaaggctcatgcaccagccgctgcgtgcannnnn

SEQ ID NO: 100387 - DNA, 600 bp, Triticum aestivum
  Clone ID: PAT_TA_100387
gcacgagggtttttttttctcgagcacacatatggctgagtttcattttgtagaagaaggcgtcataaggtttacaaattgaaaccaaaagcaaaacgcaaaaaggcaacctaggcgaagcaaaagaaagaagtaaacccaaaacctctaaactgttagaaccagactcgaggtagagagggtgagctgaacacgggagagttggtttagctccagcgagcatccacagcttggcttcacacaggatcaagtcaattaaagctgagcaatcaggtgcggtgccattgacgacgcagtcattgcgcaaggtccagttgtatagctgactattcagactgtaattatcttggccagtaagtctaatccattttcttttatctgattctacaatggactcgcatgttgataaactgtgttaagtaaacttcatttgaggatcaaaatgcaagaaataatgaaccagcatgtgcctagttgtaacatatcaatgcaggctgcaggttattttcaaggagaatgtgttactttatgcaatgaatatcacccttttgacaagttgtgatgcatcattttacatctatgcaataaattattaaatta

SEQ ID NO: 100388 - DNA, 621 bp, Triticum aestivum
  unsure (1)..(621): unsure at all n locations
  Clone ID: PAT_TA_100388
cctcgtgccgaattcggcacgaggcctcgtgccgaattcggcacgaggttgcccaccacctagcgccacttctccaccggcagccgacgcgcaccaccagacttcctcctacgcctccgccacaggcccggccaggcctcgcgcgtgcaggccggccgccagcccggagcccatacacagccagccgcgctgcaacaacgccgccgcccgtacgccgcctcccgcaccaaccacgcccgagcaagcaactcccctcgaccccggcgcctgcagctcctcctcggctccccgtccggcactcgacaccgtcaccggctaccccctgcaactcgagccgttgctccgctgaccttctccctcttcatttccttccctaactccagcctctggatctcttcctcacctctcacctccccgtatcttttctatacaggaagcatcacacccgcgccatgaatctccgaccctgatgcccaagctcccgccgctgttcagcgtcagatccgcgccgccccaccttctccgaccgtgtcgggagccgccgtcgctgcctgcttcgtctnnncntggagacgatgaacgccaggagcacccacgacgtccagcgccaagtcctgctnn

SEQ ID NO: 100389 - DNA, 325 bp, Triticum aestivum
  unsure (1)..(325): unsure at all n locations
  Clone ID: PAT_TA_100389
gggcaaattttttattttggaacaacaaaaaaactttttacaaattgcccattggacaaaaaaaggcgcatttaacacagggaattggcccgatttaacatttaaaactggagggttaatggcccccaaaattggggaaataaaataacccgggcccattttgggcggcttttttttttttttttcttggaccggggtcccttccttttctggggggggggctcgggcaaaaaaaagctttccccttaagggccacaaaaaaaacccttatttgggggggggccgtcaaaccttannnaaaaagttttatgggtgattttgaagg

SEQ ID NO: 100390 - DNA, 640 bp, Triticum aestivum
  unsure (1)..(640): unsure at all n locations
  Clone ID: PAT_TA_100390
gcacgagggaataaaacaacagcagatccaaaagcaggtgtgggacattgtcaaggatgttcccaacaacattctcaagcacatcgtcctagagaacaatgagggcaagccggtcacaaacagccgtgacacacaggatatcaaccttgagcaaggtattcagatgctcaagatattcaaagagcatgtcagcaagacctctatcctggaagacttcgccttctatgagaaccgccagaagttgatgcaggagaagagaataaaacaacagcagatccaaaagcaggtgtgggacagtagggctccgaatcctgttgccggagagaaacagcaagaactcgccaacgggaagccaaaggtgtctctaccgaacggtgtcaatggggagaaacagcaggatgctgtcaatgggaagccaaagtcacctgtagcaaatggtgtcaacggggatgcgaaggttccggcagagaaagccgctgccgctgctcctccagctgtgacctacgcggcganggtggcccaaacagcagcggccgagaagaagcctgtggccaccgagnnnaagcctgtcgtcgccaacggtgctgtcaagnnnggtgtagctgcttgatcgcatacctgatcctcccagctagccnnn

SEQ ID NO: 100391 - DNA, 568 bp, Triticum aestivum
  unsure (1)..(568): unsure at all n locations
  Clone ID: PAT_TA_100391
aaaatattgtaaacagaataatataagatgcagcgtacatggcagattcttccggtcctcagtgttccaagtcatgtaaactctcaacagccttccaggtaaccttgacagaaatttttgtggaatcatgaagatacaccatttcatgcactgttccatgataccccgaaccaaatcgaccttcccacatacaacacggcagctcttgagaaaaaccaccatctttcggggatccttcgatacaaagaataaggtaactgtatctcatcactcctacgaccgaactcattctgcaacctgattctgtaactccagaaaggaggcggatcacatctctgaagccactcgtcttcgcataaagattcagattaaggccattgacaggagcatgaagtatctcaacatcaacttttgcttgaactgcattccacaacaccagaaacttcatatccaatccacacttttccccatacagacgccgagtttcgatgaatggtcttgttttgtgcatgttcataaactcagtaaactcggtacatccttcaatcagnnnnnnatcttttggccc

SEQ ID NO: 100392 - DNA, 510 bp, Triticum aestivum
  unsure (1)..(510): unsure at all n locations
  Clone ID: PAT_TA_100392
gcacgagggatcccatcaacccctcccaccatcgcatccctcctcccttgtccccatctcctcaccgccgccgccacctcctccccgtccccggcaccctcccgatccagtcctccgtctcattcccctcgtccaaacccaccaacgcgacggcgcacccacccacccaccaacgcgggctcctctctccctcgtctctccctctcccccgcaccactcctcgctgccgccaccaccaccacctacggcgcccgatcccgcctgaatccggtctcctccggcggcgccgagcacaccacggtgaccccatccctccgctgcttcctcccatccatggcggcgagcgagccagccaaatcgacccccgttccccgaaagcagcggcagcaccacccacccatggcttccctgacggcgagatccggnntncgctccctggcgnnncgcgccnnnccccccgccccggccccgnnngggtgcngcatatgnnncnnnnnngtnggagannnn

SEQ ID NO: 100393 - DNA, 619 bp, Triticum aestivum
  unsure (1)..(619): unsure at all n locations
  Clone ID: PAT_TA_100393
gcacgaggctcgagcctcttctatcttggtgaacagcatggatgttgatctcaccatggatgtggtggcccttaccactgcatatcagatgtgggagcaccttcgccatcgctatgagtctacaggggatgccatgtatctctctgttgttcgtcaagagcaacaactacaacagggagatgctactgtggatgatttctacaaggagatgtcggcggtgtggcgccaattggactctctgggagctgatgtttgtcgcagatgtcagtgttgtgtgcggcaacaagctaagctggaggttcgtcgcctctacgacttcctcactcgcctccggccggagttcgagcagagtcgtgctcagctattggcacgccatcctcggctctctactctggnnncccttgctgaggtgcgatctgaggaggtgcgcctacggagcacgggcttattgccatcctcttcagcagtcctggctgcccgcgttccaccaccgctgcctggtgtgccctcttctacacaggtggcagcaacctccactagtgctttctgcaactactgcaagcaggatggtcacatgatcatggagtgcatcaagnnnnnnnancnnngncgnngnnnn

SEQ ID NO: 100394 - DNA, 619 bp, Triticum aestivum
  unsure (1)..(619): unsure at all n locations
  Clone ID: PAT_TA_100394
caactcccgctccgctgccactagtcaccatctcgagtctctgcccgatttttattactacggagcaccatcatcgcccacgcccaatcatcgttcgtctctaatccccagaagcacccacctccgcgcgagatcccacgcaccaaaaaccgcgcgcggattctcgccggcctcgatctcgcgccgcgcctgctgcttggggggccgtacgtcggctgtgggaggcgatggccgcggcggcgaagctgacgcggagcttctctcggcagctgtcgtcgggggcggcgcgggtgtggcgccagctgtcgctggagccgcacaccccgcgccggggcgcggccgcggcgacgggggccgtggcggcggcggggccgaccaggttcggcctcgcgaggcagtcgtcgctcgacccgacgccggcgcccgacgacggggcggtgctggccatgccggagaacctggacgccaccatgcggctgctgtacgcggcgtgccagggggacgcggccggcgtggaggagctcctcggggaaggggtggacgtcgacagcattgacttcgacnnnngcacggcgctgcacatcgccgcctgcgnnngccggggnnnnngtggtgnnnn

SEQ ID NO: 100395 - DNA, 427 bp, Triticum aestivum
  unsure (1)..(427): unsure at all n locations
  Clone ID: PAT_TA_100395
aaaaaagaaagcataaaagattgcctgtcccaaccaaaagaatgggttggttggtgggggggagggaccaacaaccacacgactggcttccatgaagggaaaccccccaaacccctccccattaattcatgccggcctgcttactcctcctcttcatcgtcgggaaggaaccggggatgctttccctccggggccggcaggcccctaaacagcgcgccgtgctctgccggcgcgttatccacctcctttctatcaacgatttcgtggtgggggttgcaaaccaaccgagtgtgcctgccctcgaacgccggcagaccgaccttttttttttcctccgcctcaaacaccgacagcttgttcattccctcacacaaataangaaagcactcgctttcataatgatcgcccacccnntcctcctcctggg

SEQ ID NO: 100396 - DNA, 631 bp, Triticum aestivum
  unsure (1)..(631): unsure at all n locations
  Clone ID: PAT_TA_100396
gcacgagggctcggcttcttcgccttgcaacagccccgtgaagaaccaacagaagggagctctacgacgtccatgccgctcttcaccccggtgccatgctccccccaccgcttcctcgccatccctgatcagcctcgaggcagccaggcggtggtgctcgcctcgcaccgtggccttcttgttgtgcgcttcgtcccactcgacgccatcagcatgttcgagaaaatcatgatccttgctgtgtgcgatccaatcgccggcacaagccgcccgctgcctccattgaagtgcaataggtcattccgaatagaaggatgcacccttctaaccggtgccgattgtcgcccgaccaaacggcgaggggcgtcgccgtcagtctactcgtccttcaaagtgttaatcatcagttacgacggacggtacaatctccacgtgtccgcgtccaatgagttgagctggaggacgtctagaaactggtttgaacctgttgagtatgccggacgtgtggtgccccagcagatcaacatcgtcgtgtgccgaggcatggcacactggctcttcaagtactcgtcagacttctacacactcaacgtgtgtgctangnccatgcagatgtctataannnngctcc

SEQ ID NO: 100397 - DNA, 628 bp, Triticum aestivum
  unsure (1)..(628): unsure at all n locations
  Clone ID: PAT_TA_100397
gccaccaccacctcccgtcccgaccccgagacagacacctcccactcgcggccatgcccccctgccaccgccgctgctgacctgaccacccagccgtccgcgccgcgaccggtcaacatctatctagccggaacatccatctcaagcaacatggacccggcccaggaggagctcgagcgccgcagccgctacctcagctcgctcgtccgccgcaccaggctcgacgacccgccccaaccggagccggagccggagcccaaggtggagcgcaaaccggcggcggagcccagcggcggggagggcaaggccgctaagccggagaccaaggaaagggaggcggcgaaggtcaaaggggacgccgcgagcggggaggggaggaanntggcggtgcgggtgcgcgcggcggacatgccgctggcgctgcagcggcgcgcgatctggatcgcccgcgaggtcgtcctctccacgccgcgcctcgagagcaagcgcctcgcgctcgcgctcaagaaggaattcgacacgacatacgggcctgcttggcactgcatcgtcggcacaagctttggctcctacgtcactcactccctnnnnnncntcctgtacttctccgtcgacnnnncgtacannn

SEQ ID NO: 100398 - DNA, 412 bp, Triticum aestivum
  unsure (1)..(412): unsure at all n locations
  Clone ID: PAT_TA_100398
aaaacaaaacagtttnancgatgaaaaaatgancgccagggcccaagacaaaaggacctttcgcaccacaaacccacaggtgcgggggacgggattaccaaatgacgctcggaaacctaagaaacggggataaaaactaaaaggcaacccggacacccaaccagttccgaaacagggacacaaactaaagaccntcacccaaccgcccccgcgacgcaggtttgcaggccgggaaacaattaaaaacccaccacgaaacaaaaattggaagagggggagaccggaatacttaaactccccgagctctagacccccatgacggcgggggggctccggggggcggggggccccggtccccctttccccatatagagaaccctctcacacgggcccaggggccacaatttannaa

SEQ ID NO: 100399 - DNA, 633 bp, Triticum aestivum
  unsure (1)..(633): unsure at all n locations
  Clone ID: PAT_TA_100399
gcacgagggcgacgcgatgctctcgcggcctctagtctaagcacccccgacgacgtcggcgactcaccgccggcgagccgatccacgccgccgccccatttcccgcctgtgtcgtgcatgtgatctggcgccctctccggatcctcttcttccatgggattggggggcatgagaggcggcatcgggggagggggcgccggctcgggcgagaggtggaggtggatcctcttcctctcgctggtctccgtctccttcctcctctcgttcctcttcctcttcctctccgcctactcctccccgacgcgcctccgcctccctgggctcaccaccgcccgcgccgccgccggagtccgccgcggccccgacgcgctcccctgcctcgcctacctcctcatcggcggccggggcgacgggcaccgcctcctacgactcctcctcgcagtctaccacccacgcaaccgctacatcctccacctctccgccgacgcctcccacgaagagcgccgggaccttgctgcnnngggnncgccgccgcggcgcccgccgctgtctctttcgacaacgtcgctcttgtgggcacgcctaccgcggggacnnngtnnnnnncgtnnnncctcgccggcacgttacgcg

SEQ ID NO: 100400 - DNA, 618 bp, Triticum aestivum
  unsure (1)..(618): unsure at all n locations
  Clone ID: PAT_TA_100400
gcacgaggcccacactcgcagctccttcttcctcctcctcgaatccattccatccacaactaagctcatcctgattcagaatattctggtgaccaattcggccgacagacatgccgccgccgccgctggcccgggccgctcggcgcgggttactcctcctcctcgtcctgcattgctgctggggcaccctcctctccacggccagcgccgcccacgtccacgcggcgggcgacggcgtcatcatcagccaggccgactaccagggcctgcaggccatcaagcacgacctctccgacccctacggcttcctccgctcctggaacgacaccggcatcggcgcctgctccggccactgggccggcatcaagtgcgtcaacggcagcgtcgtcgccatcacgctcccctggcgcggcctcggcggccgcctctccaaccgcgtcggccagctcacggccctccgccgcctcagcatccacgacaacgccatcgccggcgccatccccgccgccctcggcttcctccccgacctccgcggcctctacctgttcaacaaccgcttctccggcgccgtcccgcnnnnnnnngnccgctgcgtcgcgctgcagtccttggannnnn

SEQ ID NO: 100401 - DNA, 641 bp, Triticum aestivum
  unsure (1)..(641): unsure at all n locations
  Clone ID: PAT_TA_100401
gcacgagggttacatattgtgacagaattaagtaggcatatgcttattcgttgattcttataccgaaactgaattggtattgtgttaatacattatagtcatccttgaaggacatgtgttttattgccatgcatgcttaataattgcttgctgaagcattggtcctaatttttaccatgggtttcgctggcgttgcgttttctttttgtatatggttgctgcagtggccattgaatagtgattctatccattagtagtatcttgtcattatgaaagtttgtgtattttttgtacatatgaaggtttgtgtattttgttctcagctgcgttgctacatataaatttgaggcaaatgatgatacggttcagactcacccttttctgattttatcttgtcattatgaaggtttgtgtatttgtttttgtgctgcatataaatttgaggagaatgattttatggttcaaagagacagtctaatcatatttgagctgccagcttgcttcagccatgtgataccggagcctgnnnntgacagtggccaaatgactgaacttgttcgcaacattaatagtagtagtcttgataaacatagcattcctcaccnntntgtaccgttcgcctgtttgcatgnnnanaacag

SEQ ID NO: 100402 - DNA, 537 bp, Triticum aestivum
  Clone ID: PAT_TA_100402
gcacgaggagaaggagagggcaaggcggaggccagaccagctcacgagcagcagcagcaaacgggtaagtaaaaataaatatctttcttcctgctgtcggtggcatggcatggcatggtatggacggaatgagtgagcgaaagggggctgtgtttttaccaaaagcagggccgccgaaagcagagggccgcgcgcgcggcgtcgggaagagagacgacgacggcgcggccaagccgttcggtatgtgtcaaatattcctcccccctaactaaactagcagcacaattagtgtgatgagatgtcgcattttgttcctgctctggtagaagaaaatatatagtacaaggataatggtttggttcgattcgtgtagtagctttcggacgtactctgtgtacctactgcctgctcactaatgctgctataaatgtgctgattcgatccgattagctttgggacgcacggtacgtatctggtggtcaccagtagtactaccagtatttgtatcaattttataaatgaaactaggctatttac

SEQ ID NO: 100403 - DNA, 513 bp, Triticum aestivum
  unsure (1)..(513): unsure at all n locations
  Clone ID: PAT_TA_100403
gcacgaggaagccattttagtcacccgcgtacacgttgcaggacgagatttgcagggcatgccatttcactcaccattaacatagtacatatgcagtgtgtagttggactgcgcaaataaatcatgtcgagacaatgttctgacttcattaaacaagcgattattatcgaagaggaaaaaccttttgagatatccaagaggataaagaactgtggttctttttcaaggatgttctgcagaacaagtacttgcttttttatttagaggaggatcacccggcctctgcatagaacaagaacttgctggttcttaatgcaatccgggtccagacagatggcaacttttctgattgtactgttttgatggcatttttccatctccagttttaatttagctaactacaaccttgacaggaacctgcaacaaataatttacatgggtaaatcgaatggtaatttgannngntgtannnnnannnnntntactnnnannnnncactnnntnnannnnnnn

SEQ ID NO: 100404 - DNA, 630 bp, Triticum aestivum
  unsure (1)..(630): unsure at all n locations
  Clone ID: PAT_TA_100404
gcacgagggagagaggaggagaggcgtatccctgcccggccacccaagccaagcccctcccgaatctctctctcctcccctcccataccattgccccccgctccctccccctcccccacgacacgcacagatccacccgcggccatggcccccgcaatgaggccggagcaggaggcgagctgcaaggccaccgaggaccaccgctccgagttcgacgccgccaagccgccgcccttccgcatcggcgacgtccgcgccgccgtgccggcccactgctggcgcaagagccccctgcgctccctctcctacgtcgcccgcgacgtcgccgtcgtcgcggcgctcgccgccgccgcgtggcgggccgacagctgggccctctggccgctctactgggccgtccagggcaccatgttctgggcgctcttcgtcctcggacacgactgtggtcacgggagcttctcggacagcggcacgctcaacagcgtcgtcggccacctgctgcacaccttcatcctcgtcccgtacaatggctggaggatcagccacagaacgcaccatcagaaccatggccacatcgnnnnnnacgagtcatggcacccgatcactgannnnnnntaccagnaattggnn

SEQ ID NO: 100405 - DNA, 372 bp, Triticum aestivum
  Clone ID: PAT_TA_100405
tgcctggttgcccacggccacggggtcgacgacgacggaatgcagctgatgtagatacatcctgagcggtagtgctattctactgtccgcattgcagatatatggttggtgatttgccacttgttaaattacatgatgagatgacatgagctgtgaaaaaggagcgagcaggacacaataaagatgatgtcctgacttcatttttgggacgtgttttctcagtaactatcttgttcttgctcattttgttgaaagatggtcttgtgttctgtgaagatgtgaacaaaaatatgtattcacaacaaagaacacaaagatgttgtggtgatgtaaagtccgccccagcatctgtagttttccaaaaaaaaaaaa

SEQ ID NO: 100406 - DNA, 605 bp, Triticum aestivum
  unsure (1)..(605): unsure at all n locations
  Clone ID: PAT_TA_100406
gcacgaggcgcaggccgtggtgcgtggcttcttgggcgacggggataacaccatcctctccaccgctgtcctcaacttctacgcctcatgccgggagcccgaccttgcgcggcgggtgttcgacaggatggcacgcaggaacgccgtcacctggaatgcgctcatcaaagggtacgcgcaggcgggccgccgggacgaggcgctggcgctgttccgctgcatgaggagacagggcggtgtcgcccccgacaagtacacgttcccggcgctgctgtccggcattggcaggaaccatggtggcggctgcgtgcaagaactcgggggagccgtgcacgcgcaggtcgtcaaatccgggctggacaaggatccgtttgtgggtgcttccctcgtttctatgtacgcggctacaggagcactggaagatgtgaaggtcgtctttgatgatgtggatactttggacccggttgtctggtcttctatgatctctgcgtatatcaactgcaaggnnnaagaagccgctctccttacattctacaagatgttgtgccaagatattaagccgnnncagtttgtgtactccagcctgtttgccatctgtggangnn

SEQ ID NO: 100407 - DNA, 632 bp, Triticum aestivum
  unsure (1)..(632): unsure at all n locations
  Clone ID: PAT_TA_100407
gcacgagggcggctaggtcaaccaagcggcggtgacggcggcggaccggacctcatcagcgccctccccgacgacctgctcctcctcgtcctcgcccgtctcccctgcgcgggcgccgccgcgcgcaccgggatcctctcccgccggtggcgcgacctctggccccatcttcgccggatcgtcttccgcgacatcgcgttcgactcgatcgaaccggcgctcggccgcatctctcccgtggtttccctcctggaaatccacgcccgcgcgtcaactcgccgctggtcgactgaccgggtcgacacctcccgcgtgaactcgctgctgcgcgccgccgcaaggctggagccggaggagctcgtcttcggcctctcgtcggccttgatcggcgattccccagtcgtcgatctgccctgcttcaaccgggccacttccatcaagctcggccttttctccgccatacgcgtgccggccggcgtcgaggtcgagttcgccgcgctggagacgctgtacctggcgtgccgcattgacaccctcgactccttgctctccagctgcccgcgcctgcgcacgctctatctcagcagcactgagttgaagnccacctgnnnntcaactcggcgtcactgctg

SEQ ID NO: 100408 - DNA, 378 bp, Triticum aestivum
  unsure (1)..(378): unsure at all n locations
  Clone ID: PAT_TA_100408
aggcaaaacttcaagcccttggacaaaatttcccacggtttaaatttttttttaanaagtcgggggaccttttgaaccgttgataacatttggctaaggcaggacttcccaatttgctttcagcagatttgttttaagttttaacgggtcgatcccacagaggggggggttagtccttttcctccacaaccttgggccccaaacctttaaaacctttcgggggggcttcagcaanggggaccagagggtacagctcctccttagcctcctcctgggggttcctttgggggggaatcctggcccgggcttttttgggggccctcctggggccggtggtccaaatgggcttgggggcttnnnnnnnggggnnnnnnnnnn

SEQ ID NO: 100409 - DNA, 617 bp, Triticum aestivum
  unsure (1)..(617): unsure at all n locations
  Clone ID: PAT_TA_100409
gaaaatttcccttcctgaggatcttgtcttgcatgaaaatctgtctgaacttgctgacattttaagtgaagatgacactattctgtcaacttcaatctcttttatctctcgcaactgtcattctgtagagactagagatgagcctgcagtagtgtcagttgattcatcttctctttttgagcaccgtaaacggcacgggatatactatctcccaacaggaaaagctgaggatgacgcaaatagctaccctcgtgccaatgatcctcttctttccgctgagaatgcaagtgccatggaggataaatccgagactgtccagcctgtatctgctgggaaaaaattgaaggccatgaggtccagaccaaaagtagtgaaattggatggcgaagatttcctaagttctatgatgactagtgcaaatattctaaaggctgcagataagtcagaagtcatgggcaaaaaaatggacactggcgaatctagttctcaatggatacagaacatatatgctgatactggaagcctttctacttcaagttctaggacaagtaagcaacacgatcttactaaagagaagagcacaatacctcctgacagtgatannnnngngccgagnn

SEQ ID NO: 100410 - DNA, 184 bp, Triticum aestivum
  Clone ID: PAT_TA_100410
gcacgaggagagagagagagagaacttgtctcgagtttgtttgggttcatttcccatgtgttgtgtgttgtttcaaagttagggcgactgggtgatcggcctatcttccttgtttaccatgtagacaattaatcatgagttttccatttggaatttacatttttctgttgataaaaaaaaaaaa

SEQ ID NO: 100411 - DNA, 624 bp, Triticum aestivum
  unsure (1)..(624): unsure at all n locations
  Clone ID: PAT_TA_100411
cacgaggacaccacccaacgccgcgctgaacaatgcgattcactgagctactacctcgctctccttgctgatacaccaccgcctcgcgacctcgcctcgagagcccaatggccgcgcgcatgacgcggcgccctgccgtgttcctgctcctcgccgccgcccttctcgcggttgcggtacagccggcggcagcgacgctgcatccggtggactacctggcgctgcaggccgtccggcgcgcgctctccgacctgccgggctccggcttcttcgcttcgtgggacttcaccggcgacccctgcggcttcgcgggggtctcctgctccggcgatggccgggtcgtcacgctggccctcggggacccgcgagccggcgcgccgggcctctcgggcgcattcccctctgccgcgctcgcgcgtctctccgcgcttagctcgctctcgctcgtccccggccgcgtatccggggggttatcctccgccgtcgcggcgctcccgtcgctccgcttcctcgctctgtctgggaacctcatctcgggcaacctccccggagcattctcccctgctcttcggacnnnncgatctcagcaagaactccttctccggcaagataccctcgtcgctn

SEQ ID NO: 100412 - DNA, 446 bp, Triticum aestivum
  unsure (1)..(446): unsure at all n locations
  Clone ID: PAT_TA_100412
tcaatgtcaaaggtctaaaagatgatttggcccttaatctcttcaagaagattaatctcaaagccgagaaactgtctcaatctttccctgaggtagtagaaccaattttaaagcatatcatgtccaagtgtggtgggcttccagaagtaatagttgctgcaggaaaaattgccatcccatactcagagagaattagttccttggagcttttcaatgctgaattgatggaaatattggagaactcgttaagctttcctagattaaagggtatcttttgttggatgcaatcctattttgatgcctgctcagatgaactcaagccatgtatcttctatatgtcagtattccctatggaccaaagcattaggcaaaggcgtttgctcaggcggtggattgcagagggnnctcnnnnnnnnnngnnnnnnnnnnnnnnnnnnnnnnnnnnn

SEQ ID NO: 100413 - DNA, 600 bp, Triticum aestivum
  unsure (1)..(600): unsure at all n locations
  Clone ID: PAT_TA_100413
gcacgaggcccacctccattttcgtgcccggccaacctcctcgccaccacttggcgcgctgtcaatggccagccgccgccagcgccgccgccccgaccaaccgggcgcctccacgtctccctgcctccctccacctcccgcggccctcagggcccactggagcccgccccgagcccatccagggcccgagccaccgccgccctcgcgtccgagctccccgtgcgggagagctcccgatccagcgtgtcctcgccgcctcgctgacccgccatccgcgctcgtcggcgacgagcgccgcccatcgtcggagacctccagcaggccagtgcgcccttgcctccttcctttccccgctctctccctcacgccctctcggctttcctcgcagggaccctccatggcgcgccgagctcggatctccgcccgctgccgttgtccatcgtcattccgcgtcgagaacgaggctgcccactcggatcttcccgcccaggccttttccttgtcggatctggcggatcccacccggatccgctcgccggtgctcgtccccggcctcccttcgcgtcggcatcaacctcctgccgccgtccagcgtccgcn

SEQ ID NO: 100414 - DNA, 393 bp, Triticum aestivum
  unsure (1)..(393): unsure at all n locations
  Clone ID: PAT_TA_100414
gaaaagcctttgggccctcctgggtggggcaacccgaacaaaccctttggccaacttatacgttctttaacacgctggggttaacccttactaccaagttaacgggctacatcccccttttacaagtttaaacgggatnactggccaaaaaaacttcttttaagtttttcccaactgaacccgaaaccgggccgaaactgaaatccnntcnaagtttttttaaaacttcttttctccctcaagggcccgcaactgggggggggggttcccaaaagaatttgctcatgggcccgaactccgggggggggggaacaaaattgccccaatnnccattcccctggaaaatggggnnntgcccnnnnttccccagggggggcggggccnngggctcct

SEQ ID NO: 100415 - DNA, 610 bp, Triticum aestivum
  Clone ID: PAT_TA_100415
gttgaacaaggactagcacagttttgaaattcatgctggcagaccttttttacctatgcgtgatcattatgtcaagtatgccacttataaggacaacatcaagccatttgagagtaggggtccaacttccctggagcatgttcctacgccacccctggcaggctgcaacctatttgcggctcggccatgcccactccccgtgcttcttgcttgtaccagcagtgaagactcaataaatacatgtcattctattatccaaaatccaatggcagaaggaagtggtgtcaaacaacatgttgcttgatgaaggaacaagacagttgaagaggaacatgaagcggtatagaaattcctctggaggccgagcatcttgtcagtctatttatattgaccagattagaaaaatcacagcggattgaatgtaaaaatcatgcaaataacttgtgtaaacttggaaatcccccctcccccctcaccctctcgcaacagcgccgccctcgcgggcggccggccgcgccccgatctctcccccctccagcccccctcttcccctcctcgccgccgtcactggcgcctgcggctggcctggccccggggtcgctggtggcgg

SEQ ID NO: 100416 - DNA, 601 bp, Triticum aestivum
  unsure (1)..(601): unsure at all n locations
  Clone ID: PAT_TA_100416
cacgaggctcgccaccgctcccagcaacggaaccaacaaatccccacccaatctcgtctccgatcgacccgaggctgntcgaatccccaccgcctcaagatgcagatatttgtgaagacactcacgggcangaccatcacccttgaggtggagtcgtctgacaccatcgacaatgtnnngnnnnngatccaggacaaggagggcattccgccggaccagcagcgtctcatcttcgctggcaagcagcttgaggacgggaggacccttgctgactacaacatccagaaggagtccacccttcaccttgtcctgcgtttgcgtggnngcatgcagatcttcgtgaagaccctcaccggcaagaccatcactttggaggnnnagagctctgacaccatcgacaacgtcaagnccaagatccaggacaaggangnnnntcccccggaccagcagcgccttatctttgctggcaagcagctggaggatgnnnncacccttgccgactacaacatcnnnnnnnannncaccctccacctggtgctgcgcctgcgtggnngnnngcagntcttcgtgaagacccttactggnnagncnnncactctnn

SEQ ID NO: 100417 - DNA, 575 bp, Triticum aestivum
  unsure (1)..(575): unsure at all n locations
  Clone ID: PAT_TA_100417
gttgcccaattcagcggaatccgaggccctcttccgtgagaaacacgccgtccccccattggcaggctgctgctgctccagtgctcctgaaaatacactctaccacgtcgccccgcgccagctccggctttgtccagacaccgcacgtcgacacaatccgatcgatagtccagccagccattcatccgctgccgtcctcgatctctgctcttattagtacgcccccaccctctccctctcccacagtcccgcgacaccaacagctgcgccaacagcaacagcccagctaagcccagctcgcccaccaccagacgtaccacgtacagagagctagcagcaccatccatggccgccgaggagcccaagaaggtggaggtggaggcggcgccggagccggnnnccgtccctgccgcggagcccganncccccgccaaggacgtcaccgaggagaaggccgtcatcccggcgcccgagccggccgccgannnnnagaagccccccgccgatgactcnnnnnccctcgtcgtcgtcgannnnnnngcagatgaacctgttgctgagnaannnacaganna

SEQ ID NO: 100418 - DNA, 626 bp, Triticum aestivum
  unsure (1)..(626): unsure at all n locations
  Clone ID: PAT_TA_100418
gcacgaggtctgcaacaagcaaatcttctgtaacaagctcttccaaatcaaaaggaacacggattggagatcttgctggtactagtaaggccatacaacaatcattagcacttcccgccaatggttctgttcgagctccagccaaggccgagctttcaaagcttactctttcaggaagctttaaaatcctcagccgagagcaaaattgtactgcacagactcctaaagactctccaggcaatcctgcgagtcctccagctcgtgtggcttccatggaaccacacaagaagcctcctctcagccaaaagcccaaggtttccacacatgatcttcctctagtgcaaggttcatcttgtggtgttagcaaatcaagattaaagttcttccagtcgttgcgaaccaaatctaatggttcaagttcagccgttgagtcaggttgtgagccatctccatccagcggagttgatgcgaagcatgattcttgtcttaattctggaatgaaatgcatggggaatggaaagtgtttctgtgaagaagcaaattcttcngnnngatcccagcggcaccattcagncnatgaagnnnacaagtcatncttgcagtctgttgacatggcagctgggggg

SEQ ID NO: 100419 - DNA, 436 bp, Triticum aestivum
  unsure (1)..(436): unsure at all n locations
  Clone ID: PAT_TA_100419
caggtttaagaaagaaacactctggacgaggaaataattaacatgaatcagatatatctccagatttttctttttcatttcagtctgtttctaatatcgcagctacaaagccttacaccatgtaacttacgcgtttagtttccacaccagtttgttaccaaaattgtgctcttgaaggtaagccgtagcatcaacgctaacaaaatgaacaccgcagcgcagagtgatgagttagtgacctaaaggacttatatgagcaattctcctctggttctgcaaaaaagatcaaataagccttccaaggaaatatcatgatctctgccgaaactgctggcatgtttcactatatgcannnnntactatgacactgcnnnnnnntgntgnntcgacccaggcgaaccnnnnnnacggngagagcgcctannnngangtnnnn

SEQ ID NO: 100420 - DNA, 617 bp, Triticum aestivum
  unsure (1)..(617): unsure at all n locations
  Clone ID: PAT_TA_100420
gcacgagggggaggcggagcggcgcatcagggcgggggtgacgccggccaggacttcggcggcggccgcagggagcccctgggccgccagcccgctccccgacggcatcgcgccgtccccggcgacctccgcgtccacgcccaggcgattcttccgccgtccgttccctccgccgtctccggccaagcacatcaaggcgtcgctggcgcgccgcctcggccaccggtccccggctgctacctctgcgcaggcgccgcccgctaagccgccgcaggaggccccgatccccgaacaaggggccggcggcggcggaggagaggaggagctcgacaagagcttcggctacgaccgccacttcgcggtcaagtacgaactgggaaaggaggtgggtcgcggccacttcggccacacctgtctcgcgcgtgcccgcaagggggacatgagaggtcaagtcctagctgtcaanntcatctccaaagccaagatgacgacagcaatatctattgaggatgtgcgtacagaggtgaaaattctgaannctttatctgggcattcaaatcttgtgaagtnnnatgatgcatgtgnnnatgcccttaacgtctacatcatcatggagt

SEQ ID NO: 100421 - DNA, 619 bp, Triticum aestivum
  unsure (1)..(619): unsure at all n locations
  Clone ID: PAT_TA_100421
gcacgaggagacaccatcggatacactggaagattttgtggtgaggctcaagaagatggtggaggaaaacatgtacgccaccccaacatgcctggcgatacagaagcttacctgccagatggttacagaattcatgaagcatgatcgaaacatccaagtgattgataagcacaatatcgttggcacgttactgaaggcttcaaagacgatggccgagctcgagagcagcatgcttttcgctgctgtcattcgtgaccgctacggggttcctttgaagcctctttcatctgttctctccaaaaacacagaagatcttttgacacagaggaaacaggctcttggcatctacactgtgcctgcctctgtaccaataccactaccatgactgttgcatcacggagtatctcattatggtaaaagtaccgaaacaggtgcagagaccgggaatgtcatccttccattatctaaaagaactgcaaccgtttgtgcattaagattccaatccatcttctgcatcaaggcaagatccaagtctatattgcgcctgccagtgtacgagttcagcatggagctgccaactactgtcctgccgaatggcaatgcaattctcacccacgnn

SEQ ID NO: 100422 - DNA, 600 bp, Triticum aestivum
  Clone ID: PAT_TA_100422
gcacgagggcgactgggaaggagggaaggagggtttggtgcgtcggcgctaatgtcgggaacggagcagcagttgctatcatgacatattctcccctgggggccatgggcgtgaggcggccgtttgtttccttttttggtttgccagctggatccggggagaggcccactactaattttggggtgtgtgccctgggccgctagccagccgttgctggctagtcgcgttcaaaaaaagtagaatgcttgtcttgcctaaaaaagagtaaaatgcttgcctatatatatatatagtgttactattcatcacccagtgtgcacccgaggtaatcttacgatcatttcatagttaaattacgtttgaaattcaaatagttacatttctattgattcactacgtaaaatttgacataagaaaattaaaatataggtcataagacaagaaaatttgcagtttatgtgtattttagactatgtttttacgtttgtaattttacataacataaaatatttttacggcaattatatatttttttacggtctctttttgcgtcggaaataagacaaaacttacggaacacaaaattacggtgcattgatg

SEQ ID NO: 100423 - DNA, 526 bp, Triticum aestivum
  unsure (1)..(526): unsure at all n locations
  Clone ID: PAT_TA_100423
ataaaattgnnnntgatnnnttatcttacaaaaaaagctttcatcccactttataaataaagcaaccaccaagtacaaagtcaacaaggtaacatccgaacaacacacatacacaacgccaccgggggcaaaggtccaacacacacgcacaactcactccactgattcagttgtggacacatcacaacaagccaaaacaaacacaagggatgcacaagcaaacaggacgatggcaggttaagcttgtcgaaaaggtttcttgccttcaatcggaacgaaatgttggttcgctgttggaatttatatgtcgtggaaaaaaacgtatagtttccttgtgcgtgcaatccaaataacacgcgtttgtcaaattccatgtttgcgtgtttcgggaggtcgatccggcccggttgcaatttgttttgggctnnnntggcaccgcatgcatagtcagattgnnnctgacgtggttcccgaattactnnnnnctcatgtatatgttttaaannnaaagtgcctgtgtgttgcn

SEQ ID NO: 100424 - DNA, 461 bp, Triticum aestivum
  unsure (1)..(461): unsure at all n locations
  Clone ID: PAT_TA_100424
gctggtataaaacaaaaactatgcaagtacgggaccattacaggccacgttgattcactttgaaacccccaaaatgaaatcaaattacaatttaagtaactttttaaatcaacaaaaacctatttgcaactccaagttgaaaaatttgaaaaaccccggggtactggttggtctgccacccgtactggccgggcgtttgttttnncgacaacagaggatgacaaccctgaaattactggggaaacacaaaacacaatcgggttacatgaaaagcctatcgattttacatgaatagtctccattattgaaaaaaaaaaaaggatttccctatgctccttgcacgggagtactactatgttcaatttcttgcttgggtcaattcaataantgctgaccaaaaagaagcccatgggggggacnnnaatgggggacgggacccccaaccggaggggnntccaaaa

SEQ ID NO: 100425 - DNA, 397 bp, Triticum aestivum
  unsure (1)..(397): unsure at all n locations
  Clone ID: PAT_TA_100425
gcacgagggtagcctctcccactcccccctgctccctcccctccccacaaacaaatccctctcgcgcgcgccactgccgccgccacgcacgcacgcacgcgatcgtctcgccacgaccatgagcctcacggcggcggctgtggccgtgggcccgcccgcgttcgccgtcggggccgcgccggccgcggagatggagatgggccccgagctggcgccgccggagccgagccgcggcgtgggcggcgtcggggaggacggcggcgtggagccggagcggcgggcgtcgcggttccggcggatctgcgtctactgcggcagcgccaaggggcgcaaggccagctaccnnnacgccnnngtcgagctcggcaaggagatggtggagaggggcatnnncctg

SEQ ID NO: 100426 - DNA, 620 bp, Triticum aestivum
  unsure (1)..(620): unsure at all n locations
  Clone ID: PAT_TA_100426
ggatatgagcagatactcactcctcaccgcaatccgcacctaatttttgtatacatttgcctcccttctccttcctccgcactttgaattcacgctgcgcccggcttcctcacctccgcccccgcccatgcatgcgaagcagcagtgcttccattacttcccaattactcctctcgctctttctcccaccctcctcccttcaattgtcattctcggtccatcactcgagcctagcactagcaccagcatcattttcaccaaccttctacccgtgctcggtaatcttctccccgcgcgcgtttcttggctcgccccggaatttccatcgcaccaaccaccggccacctgcaccatatctttctttttctctctcgcctcaccgtaatcctgaattttcatcgcgccgacaccgaccgagccatccatccaccgccctccactttcccagcgaccaaatccaatcttcgcaaccacattgctgcggccctgcttcccttttgcacccgatcaacttcctcttcatnnnngctccctttccggcaccgccgtgcccagcatctggccgtttgcgngnnacagtccgatggtctttgnnnnntgattgcnnnnngcccgnnnnn

SEQ ID NO: 100427 - DNA, 453 bp, Triticum aestivum
  unsure (1)..(453): unsure at all n locations
  Clone ID: PAT_TA_100427
gagatgcattacgtactatatggaaaatatagagagatatgtactacaccaatcgatggccagctcgatcgacctctacactccactggctggctggcaagcaggagggactacgtgtgtactccctccgtccggaaatacttgttctaaaaatggatgtatctagacttattttagttatagatacattcattttctttattttcaggacaagtatttccggacggagggagtacgtatcaccagccagccgagcataagcaatccaaaagaatacacaccgacgggattcactcatcaactggccgttgatgattgaaaaattctttgatgatttggttatgccgggatcatcagcctcggcttcttgaacgccagcgggatgagcacctcctcctcgtagtcgtcgnnngnnnccgncatgcaccgctcgcgctcgnnnannntgtccgn

SEQ ID NO: 100428 - DNA, 624 bp, Triticum aestivum
  unsure (1)..(624): unsure at all n locations
  Clone ID: PAT_TA_100428
gcacgaggggtttccttttccttccttcctcggtaagctggccgagatatcgatcggatcagggggaaccgccccgccgagctccggatggcgacggcgccgctcggcgtgaggctcctcgtcggcgccgaggcgccgacgcccctccaagattcagccgaggacgccgcggccttcctcgccctgccggtcagcctgctcgggaaggagtgcctgatggacagcgccggcaacctctacgccagggtcgaggccctgccccgcgcgggcgcggccgaggacgccctcctccgagcgccggcgggcgcggtcgtcgtcggctccgcccagcgcctgctcgccctcgccggcgcaatgagagtggcggagcggctggccggccggacggcccccacggaccgcgccgagccgagcaccgcggccgacatggacatcgactccggcggcgacgccgtctcctcgagccattcgggaagggatccgggcgccaaaannnnncgcggcggcggcggcgacgacgcgcacggcgtgctccannnnccagcgaagcgccggatcctcgcgtggagggtgcgccggtaccggtccctggtggcnnnggccanngcgacggcgnnnnnngcc

SEQ ID NO: 100429 - DNA, 599 bp, Triticum aestivum
  unsure (1)..(599): unsure at all n locations
  Clone ID: PAT_TA_100429
cgaaaacaaggattcacagaagcaaaaagcccgattggagtagaggaattagtttttgcaataagcgtgattggagtagatgatttttgtgtatgcaaggcaaggcaaggcaagccaataggcagagctcccatctagccaggggaaggagacgcacgcatcatcacagttggggacggggtgtatcaacaaacgcatgatcaactcgcacctagccgaaagcacacgaaggtagcaggtcacaccagcccgtacacaaggtgccgggcttgctgtagtcttgacaaaggcatgtacgtggagatcggcttggttgatagctactgttgtctcaacagatctctcttaactgggtggtagcctttgattatcagtctatgacaaaagttcacgacaagctactgaagaaatcaatcgaccttcctctgttggctagctttggctagatttgcatgtgttcttgctcatggagaaattgatctnnngctataaaacaaacatatatagtgtggaagtacacgaataaacacttgcgattggaacaagnnnnnngctggccacnnnnnngatgaacgagaatacaganannncttgactgn

SEQ ID NO: 100430 - DNA, 554 bp, Triticum aestivum
  unsure (1)..(554): unsure at all n locations
  Clone ID: PAT_TA_100430
cacatcgccgtcaggagtcacaggggtagccatggaccaaagatcttggaagcttggaggggtaaatgccgagagtgttccgaaccagggtggccttcgggcagtggaggaacaaatggtttgtggcttcagatacacaggagcacaaaccatttccagctggaaacccaaggaaggggggtgggggaggctaaacattgcaaaacaaatttcataagcaagtaattattctgggtttgaagatctttgatgcctagaccaccgtatttttttggtttgcaaacatcccgctacactataaaacatttcgcccccgtgcaggtctcctccacggtccagaagaaagcacgtcggattgcgtcgagcgcctcaaaacttttttggggagttggaaaactgacatgaagtaggtggcgagggagtcgaaaacgaaggaggtgagggttagcctagctggcggtgcagaagagcagcttagccctccaccctgtttgatatttgaagctgttcaagagnnngggagtgtgtnnncagnnngnnngnnnncgnnnnac

SEQ ID NO: 100431 - DNA, 334 bp, Triticum aestivum
  Clone ID: PAT_TA_100431
gagagagagagagagaactagtctcgagtttttttttttggaggcccggacaaggacatgactgccagaatggtggtggcacatggcctccatttaacaccttgcacaaggaagattagtagcatagggaataaagtagaggatccatttaagtttttttcggcagtttgactgccttttattctcggtgaaaattcgttgtaatcatattaattttacccttaattttaacacaagcttgaatgatctcagtctaatgtatctcgggtttgggttattttaacactgccagtatgtatccgcgttattttgtggacaagataaaaaaaaaaaa

SEQ ID NO: 100432 - DNA, 317 bp, Triticum aestivum
  unsure (1)..(317): unsure at all n locations
  Clone ID: PAT_TA_100432
aacagcgggtcaacaccaacgttttttttttccttcaaaaaaagcatacttgggggggtacaaaaatttggggcttaatcttgggccccctttttcttatggagtaaccccgaaaaagggggcaactttttttctctcattataaaaaatacctcctacaaataacaaggggaacaaaactctctccacatnntaagtaggtaaaacgctcgaccgataccaaacgcctttggtataaacatcatatttgggtacaaaactgggaaacaacccccccccccaaacccccacgtcctcctccaaaaaaaaaaaaaaaa

SEQ ID NO: 100433 - DNA, 623 bp, Triticum aestivum
  unsure (1)..(623): unsure at all n locations
  Clone ID: PAT_TA_100433
gcacgagggtttataggaaagaagaacgaggatcagcaagaggcttaggaggctgcaagacctcgtgcccaacatggacaaggtaactaaaccagttgaattattgttggcagtaatgggcaatgtcaacttcgtcagttctcgaaaaaatgctgtcagcagacatggatggaattttcaccaagaattatagaagcccgtactcactaaagtactaatgcgtgacaattttcacctaaactggatgcattttgccttgacaaaaacccaaaacccaagtagctgttaatcacctggacctagttaattcagatttcaggattgcaaccgtgcatcagaaatattaataagtttcttcttggttatgcagcaaacaaatacttctgacatgctggatattgctgttgactacatcaaagtgctgcaggaccaaatcgaggtatgctcagtgctcacgcctgtgttatatatatcacacctccagttccaggaggccttgttaaagacacattgacatgtttgcttaaaaaaatacgcaagtatgnnaaaaagttgaaataaaattatttattatcnnngggtttatgcagaaactgaaacnnnnnnnngnnaactgctcttgc

SEQ ID NO: 100434 - DNA, 601 bp, Triticum aestivum
  Clone ID: PAT_TA_100434
gcacgaggaggtactccaggattcatccatcgtcaagtatatatatataccacatcaacatcatactttctgcctttgtacaagctaataaaaagatgagcactagtcagattctggtggtcgcgctagccctgctgctgctatttttgggtggcatgccggcaaaggtgtcggcggggttggcaggcacggcttgtgattcgtatgttctgaatccaggcgagcagtgcgatccggccaagtgccagaaagactgcgagaagacggtccacggaggcgtcggcagctgcttcaatcctcctcctccttattacaacagaagatgtgcttgccagtactgcccgcctaccctacccaggaaattgaagaactagctagctgagccggatctcaacacgtcgaaccatgtgcttgcgtcggtgcgtgctagcatttttgcaggaagataacgacgacggcaaccgatggaattgtggtattggttcgcggttttaccgtctaatctcttcaataagctaccattatagcaatgtatttttaagaagtgtggtgcagtatacgagttatcatttgcaaataaatcagaaataaaaaaaaaaaa

SEQ ID NO: 100435 - DNA, 513 bp, Triticum aestivum
  unsure (1)..(513): unsure at all n locations
  Clone ID: PAT_TA_100435
ggcatatgcgcctcttcagttcgtaaaatcaatatnncaccctacaaccaanntacgaacaaacgacccagggaaaccgcgtccacccaaaaaaaaaaaaaaaacgggcgggggggcccagtccccaaatggggctacagagaacgcgctcacactcgcccactggccgcaacgtcacaactgggagaccgggaaaaccccgccgctaaccaacctaatcgccctgccccacatccccctctggccaactagcgaaaaagccaacaaggacggacctatcgaacagcccaacagtngggcaggctaaaaggacaanngcacccgccctgcatcnagccnntaagcccggggggtgaggtggatacccacagcgagaccggtnnactcgccagcgcccgatcccccggccctttccctttccttccttcctttcttggcnnnctcgcccggtttacccctaaagnnggagctcccgggctggcttcaaggtagcgatttactgcttggcggccc

SEQ ID NO: 100436 - DNA, 578 bp, Triticum aestivum
  unsure (1)..(578): unsure at all n locations
  Clone ID: PAT_TA_100436
gcacgaggctcgcctcgtcgccatcccttctccgctcctctcctcgcctcgcctcgtcgccgtcccaaattagcagctgctggagctggccagcccccgccgccggcgaaatccctagggcctgcccctccggcgctccatccagccgccgtcgccgctgctgtaagatctgagcgagctgctgcggcttctgctgccgtgtgggcccggggttagggtttccctgttcgtagggtgtggaggcgggtccatggcgggccccaagtttgggtcgttcaagtcggagaacaagggggactcggccgcgtcggcggccggcgccgcggcgcagnnnagggacccgtacgaggtgctgggggtggggcgcaatgccacggagcaggagatcaagagcgccttccgccgcatggccctcaagtaccatccagataagaatgcagacgacccggttgcctctgagaagttccaagaagccacattctcttacaacatcctctcagatnctgaaaaaaggcggcagtatgattcctctgganncgnnnnnntcgaagcagatagtcatgaattagagctggncn

SEQ ID NO: 100437 - DNA, 388 bp, Triticum aestivum
  unsure (1)..(388): unsure at all n locations
  Clone ID: PAT_TA_100437
nnttttttttttttttttttgggttttttttttttttttttttttggtaaggggccccacaggnnaaaaccttttaaaggctcaatttttttccttccttccttgccggggcaattaattttttttgtccccgaggggtttttttggggggcctttaccccgcttggttgtttcacaggggggggggccttttttttttgcccggggggtgggaaaccccattccttaaactcccgtttgtttttttcccccttaattggtaatggttttaatcggnngggtgggtggttttttttatgccccgatcgatttttttggggtggtcctttcttaacagtcccttcctggttnacagtaggggngnngccttgatcagggcnnggccttg

SEQ ID NO: 100438 - DNA, 652 bp, Triticum aestivum
  unsure (1)..(652): unsure at all n locations
  Clone ID: PAT_TA_100438
gcacgagggcataaagcttgatcagtgttgttgagatgaaacaacgtgctggtgtacactgtcttttccacctactagtccatgtgcaatgaaaaattatactccagtatgagttaatgaacgaccaatttgggtaaaccctgctgaccttttggcattgtgttctccctcgatcgaacccccttattcgtagtacatctatttacagagcaagtagtagtagtatataacaagcagctgatgcaaatcaatgtggtcatggagaacaaatccataagagttattcggccggtgctgcttcttctaacgggactgacatggtcatcttcatcctggaagtcgtccccaagaaagccatcgtgaccatcgcttctcttcgtgctcgcatcaaacctccttgcaaagagcatcctccttgcaagcaccatcaaggttgagatcacttagcaggtgctccacccccttgattcnnnctatcgccaccgtagttgccaggacccaggagaagcatttttgtatccaccagcaccccctcaaaacgcagnccnnctgattgccaccgggtatgacactcgcgatatttctattactcatccatccttggannnnnnagtnnnnnnnnncnnnantgacnnntccatttcaagtagcn

SEQ ID NO: 100439 - DNA, 556 bp, Triticum aestivum
  unsure (1)..(556): unsure at all n locations
  Clone ID: PAT_TA_100439
gggggtataaaacaaaaactatgcaagtacgggacgattacaggccacgttgattcactctgaaacccccaaaatgaaatcagattacaatataagtaacttcttaaatcaacaaaaacctatctgcaactccaagttgaaaaatctgaaaaacccaggggtactggttgggctgccacccgtactggccgggcgtctggtttnncgacaacagagggtgaccaccctgaaattactggggaaacacaaagcacaatcggggtacatgacaagcccatcgattttacatgaatagccccccttattgaaaaaaaaaaaagggtttcgctatgccccttgcacgggagtactaccatggtcaatttcttggttgggtcaattcaatacncgctgaccaagaagaagcncatgggggggaccacaatgggggacgggnnccccaaccggaggggggtccaaanngnnnnngtnnnncccaaaanntgggcccgcctggcctgnnnnnncacnnnnnnnntcnnnnccgaccccaacnncnncnnggtcccgnnnnnnn

SEQ ID NO: 100440 - DNA, 632 bp, Triticum aestivum
  unsure (1)..(632): unsure at all n locations
  Clone ID: PAT_TA_100440
gcacgaggcgcgcctccgcctcccgccttcccccattcctcccgccggcgagatggccccgcccttcgtgttccccgcgagcctgcgggatctggagcgcgacgacgacggggacgacgagggcgagccgtcgctccggccgcacgcccccgtcgccgtcaccgccctccgcgccgccgacctcgaggagttcgtcaaaggcacatcatttgatctgtctgacaaggaactcttctgcattgaggaacaggatgtgtttaatagcatatactctcttgtgcgtgacttcacttgcttgcccccagggcttaagttcaatcttgttgaggctttgcgctccaacctcagtgttcttctgcccaacattgactccctttcacgagcttccatgtcatccccctctgatgggatccctatcactgaccgcatcgcgtctcaccgcaatgccctcaagatctactcctttttcctcctctccattgtcctcgctcnnnaatcttcagctgatagtggcactggggcaaaggtgacagcacatggtcggaagaagaatcctgtttatgcttggaattgggaagcgcaaagnnnncggatcatgaatctgnnngccaattctcttgaagttgacnnnn

SEQ ID NO: 100441 - DNA, 633 bp, Triticum aestivum
  unsure (1)..(633): unsure at all n locations
  Clone ID: PAT_TA_100441
ctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaaggtaaccaaccaaccaactcccagatccgttggaatttcgcgtccgatttgctgtccgtgtggtagatctgtcccgatcttgggtttgtgtggtggatctgaccggatctggtggtnnnttgtgttttgtgcgtgcgtgcagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaagcccagnnncgccggtccggcggtgggggcggcggcggcggctacggcggccagcgcggcggtagcggaggctannncggcggcggcggtggctannncggccnnngcggtggcggctacggcnnnnnnnncggtggcggcnnnnnn

SEQ ID NO: 100442 - DNA, 534 bp, Triticum aestivum
  unsure (1)..(534): unsure at all n locations
  Clone ID: PAT_TA_100442
gcacgagggtcaccacccgaagcaccagcgccagcagctgaacctggtggactgggccaagccgtacctggcggaccggcggaagctcccccgcctcgtggacccgcggctggaggggcagtacccgtccaaggccgcactgcgggccgcgcagctcacgctgagctgcctcgccggcgagcccaagaaccggccctccatggccgaggtcgtcacggtgctggaggagatcgagcggattcggcctcggcaccggcgcgcgtcgccggaggaggacagggagagcagcagcagcgcgtcgtctcggagcgcgcaccacgggcgccggcaccagcagcagtcgccacggccgaagtccgggtcggacggcgcccggagcggccagccgtctcctcgagtgagatgacgatagccccgagatgactgactgagcgagatctctctccccgatcagatcccttcctttcaagatctctctcctttnncgtgattnnncnnngggtttttttnnnnccagttttccannnncnnnnn

SEQ ID NO: 100443 - DNA, 407 bp, Triticum aestivum
  unsure (1)..(407): unsure at all n locations
  Clone ID: PAT_TA_100443
gcacgagggagagagaganngcggaaccgtctcgttctcttttcttgcttgcctcccnagaaagagaaagaaannnncggcggcgtctgatctcgtcggcggcagcgatggcagccattctgcgtctgatcccgtccttcaaccgcttgctggtggagaaggtcgtgcaacccaaaaagaccgccggctgcttcctcctcccagatacctccaagcaantgaactctgggaaagtcctnnntgccggccctggcagncctgacaaggaaaggaaantgatccctgttgctctgcaaggaaagcgaccnnntgctcctgcctgagnntggcggtcttganntcaagcttgctcctgagaannnctaccttctctacacanacnntgacattctgcgctccctccacga

SEQ ID NO: 100444 - DNA, 625 bp, Triticum aestivum
  unsure (1)..(625): unsure at all n locations
  Clone ID: PAT_TA_100444
gcacgaggccgcagtctctctccactgcagtgggaggacggaggagcggcggcgccgccgacctcaatcggctccgtcggcggcagccaccctcgaatcgagctcgtcggcggcggtgtccgatcggaacaacctgccgccatctccatctgcaccggatcaccggccagctgagagaaagagacgagaggttgctctgacagataggatggatcctgtggagattgcccaaggggttgatgccaggcccgagtgttctttgacaccaactgaccctgtgtccaaggtgctcaatgatgatgacctcctaatcgagatcctcctccgcctcactccgaagccatcctccctccgcaacgcctccctcgtctacaagcgatggcgccgcatcctcttcgaccctcaattcctcgggcgcttccggaagcaccattggaagctcctcggcttcttctaccaacagtttaatgaagcccccaacttcactccaatttcggaccagttggacctcattgcagcagcgttgccagagaacctgtttcatccttattctggnnnnnnnngtcttccttggctgncgtgatggcatcgccctcgtcctccaccgtgcgcgccatgaagcnnn

SEQ ID NO: 100445 - DNA, 624 bp, Triticum aestivum
  unsure (1)..(624): unsure at all n locations
  Clone ID: PAT_TA_100445
gcacgaggcaacaattgccatggatccgatcaacgagccccttctctcttctccgtcacaaagaaactgctcccctagcaaagttcgcttgggcacaccgaccttcctagccactctgctttgcttttgcttcgccgccttcctactcctcaatcctgccagggtgcacctctgcacaaactccccggacccggcctcgtgccacgccatcgtcgctgacgccgtcctgacgtctccgggcgctcacccgagccggccggcgcgagtgcttcgcgcaatactcgccaggtccctccaccagcatgacgcggccgccgctgcggtggccggcatgcacgggcgcgccagcgacccgaggcagcgcgcggcgctcgccgactgtgtccagctgatggagctcgcgcgcgaccgtctcgccgacgcggcggaccacaccacggcgacgcccgnnnacgcgcgtacgtggctcagcgcgatgctcaccgaccacgtgacgtgcctggacggcctcaacaacgggccaccgcgcgacgccgtgggggcgcagctggagccactcatgtccctcgcgagcgcgtcgctcgccgtgctcaacgccgtnnnctcttgcacggccgccgacnn

SEQ ID NO: 100446 - DNA, 593 bp, Triticum aestivum
  unsure (1)..(593): unsure at all n locations
  Clone ID: PAT_TA_100446
gcacgagggctcgctcggccgctccaaggttccaggcgaagaggcgatgatggggcgcgggatggctgacgacggcgtctcgcggcgggccaccttcggcgagcgcagcggcgcgctgctgacggaggcgcaggagctcgccgcgctctgggaggcggacgtcggcgtccttgtcttcgacggcgccggcaggcagatggactactgcagcccccacaccagtccccatgagcaggattttcgcttcgattcaaaaactacgactgtctccaaggcattcagatggtccctcccatatagaagatttcaatttggatttttggatcaggaattcaggatcaaagtggacacaaaatgatgcttttgtatcttttgtatctgcatatgggctttgaagatggtttttgtgctttataagataccaaagaagtcttatgaaaacaacatgtataaggaggcagtggatgtttggataatggcccagctggagcgagctgatgcagcgctaccagatcatcaccaaaggcaagtttgaggggataaatcatgatgatgaccgccatcagctgttggcggaaatcacannntngnnn

SEQ ID NO: 100447 - DNA, 551 bp, Triticum aestivum
  unsure (1)..(551): unsure at all n locations
  Clone ID: PAT_TA_100447
gcacgaggccactctccgcttcaactgtctcgccaggaactgcgtgccaaatatcggcggctccgttcttcctccttctcgccggttgaagcggcgccgttcctccccaaatccgccccctttctcgcgaaatcttgagtcttgctcgcgggaggagtggtggtgggaggccatggtgtcgagctcctactccaacctgctggacctggcgaccggcgcggcggaccaggggccggcgccggccgcgctgggcgcgctgcggcggcggctcccgagcgtggtcaccacgccggggctcatggaggactccccggcgtcgccctccacgccgtccccggcgccgcgcccgcgcaccatcgtcgtcgccaaccacctcccgatccgggcccaccgcccggcctcgccggnnnagccctggaccttctcctgggacgaggactcgctgctccgccacctgcagaagagctcctcctccccctccatggagttcatctacatcggctgcctncgcnnnnacgtccccgtccccgagcannacgccnnnnngcnnn

SEQ ID NO: 100448 - DNA, 472 bp, Triticum aestivum
  unsure (1)..(472): unsure at all n locations
  Clone ID: PAT_TA_100448
cagcgacgacctcaacggccagcaatgtcgggccgcggcaagggaggcaaggggctgggcaagggcggcgccaagcgccaccggaaggtgctgcgtgacaacatccagggcatcaccaagccggcgatccggcgtctggcgcggcgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggccgcaccctctacggattcggcggctgatctgatcccgcgtgttcctccgttgttaggggttgccgatgtgatgtaatgtgatgcgcattgtttcagnttaatcaatggattcgctgttgctgttnnnnnnnnnnnnnnnnnnnnnnnnnnnnnnnnnnnnaaa

SEQ ID NO: 100449 - DNA, 648 bp, Triticum aestivum
  unsure (1)..(648): unsure at all n locations
  Clone ID: PAT_TA_100449
caacacacagcacacaacacaacacacagggcgcgcgcacaccacgccgcctcccctcccctcccagtctcccacctccggcggcggcggcgagccagatagagagcgaggccggccgggggggaggaggaggaagatgatgatgcccacgggcggcgactccagctcccccgtgcgcgcgctgcggcggctggccggctccctcctcgccgccgcgcgcctccgcggctccttcagcgcatccaaatgcaagacggaggcgcggatggcggcggcgcggatgaagctgctgcggaaccgccgcgaggcgcaggtgcgcaagatgcgcggggacgtcgccgcgctgctccgcgacggccgcgaggacaccgcccgcatcagggtcgagcatgtaattagagaacaaaacactatggcggcaaatgagattgttgaacttttctgtgaactgattgttacacggcttcccatcattgccaagcagaaggaatgcccagcggacctgaaagaaggtatctgcagtttgatatttgcagccccannntgctctgaactccctgaactcactcggatgcgggacctttttgaaaagaagtatgggaaagnnnncgttgctgctgcagttgacctgcgcccannnnnngnnnn

SEQ ID NO: 100450 - DNA, 636 bp, Triticum aestivum
  unsure (1)..(636): unsure at all n locations
  Clone ID: PAT_TA_100450
gcacgaggcggcggcgacccccatcccattcggccgaccatggcgacacggccggagctgatggacgacctcctcggcgaggtcctcctccgcctcccgccggacgagcccgagcacctcttccgcgccgccatcgtctgcaagtcgtggctccgcatcgtctgcgaccccgccttccgccgccgctaccgcgccttccacggagcccctcccctcctcggcctcctccacctgctccaggtcctccaaggaagccccgcgcaccgcttcgcctccaccacgtcgatgccggacttcccctacccgggctccgacggcgagggcgagcaccccacccccctcgactgccgccacggccgcgtgctctaccacttggtgcagggcgacagcctggttctcgtcgtctcagaccccgtcacgggcgaccggcgcgttctgcccgcgccgggcgtcgattggttcatctggaccgccgcggtgttctgcgccgccgatggctgccgacatctcgactgccaaggcggccccttccgcgtggccttcctgggcaccggcaacgacgaccgtgtcgttnnnnngaacgtgtactcatcggtgacaggtgcgtggagtgcgccagtatgcctcgacgatggc

SEQ ID NO: 100451 - DNA, 638 bp, Triticum aestivum
  unsure (1)..(638): unsure at all n locations
  Clone ID: PAT_TA_100451
gcacgagggagagaccacccctaccgcgcctctcctcgccagtcaatcaaccatccagccagccagccagccagccaaccaatcacccccatctccccctcccccctcggaactccgtctcgcgtggattaatggatctccgccccgccccgctctccctctccctctccctctagctgctgcctctgcttgctagtcctccccgccccgccccgcccgattcggagccgcgcggacggagaggaggggggatggggctccgcaggagagggccgccgctgctgatgcttctcggcctggcggccacggccttggccgcctccgcctccgcctccgagggcgacgccgatccgctctacagagcttgcttcgaagaatgtcaaaggactggcaccctgaaagaggattctatcaaacactgtgttgtgccgaccgatgaccagcccgctgacaaggcatggtacgcgcacgagccattgtacctccagtggaaggagtggaactgcaacagcgaatgccgataccattgtatgatggaaagagagcaggaaagggaagagcttgggctnnnnnccgtcaagtatcatggcaaatggcctctcaaacgtgcttctnnnnnnnnnnnacctcnntctgnn

SEQ ID NO: 100452 - DNA, 470 bp, Triticum aestivum
  unsure (1)..(470): unsure at all n locations
  Clone ID: PAT_TA_100452
gcacgaggctcttctcttcttcctacgaaaagctcgaagctttttgcaattgcaacgactattaatggctgccgttcgaaactaatcacggaggccattactggctcctgacggcgtagttaatccccccataaacaccgtcgcatcccgctctaatccttcgcctcccgccgctggtgccgctggtggtagcagcagtggtcgtggtactaggtggcggttaggtggaggtgagagaggcgagggcgtaggggtcgggagaaagaagcggtgcgtgcggcgggggagggggtggggagatggtcgtggcggtggcggcggcgcggcggaggcgggtgtggcggtgggccatgcgggcggtggccaacgcggtgatgtggacggcggacctgcaactggcgtacatcaccggcctctggcgccccnnnnnntnnnnnnactnntggggcggctccngctacgggggcgcc

SEQ ID NO: 100453 - DNA, 632 bp, Triticum aestivum
  unsure (1)..(632): unsure at all n locations
  Clone ID: PAT_TA_100453
cgccggcccggtttactctcgggttcccattctattttccaccttccctccactcctctccgctctctcctccctcgcccgcgtcccgcccatggagtcatccgccgggggcggcgacccgcgcccgtcgccgtccgggggcgcctcccctccgcccccgcctcccccgccgccgccgcccagcgggtggctcgcgggcctcgtctccggcgccggccggctcctcgcctccgtgctcggcccctccccctcctcctccccgcgcggctccggccccgccgcgtcgggcgggtccgcctcctcctccccgacctcgttctgccatccccgcgagggcctccacggcggcgccggcgctgattttgatgattctgtgcgtgtcccgtcgaaaaacaatcagttaaaccagggatccctagcaattgtctcagaaattgagccgaaagatgccataatgcagttgcttatgcaggaaacctactcaaggtctgagtgcagtacactaataaagataattcaagagcgggttgtggatccagattcnggtggaattgctgatggtgagattgctcttccgatcagttggannnctgacaaccaaccaacccttggatattcttcatttagtnnnn

SEQ ID NO: 100454 - DNA, 554 bp, Triticum aestivum
  unsure (1)..(554): unsure at all n locations
  Clone ID: PAT_TA_100454
gcacgaggatcatgttatacgtgacctgagcggtggctcctgctgctagatggtgatattacgtagttgcatgagattactggaggaggcaataaatttcagacgtaaatgaacaggcgccagatttgagtaaccagaatgttggatcatggtgatgcttcttgtcactttatatcatgactagagttgctctgacaccatgtgcactgaacctcagaattatgcagcagccgcagcagttgtgtgcatgtcaaactagtggtttgatttgatttgcagcaaagactgaagggaatgggtgaggaactgtggaataaataaattttgccaagaattgtcagtttttgatgtgtttctgtggatcatcggctgtatatagagtttgggagacctgacatcgccggcacatcgcccagtgtgccaagcttgaaagcaacattcgtctgagcgagcgagatctgtatactgtgtggtgatgcagtcagagtcaggtcaccaacgnnnngcgagtgtgaacatttgcctctgtgannnnnnnagtgagatccgtgtgt

SEQ ID NO: 100455 - DNA, 405 bp, Triticum aestivum
  unsure (1)..(405): unsure at all n locations
  Clone ID: PAT_TA_100455
ttcggcacgaggagcatctcccagatcccgatccacccacccacaactcccattgccgccggtgtcccgcttccaggcatcgtcgccggcctcctcctaccacgcgccgccgccggcctcccgcttccacgcgtcgtcaccgggctcctccttccatgcgtcgttgccagactcctccttccacgcgccgccgccagcctcccacttccacgcgccgccgtcgcctccctcttccacccgccatcgcaggctcctcgccttccacccgccctcgtggcatacttgcttccaccagccgccgtcggagccaccccagcacctccaccgccgccatgcgcgacgcgtctcctcccaaggacgcggtnnnnccccccnnnnnnnnnnnnnnnnnnnnnnnnnnnnnnn

SEQ ID NO: 100456 - DNA, 645 bp, Triticum aestivum
  unsure (1)..(645): unsure at all n locations
  Clone ID: PAT_TA_100456
ccgcttgtagggtttcgtcctccccgtccgcaccgccccccatggccgccacctcccgcgacgcccctgtcccgcccgccatgccggacctcgtccgcgaccacctctacttcggcgacatcaacgacgccatcgcggccctcaccgcctccctcccggacggcacatacatcacccacgtcctgtccgtcgtcagctccgcctccatctccttcttcaccgactaccgcccgggcctctccttaccaacagaggaggcccgccgcgtggtcgccggggaggacggagcgccctcggcggtggccccagggcggctgatgcgggtggtggaaaggaccggggaagggctaagggtgacgcggatggccgtgccgctcaaggacacggaggaggagaacctgctcgaccacctcgagccgtgcctcgattttatcgacgaggggaggaaggcgggcaacgtgctcgtgcattgcttcgcgggggtctccaggagtgctaccatcaccacagcatatctaatgagaacagagcagaagtctcttgaagaagcactagagtccttgannnaaattaatgagtctgtttgcccaaacgatggtttcctcgaccnnttaaaattgtttgaannnntnggtttcaagnnnn

SEQ ID NO: 100457 - DNA, 627 bp, Triticum aestivum
  unsure (1)..(627): unsure at all n locations
  Clone ID: PAT_TA_100457
tgcgtgatggagctttcgtctgctttcgaggagcgcgtccggcagatggaggacgcgcgcaaccactgcatgacccgtctccaagccgagaaggagatcctggccgccaagtcccgcctcctcgccgccaaggtcgccgccgcccgccgcctggagcgccgccgcctcctcctcgagcgccgcgccgcggatctcgcctcccgcgccctcgccgcccgcgccgccatcgacgccacccacgcgcgccgcctcgccgtcgcccgcgacatcagctcgaccaacggcgagatcgaggaggcgcagcggaaggcggaggagtgggaccgcttctacgagtccaagaggaaggagatggaggagttccgagcaatgtcgcagcagttcgaggcggggactcgtcaggaagttcagaggctcaaggcctctgtgtctcaactgcaggcagccctgcaggagctgcagagcagcgggttgcgctcggacgacgccgggatcggggctgcggaagccaggaaggccgacctcatggccaagannncgaagctggacgagnccctggctcaagcccgacagttcngnncactgcttcggcagcagctccagnaagccttcgcgtcacnnnnnnnn

SEQ ID NO: 100458 - DNA, 483 bp, Triticum aestivum
  unsure (1)..(483): unsure at all n locations
  Clone ID: PAT_TA_100458
ttgtacttaccataggaaccaactcataaagtggtaatgaatggaagctaaagctcaattgagggatcatctgcaatatcagagcaccttaaaatagttgaagtcaagtggggtgtggtggacgacaggattctcaaggttttggagtttctcactagtgacccattgcatgttttctgtattctgaataagttttcatatatgagaaagaaactaatagatcaagcagtaaagaaggaaatcccgaattatgtaggaactgtttgtaggaataccgaattgtccatggcttgaaaattctggaccatgtctgatcagtcgcaaaaaataaatcaatgtaatccattttgttgccaaagggtgtttaagttaaactgtgttgcagaaataataagtgtaaaacaacatgtggacttgttgattagttctggccttgtgggtactggcacaaatgtctgaactgattcattcagggtagtgann

SEQ ID NO: 100459 - DNA, 452 bp, Triticum aestivum
  unsure (1)..(452): unsure at all n locations
  Clone ID: PAT_TA_100459
gcacgaggcgcagatcggtcagagagcggagagccccgctgctccgacacagtcccactacctcccacagcgcgcgaggcaggggccgagggccgaggacgaggtgcgccggccggtctgccccccgaagcttgggagcccccgggcgggcggcttggtcaggaacgaccggccgcgaccagcgcccttcttccttgcggtgctcgcgctcgcgctcgtgggatgggggaaggaagggtttggggcgaggtggcaggatcccgctaggaggcccctccggcgtgaggattctggttaccgagtgttggtgcgatggacagccttcagagtgatccttatacaaggagcagcttgcaaatgcagctcattgacaccaccacatccttcgaaactagcaatttggatttggtcaagcatgaagttcccacccctcaagttggcatgacttttnn

SEQ ID NO: 100460 - DNA, 398 bp, Triticum aestivum
  unsure (1)..(398): unsure at all n locations
  Clone ID: PAT_TA_100460
cccggcggcggccccgagnctcctgcagctgttgcggtactcctccagcctgtaccaacagccgatgctgccgcagcagctgcagcagcagcagcacacaccttcgcagcacccgnngatgatatccttcggcgatgcccagcagcagcagcagcagcagttcgaggcggcggcggccttgatccagccgcagtacatggcgccggaggcgctgcgctactggagcgcggccctgaacctgagcccgcgaggcgtgcttggcggggtcgtgccgccggcgctgtaccagcacctgctgcggccgcctggcccggccaagctgtaccgcggcgtacgccagcgtcactgggggaagtgggtggcggagatccgcctgccacggaaccgcacgcgcctgt

SEQ ID NO: 100461 - DNA, 357 bp, Triticum aestivum
  unsure (1)..(357): unsure at all n locations
  Clone ID: PAT_TA_100461
gaatgaccaaggggttcctttaaaaaaaaaaaaaaaaacnncaagggggggcccggtccccatttccccctttatgaatcnnattaaccccccccacttgcccgccttttaaaaacttcggaattggaaaaaccttgcgtttccccacttaattcgctttgaacaaattccccttttccccacttggctaataaccaaaaaggccccacccattcccctttccaaacatttccccaccctaatgggcaaatggaaccccccttttaccggccctttaaccccggggggggtgggggttccccccnggtgaacccttcaatttgcaacccccttaccccccctccttttnnntttttt

SEQ ID NO: 100462 - DNA, 391 bp, Triticum aestivum
  unsure (1)..(391): unsure at all n locations
  Clone ID: PAT_TA_100462
ccattcaagcagcaagataacttttttttcaggcagcccctttgttacaggatgaccctgtcaaaacacacccagctagctacagaactcttcagacggggaacaggaaagaaccccaagnnntattgcccgaggagcctaggacgaggggaacttggggacggccttggtgccctcggaaacggcgtgcttggcgagctccccagggaggacaaggcggacggaggtctggatctcgcgggacgtgatggggggcttcttgttgtacngcgcgagcttggcggactnnccggcgagcttctcaaaaatgtcgttgatgaaggagttcatgatggacatggccttggaggaaatgccgatgtcggggtgnnnctgcttgannnncttgann

SEQ ID NO: 100463 - DNA, 616 bp, Triticum aestivum
  unsure (1)..(616): unsure at all n locations
  Clone ID: PAT_TA_100463
gcacgaggcctcaatccccacccagaaagatcccgaatctctctgttcgttccttgcttgcatcgtacggagtagttcgtagaccggcagcatgggtggccgccgccgccgccgccgctgccgcgccaagatcgagcagccctccgctgatacgcctcccaaaaccccctcatctggctcatctggttcatctggtctgactgaggaacgcgtcgctccacgcaaaatcccttcctcttcttccaaaccctatgaggaggaagaggtgatctctgcccccgagcggaagcgcacagatccgtgcaccctgaggctcgtgctgttgaacttaatccgcaccttctacctggaggcgctctcccgccttccccccgcccgactctggagcacgcacgcccgcggcgtcctcgtcgccggccactgctacgggcccctctcccctgtcgacaatatcctcgtcaacaccatctggcatgacaccgcctttccccgccgccccaccgtcgactttcacttcggcgatgtgctcgagatcagccccgaatgcatcgcccgcattgctcaccgctccctggnnngtctcatcgcctgcctccttcacctctgcccctccctc

SEQ ID NO: 100464 - DNA, 372 bp, Triticum aestivum
  unsure (1)..(372): unsure at all n locations
  Clone ID: PAT_TA_100464
nnnnccgggggacccttttttcccccttcccctagggcgagtgagggggtttaaaataaaaaagggggccccatgggggttttgcctgttaaaaccctttgctgctcatttttggggggccccaaactttttttattgggctgggcatatgtgtgttctcttttgggagggggggcgggattttttttctcatttcgggggggggggtttcccccctttttgaaaagggaaaaaaaaacacggggtttttggnaatacctttgaacccnncccttttggtgaaatgtacattcccccttttcctttttttttttacggcccagccccttttaatttttttnnggggttttttnnnccagnnttcccccggnn

SEQ ID NO: 100465 - DNA, 455 bp, Triticum aestivum
  Clone ID: PAT_TA_100465
ctgcacttgctactgaaaggaagaggcgacaccggccaaatccacatcaccgcatggagcatggtgaagctcccaccctgggggactgcaacggcagccgccggtgctggaggcgacgagacatcaccatcgggccgcatcttgccgcgtcgcagcaacccccgtcgtcatcatgttgcgttgcagcatccacgccgttgctgtcgcgtgcttcgtcgcggcaaccgcgtcgccgtcgcgctgcgatggagcccaacaagcggcagggcggtgcagtgcaactccgttgacggcgccgtcggggtgctgcggtggagtccgtagcaacgaaacatggtcggtgccgtcgggtgatgcgatggagcatcgatggaccacacctctgcatcggcgtcagcactgcaatgaagcatcttcggcgacggcgagtgttgcgatggagcgccgcagggggc

SEQ ID NO: 100466 - DNA, 435 bp, Triticum aestivum
  Clone ID: PAT_TA_100466
gcacgagggaaggggataattgacgataaccccctttgttgatcgatccttgatcatatgcccctttgatgtgtcactgatatgtggggtttaagtgacccgacgacgaagcagcagcaagaatgggaggcgtgtgtccactgtgacgtggcaggccgctgttcggggatgacgccggcggggtgtcggcggcagctcagtgcgcgagctgtggctgctactccacgagtgggagaagggagcgaacaggttgacctaatgcgcggtaggctttgggaaaagggagggaacaggctaaatttgggccaaaattgcccaggcagttaattggcccaacctataatttggtttgagtggcaccacaatgtatacttccattctccagatggccatggcgataataatgagtatgacaatggggggccagttattgac

SEQ ID NO: 100467 - DNA, 644 bp, Triticum aestivum
  unsure (1)..(644): unsure at all n locations
  Clone ID: PAT_TA_100467
atggcgcacacagaaagggagagagcaccggtggagactggagcggcgagggttttggtgccagcgtcgctgggtgaagaaaccccatcactcgcgccctccgcccgccgcctggagtctccggatctgctcgcccgccgccggcatcggccccttcgcttcggtgggaagttctccgccgcattcccccgtctcctacgctcatttcccccttcgattccttcggctctccgctggtttgatgctttgttccggtcgatctcggtgtagattttctttcatagcttgttcggtgtagatttcctttcacagatttcctttggagtatgtttttcgcttgctgcatgaattttcccttggattggcccgatgatgattaggttttaacccccaatgcggggggatgtggatggatggatagatagatcgatagatagatcggctcagatccgagctcgaaaagggatcagccgttgcgttgcaaggttggagcccctgaaatggctaatgcggcgtggcttctctgttctgggcgccgaggcatgtgtctttgggtcagccgttgcttccgctgaagctctgccactgacctatgggcctgcccttgttgacgtcaacctctccttcctncnnnnnntcctcnn

SEQ ID NO: 100468 - DNA, 293 bp, Triticum aestivum
  Clone ID: PAT_TA_100468
tttaaacaactaatctactcgtcgtctcttgcgtcatccagcatgacgaagtcgagctcgcagccatcgtcgtcgtcgctgccgcccgcgccgaggagtcgaggttgtttaaaaaagttctatttcaaaattcgttccaatctttgtaaaagatcctaaaatatgaattatgtccaaatttgttcgtttgaaatatgttggatctcttagaaaatggtgcgtttgaaatgtatatatgaaattcttttaaataaaaatgcccgccaagctggccgaagattaaaaaaaaaaaa

SEQ ID NO: 100469 - DNA, 461 bp, Triticum aestivum
  unsure (1)..(461): unsure at all n locations
  Clone ID: PAT_TA_100469
gcacgaggattcagcgagatagttcaagagaatcagctctgttctttcagtaccgcaactttgcaagtccactactaccatacagaaggatcacaagtcagtgtccactctccagcagcgcagcaagaacaaggaggaggaggaggaggagagatggctgctccggcgaaggcgtcgtggatggtggccatgagcgtgggcgctgtggaggccctcaaggaccaggctggactctgccgctggaactacgcactcaggtccgtccaccggacagccaaggccaacgttcgaggcggcgcctcgcagggcaagaagcagctgcctgcctccgcggcagccgtggcagnnaggcggcgagcggagaattccgaggaggggctgaggacggtcatgtacctcagctgttggggcccaaattnnnagtactagtagctnnnncataggggcgcttgtgttcgttg

SEQ ID NO: 100470 - DNA, 372 bp, Triticum aestivum
  unsure (1)..(372): unsure at all n locations
  Clone ID: PAT_TA_100470
ccttttttcttctcttcnttccaaaactctcccttttacccctcccttttctacaatccaaaanntaaataactttctttctactctttttttctactatcatcttcaattctcnnggtttatttttctggcttacttatcttctttgatcacctttacacatcctcctttcgtttcccacttgnactttccatttttaactttattttttcatttcatttgaatctataattcctacccctccctcccccgcctacgactctaggtacaccctgcattgaatccccccatcntctgcaccccccgccctgtggcacaanatatgttccaatgataagctacgatcatgggcccatcggaaagcccatatgc

SEQ ID NO: 100471 - DNA, 378 bp, Triticum aestivum
  unsure (1)..(378): unsure at all n locations
  Clone ID: PAT_TA_100471
caaaagcaacttcttccaaacatgggaatgcactgccataattttttgacagtaatggcaaacagccggtccgtatatcaacatgtcgcgtaagccatcagattaacagtttcacaaacatggcctgacaaggatgaacaattcccaaaatacaacctacccaactggagaaggccttgattgtgaactataataatgannnancaacgtggatgctgaaacatcnnaatgtttgtggagcactgcataacaaatgccttgagcaatgttcttgtgagcacgttaaacaggacgccgagggtgatggacaccggtagggcgggcaatgccttgcggnnnnatgccnnnaatannagggtgatgccgnnccccgcaatg

SEQ ID NO: 100472 - DNA, 400 bp, Triticum aestivum
  unsure (1)..(400): unsure at all n locations
  Clone ID: PAT_TA_100472
cttttctgaaatccaaacacataacatccatcttaccggcacccaaatcccatgttacacggcccgaatgaacaaaaacctccctccanncattgggatcaggtaccaactacccctaaccccttcccgcaagggacctncccagatcnnctatcaaaaccatgtacctggcacatgcccatgcctaccgcactcnntccaatgttcgtatcgaaggatttatgaagcgctctactccccggtctgagctcccgccccaccccagggacctggtatatccctttccccgttcctttctgcggttttttgctccctgtgaaccccgnacccttccctcattgctgcattctgctctggntgaaggcccaacactcccccttctttctgctgcnnntnnnnn

SEQ ID NO: 100473 - DNA, 644 bp, Triticum aestivum
  unsure (1)..(644): unsure at all n locations
  Clone ID: PAT_TA_100473
gcacgaggaagcaaagggatgatgggagcaccatctattcaaagtgtcgaggctaagcaaagcacgccatgtatacaggcacaggtcgacgtgtaatccctcttatctattacttgatgatgacattttgttttagattctcacactgatgatgacattacgttgcctaattccatatcgtgtgtgcgtcacgcccaacaatgaaggcacccaccaccttgggcagcacagtacagtgcaccagcatatgcatgtgctccgggtctttaagatggaatatatccaaccatgaaatttattcctctccggctagctgccggctcgaaaggatgcgtgctgccaactgcaagctaatttcggcatgcaggcatgcatgtgcggtgcatatcagcatctgataagttggcaaacctccacgcgaagtattccatttgatttgttctccggagcagcgacacatcgaaacgccttttgcttctcaatccaggcaaaaggaaatcatcatcatcataagaataaaacatcgcaggaatcaagcatcaggctcactttttcaagcttttactacctctgttcctaaatataagctgctttggcaattacacnnnnnntgtacatcgaaatcnngnnngaagcaaannnnn

SEQ ID NO: 100474 - DNA, 629 bp, Triticum aestivum
  unsure (1)..(629): unsure at all n locations
  Clone ID: PAT_TA_100474
gcacgaggctgcattagcggccgagatctgagcgcgcgcgcgggcaggcaggcaggcaggcaggcaggtgctccgcggaatggccagccgcccgccggcgccaatgccggacacgctctccgacgccttcgccgccgccgtgctcctctcctccaacgacaagcccgacacgctcccgccgggccgcctctcgcccgtctccccgctccctcactcctcctccaagcaccaccaccaccaccacaccccgagctcctcctcgggctcctccggctccgtctcccgggcgcccgccttcgcctcgcgccggagccactccggggagatcccgctcccctccgacgggcccccgcggggcgcgcgcccgggccaccgccgcaccggctccggccccctcatcttcacctccggctccacctccagctccgccacctcgccgctcaccaacgcgctccccgcggggaacatctgccccaccggccgcctcgccaagccgctgccttccttctccgcggcctccaccccgccgcccccggcccctccccgcgccatccgccacgacgtgctcggctccggcaccggcaactacggccacgggagcatcatgcgctcgcgcagcggcggcgtnn

SEQ ID NO: 100475 - DNA, 474 bp, Triticum aestivum
  Clone ID: PAT_TA_100475
ttcgaatgggtcattggtgagattgaatcgagattcctccagtctttggtagctcctggtgaaatgattggatgtgtggctgcacagtccattggagaaccggcaactcagatgacactgaatactttccattatgctggtgttagtgctaagaatgttacccttggagttcccaggttaagagagatcattaacgttgccaagaagataaagactccatctctgtctgttttcctaaagcctgaggtgagcaagaaaaaagaattggctaagaatgtgcagtgtgccttggagtacactacactgcgtagtgtgacccatgccactgagatatggtatgatcctgatcctctaggaaccatcattgaagaggatgtggaatttgtcaggtcatattatgaaatgcctgatgaggatattgatccggataagatctctccttggctgctgcgtattgagctgaaccgtgagatg

SEQ ID NO: 100476 - DNA, 238 bp, Triticum aestivum
  unsure (1)..(238): unsure at all n locations
  Clone ID: PAT_TA_100476
gnnnccatagccgcccttagaccacnaacaaacaccgttacatagccttcaacaacccaaagcaaacctatgcatgttggtannccttngcgggcacctggggggacttgggggacnnttggggaaaatggggctccttgccctccttttccggcggattatgggggggcagaacatgggggatacgggggatcaccccnnnntnacccagggcgacaccggccaaaacccttcctag

SEQ ID NO: 100477 - DNA, 394 bp, Triticum aestivum
  unsure (1)..(394): unsure at all n locations
  Clone ID: PAT_TA_100477
gctggaaccacactgactgatgggcttttatacacaactacactggtttttgaacnncctttgacaaaactacatacacaatgggcaagtgactgctaatgtcaacatcgggggtcttattacaaatatgcacaaaaatgcacgtgctacttactactatctctcaagccacgggacctgtcaatgatcactncntggctgtgcacgggggacaccggaacaactggtgctaatgctgaacggaaggaggaactaccgcaccgggaaaaaaaggaaaaggttcctggtcaacccccgcttcctcctctgaaaannnactcccttgggaacaaaaccctctaacacaacgnnnaactcnnccgggtccannnncnncctcctcctgatgaaaccc

SEQ ID NO: 100478 - DNA, 460 bp, Triticum aestivum
  unsure (1)..(460): unsure at all n locations
  Clone ID: PAT_TA_100478
gcacgaggcctcgccgcacctgcctctccgccgccggctccaaactttatgtccaacgctcgcgaggctgcctcctcctcgccgccgtccaaaaggggcggaggaaggcggtggtggtggtcatgggcgcgacgggcgccggcaagtcccggcttgccgttgacctggcggggcactttgccggcgtcgaggtggtgagcgccgactccatgcaggtctaccgcggtctcgatgtcctcactaacaaggtctccctccatgagcagaacggtgttcctcaccatctcttgagcatcgtcgatccttcggcggagttcacttgccgcgatttccgtgatcatgccttgcctattatagaagatatattggatcgtggcggcctgcctgttattgttggtggcacaaacttctatatacaggctcttgttagtccattcctctttgaggatatgtcagangn

SEQ ID NO: 100479 - DNA, 663 bp, Triticum aestivum
  unsure (1)..(663): unsure at all n locations
  Clone ID: PAT_TA_100479
gcacgagggccacaaacacaatcgattgctgttaacacaccagggatatcagcatcgcccttgctagcagaatttacaagcgtggatggaagtcaggctaacatgctaactcaagctccaaccaaatcaagtgcagtagaaaggcctctggatcgcttacttaaagcagtaagtatcctgtgaactttatatttactttctgtgtaattttttgtgctttaatcggtgttcatatcggaaagaattttccaacggtaatttttaaagttacataacttatgtattatattgttctaattggtggtcaaagttaaatcttgaaaagcgtgcaggtcctccttttggagtaggagggagtattgtaaaacttgacgatagccagactgttctgaagcatactggcataaaaaaatgagggccaagaatgtcaatttgattataggagttagatatatcattcccttttcgggtccactaaaattaactagttgctcaaatgataggaatttcacataatcatttttgttcttaccatctgaagatctgaaagcatgttaagggtaacatgaaaatatgttactccacttcggtcaactagtttttcacatgatggcgatgctgcctatccatgtccattcttgctatcctaatannngaaagttc

SEQ ID NO: 100480 - DNA, 531 bp, Triticum aestivum
  unsure (1)..(531): unsure at all n locations
  Clone ID: PAT_TA_100480
gggaaattgtgaatattagcatataaacatgtatgagaatgttgcaccatttctagcagacaaacatgtatctttccctactaataaagcacggagtgcttctgcccgtccgtcgtcggcacttttccagaaaagcccctctgcttgtgagaattcaacccgcagtccctgtttaagtggatctgagataacgattcatttttacaaaaaagaaccctacgtttgtaagaattcggtccgcgaccctttgttctatcttatccacatgcttcctttccggcgcggtggggcggcgctcttcgcggcggcgacagctccggatggttggatttctgtcgtccgtcacgcttttttacaaagaagcccctgtggtttacaaagaagttcgcggcccacgtgatgctcaatccgctgccggccgacgccggcgaccgcatcacccggcaccaccgttccacttcggctcctctcaccagcgcgcccgagctcctcctcttcntnccttaanaaccaagtcttnnncctgtgcta

SEQ ID NO: 100481 - DNA, 603 bp, Triticum aestivum
  unsure (1)..(603): unsure at all n locations
  Clone ID: PAT_TA_100481
gcacgaggcgaagaattcgccgtagcggcaccagcaggccagcacgtccaccccacctccccctcgcagcgggtgggtcccgccgccagcttccggcgagccgccggcgggcggcattgcgctctccgggccggttcttgactgacggatggcgtcgccgggtggcgggtacgcggaccggccagcgccgccgctggacgggatgatcacggtggacgggggcgggggcaggacgccgccgccggcggggctgccgaggccgccagggttccgggggctgatgcagcagccgtcgcggctggcgtccggggtgcggcagttcgcgtcgcgggtgtcgatgaaggtgccggaggtggtgccgggcatccggccgggcggcgggcggatgacgcggatgcagtccagcgcgcagatggggctcaaggggctgcgcttcctcgacaagacctccgggagcaaggagggctggaaggccgtcgagcgccgcttcgacgagatgagcaaggccagcggccgcctccccannnagagcttcggcaagtgcatcggcannnggggactnnnnnnngttcgccggcgagctgtnnnnnncgctgtcgcggn

SEQ ID NO: 100482 - DNA, 179 bp, Triticum aestivum
  unsure (1)..(179): unsure at all n locations
  Clone ID: PAT_TA_100482
atcggaaccatgaaatccattcactgggggcaacatcgtcgagtcgatttctacacaaaagggctagatcatgaaaccttgaacagaccaaaccagcaacaaatcntggcctggctaaatctctgcacatgatgttgctatgggctaaaacagtttccccatgtacaaaaaatcaaaaa

SEQ ID NO: 100483 - DNA, 598 bp, Triticum aestivum
  unsure (1)..(598): unsure at all n locations
  Clone ID: PAT_TA_100483
gcacgaggtcctcgttttgcgcagcttgccgtgccgctcgggcgagggtggtggtggtggtggacatggagccgtcgcggcggcttctgctctccgactacgacggcgcgatcatgtcgccgctgccgtcgccgtccacgtcctcggccgcgccgttcaagccgggcgtggcggtggtcgtggggatactgacgagcgtcttctccatcacgttcctcctgctgctctacgccaagcactgcaagcggagcgccgcggagtcgtcgggcccgtacggcagcggtggtggttccggtggcggggcggcgggtgagcggaggaactccggcgtggaacgcgcggtggtggagtcgctcccggtgttccgcttcggcgcgctgcgcgggcagannnccgggctcgagtgcgccgtctgcctcggccgcttcgagccgacngnnncgctgcggctgctgcccaaatgccggcatgggttccacgtcgagtgcgtggatacgtggctggatgcgcactccacgtgcccgctctgccgctcccgcgtcgannccnnnnnnngtgctgctcctgcccgnnnnnnncaagccgtccacgacgggac

SEQ ID NO: 100484 - DNA, 504 bp, Triticum aestivum
  unsure (1)..(504): unsure at all n locations
  Clone ID: PAT_TA_100484
gcacgaggccagtgcctctcaaaactctctacacgtgtcgaagcatccccgcgttcgttaggccgcgacgcccgctcgtctgaaaacatggagctcccggccgcctccgtcccccactccgtctgcacggcgtacagcaacctcgtcacgacgacggcggcggcggcgcagcatcggcgcacgcggcggccgccgccgcgcccgcggcagggcaggtgctgcgccatgctgaagcagcacaagacgaggctgtacatcctcgggcggtgcgtgtccatgctcctctgctggcacgaccgcgacgactccgactgagcccctccggctatgtctggtgcaggcctttttttttcttcttgattttgtcattgttcttttgtgtgtgaacagaagcgtcatacacactcgaagnnagatgctggaaatattggctggnnagtttggcagatgatggaatgaaacnnngcaaatgtacatgnnnaagtttcttttataagtatatga

SEQ ID NO: 100485 - DNA, 646 bp, Triticum aestivum
  unsure (1)..(646): unsure at all n locations
  Clone ID: PAT_TA_100485
gggcacgaggaggtcgtcgttgccatggatcgcgtttccaatgctgtgcacatccagatgcctgcgccggcgcaacaatcctctgctcccatggcccagccaccgacgggcgtcgcgccggccgacaagacgctctcgagcgcgtcggacctcctgaagctcctgccgacgggcacggtgctggccttccaggcgctggcgccttccttcagcaacaaccatggcgtctgccacgcggccaacagatacctggtccaggcgctcatcggcggctgcgccgcctcctgcgtgctcctctccttcacggacagcctcgtcggccgcgacggcaggctctactacggcgcggccaccttcgggggcttctaccctttcaacttcaccggcacgcgcgccgagcgggacgcggtgttcaaggacctctccaggttccgggtcacgcccatggacttggtgcacgccgtcgtctccgcgctcgtgttcctcgccgtcgcgttcgccgacgccggcgtacagggctgcctgttcccggacgccgcgagggacttgagggagctgctggtcaacttgccggttgccgctggcttcctcgctagcatggtgttcatgatcttccccaccancnnnannnnnatcggctacacgg

SEQ ID NO: 100486 - DNA, 620 bp, Triticum aestivum
  unsure (1)..(620): unsure at all n locations
  Clone ID: PAT_TA_100486
gcacgagggccttgtgctgaggaactagagccaggttgcaggcaggacttccaatggataagcaaaagaatcacaagaatgcagaaatggggaatgatgtgttccgcagaataattcttaatcaggttggcagggacatcggtttggaggaggagaacgtgccttgcaataccccgagaaactccgttcattcgcggtttggtggctcatctgccaaatttgctgcttccaccagtggaagtaccggtgctgagttggtcagcccaggcgagtatgtcagagatcctggatccatattgagcttgcagccttggattttcaagaggagcagcacgaagaacaatgaggaaatggtggttccaagtggtagcaggtcagttggtagaggcaagaatctggtggatggctttcgagatggttcgactactgaggtttccacaagaagccctggtcttggttctgggcctggaagnnntcgaggtgctcttnnnagcagacgagcccagnnncattttattaatccactcgtcgcaacagagaactcatacattccacaactttacaatgagaaattcgagtttgaagaatgcacatttgctccagttccatccccagcttnn

SEQ ID NO: 100487 - DNA, 629 bp, Triticum aestivum
  unsure (1)..(629): unsure at all n locations
  Clone ID: PAT_TA_100487
gcacgaggccttcctgcccgacctggaccaggagacattcgcccgcacgctcgtcgagctcctcaggggggacaacttccacttcgggagccccctggccgccctgttggaccgcctcaagggcggcctctgcgaccccaggattgtcctgtaccgccgcggcagccgctttgcggagcggcgcaagcactactaccatctgcagaggtaccacaattcgatggtgctggggctgtgggacaccaaggactgctggaagagctgcaacaggtacagccttggtgagaggctcagagctatggatgcaatgaaggcacagcggaagcagaaggaactgggtttggttgcccgggctggatcagagactgactcagagagcagggagtctgcggaacagttcttgacacggtcgaagccagataagatggctctcaacaaggctgggaatttnnnnaaggaaaggtccaagggcgttctgcggttgggtgtgtcaaaagccgtgggtgaggagtacattggaggggctggtcgtgatgctgcagtggctctccctaagctttctcgtccagataatgcttatgggtatgatgccggagtcgcgcataganngaagcagcacagannnnnag

SEQ ID NO: 100488 - DNA, 602 bp, Triticum aestivum
  Clone ID: PAT_TA_100488
ggtgcgctctgcagaagaagagcggggagaacatcaacaacaagctgcagctggtgatgaagagcggcaagtacacgctcggctacaagaccgtcctcaagacgctccgcagctccaagggtatggatagatcggctctctgctttttacggcttttttttatctcactgttgattgatttgtcgctgtggctgatctgctagttctcttgtctgctggatccgaagggtagtgctgtaacttacgctcgggaccgtgttaattccagagatgcgtgattaggttttgtagaatgaagtggttaatatctgctttgtggctgtcaattacttgctgtacttattattagtgggaaataagttgaactgtatgcgtattctctgcacgtgtgtagtgatgcccactgaagtttgtagcgttgaaacttttagttcgtagaatgggactgaagtttacctcattggcttgctttcgccgtgccttggagatgaatacagcgccctagaacaagccacctcttagttaagacttctacgggacttctttaatgtctagtggacaatgggaggttgaaatatttctgtttgctgatagcagtttgt

SEQ ID NO: 100489 - DNA, 617 bp, Triticum aestivum
  unsure (1)..(617): unsure at all n locations
  Clone ID: PAT_TA_100489
ggacgagccatacttcccaagaacaccagaggggagccacacgtacgttgcgactcgcaacaatgtcactccccggcgctctcaccgcgagctcattcgccgtcctcctcctcctcgccctctccacgtggccgacgtgccacgccacccacaacatcaccgccatcctcgcggcgcgccgggacatgtccgagttcagccgcctcctcacgacgacgggcctggcggacgaaatcaacgagcgcaacaccatcacggtcctcgcggtcgacgacgccgacatggctccgctcagggcgcgtcatctcccgcgggaagcgctccggcacgtgctctccatgcacgtcctcgtcgactactacgaccacgacaagctgcaccgcctcccgggcggctccgcggacgtgtccaccctgttccaggcctccggcgacgcgcccggcagcgccggcatggtggagatctccgagcgccggggcgggagcgtggccttcgtgcctcnnnncgccggcgacgacgcgcgcgccaccagcgtgctcttcgtcaagcccatccacgnnnagccgtacaacatctcggtgctgcaggtgggcgccgtnnngtcgtnnnnnnncgcc

SEQ ID NO: 100490 - DNA, 591 bp, Triticum aestivum
  unsure (1)..(591): unsure at all n locations
  Clone ID: PAT_TA_100490
gcaagctcgacaacagagtaccaacaccaaccacaacaaccccaatttgcaacgcacataagatcaagatggcgagcaaacaatggacgcgggtgcagacgatcggccgcggcgcgtcgggggccgaggtcttcctcgcgtcggacgacgtgtcgggcgagctcttcgcggtcaagtccgccacggcagcgtgcgcctcagctcttaagagggaggaggacctcatgtcctgcctgcgctcctcgcgcgtcgtctcctgcatcggcggccgcgccgcccgcgacggctcctaccagctcttcctcgagttcgccccgggaggctcgctggcggaccgggcggcgatcgacggggggctcgacgagcgcaccgtccgcgggtacgccgcagacgtggcggccgggctcgcgtaccttcacggcgccgggatggtgcacgnnnacgtcaaggccaggaacgtcgtgatcggcgccgacggccgcgccaagctcgcggacttcggctgcgcgaggaaagtgnnngnnnnncgtgccgatcatcggcggcacgcccgcgttcatggcgccnnaantggcgcgcggnnnnnnnnnn

SEQ ID NO: 100491 - DNA, 651 bp, Triticum aestivum
  unsure (1)..(651): unsure at all n locations
  Clone ID: PAT_TA_100491
gggtttgagggccaatggaacgaaaacgtacgtttatggtataacttattgattataatacagtatacaaaggtcccttttcagggaccctttcgtatgttgtagctgattttattttcttcttttcttttgggtgcttttaatagccatatatgatgtttcatataaagttaaaagtttccccatctgtctatctatagcgtcatgtttttcaggatttcttaatttctgcagcagtttagatatatatttcgcaggtaactttattattaatgaattatgggattgatacatttcctttgtccaatctaaatcttttcctgatttcaatacctcactctcatctctattaattataaaaccgagctttccatacggacctgttaaatatgattgtaattgtctatactcagatggacctaattcttcaaaatttttagcatcaaaaacaacttgtcttgttttatagtcctccaatactcgtttccaaaaatcagatttgccaccattggtgcctataatatctcgtctctgaactgcgttaccatttggatgggacttgatgtctgttaggtgggatgcaaatactattcttagtgcgtctnncaccattgttcaaattcagtggcaccttcatttcctatcggtann

SEQ ID NO: 100492 - DNA, 608 bp, Triticum aestivum
  Clone ID: PAT_TA_100492
gcacgaggctgaacacctgatgtttagggtcaccgtttccaatgttatccgttacccgagtagtctgactcacatcacacccaggagtgccctgagcagttgctgcatggacaatctggggctaccagaatatgcaatttctttcaggaactatgctggaagcctggataagacaattctgtaattggggatattttttcgctcatccttctgaaatggaagaagttcaagcagataatataggcatctgttgttgaagtttccttcgttagctcaagctgcacagtttgtttgatgtacagtagatccattacctgtacaaactgtggtggtccctccatatatagaagcaaagccataaacgaatcatgcatacgcttcaacagtttaatcctgagaagcatggataatttcataattttttcttggtgtcaggctatcagcagcgtcgagcaatctgttttcttttttcttgtttgtgaagcaaatgtttccgataatatgttgtgaaagaactactcacttaatcttgtctctaagtcaaacctgtttaagtttgaccaagtttataggaaaaaaacatatctacattatttaaaaaaaaaaaa

SEQ ID NO: 100493 - DNA, 565 bp, Triticum aestivum
  unsure (1)..(565): unsure at all n locations
  Clone ID: PAT_TA_100493
gcacgaggcaagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctcnnnngatcgggn

SEQ ID NO: 100494 - DNA, 632 bp, Triticum aestivum
  unsure (1)..(632): unsure at all n locations
  Clone ID: PAT_TA_100494
gcacgaggcaccttagaaccctagccaccggctcctcctcctcacacctcagccgcctccccctgtcccctccctttccccccaatctcatccaccccgggtgcggaggcgagcttcccggcgacggtggcgctggctcgaggcggccacgcatccactcctccatctccttctctcccttccgcctcctcttgtcgcagctctacctccccgcctggcagcggccaaagaagggctgctccgccccctcctctgcctctcttcctgagcatggcctcgatctagagcaggagaggccaggagtgcaacctcaatctggagaagggcagcagccgccagccgattccggcccactccagcaacccgagcgggccagcaccttcccgtgctctcctatcgttcctctaccatgtccattgatcctccaacatcatccccgactatccccggccgttcggactactggtgtgnnngtgttgccatggatgccggcggggtgcccacatctctgacgccttccgcgttgcctacggggcatccacctcatgggtgggggaaaaagagggactctttggcgatggagagcttgggattcatcacccccaactgaatctaccctgctatcacatgtt

SEQ ID NO: 100495 - DNA, 618 bp, Triticum aestivum
  unsure (1)..(618): unsure at all n locations
  Clone ID: PAT_TA_100495
gcacgaggccggagcccggcgtctgggccgtcctcaccgccatctccaagaaggcccgcctccgcgccgaggggatgaacattcttttgagtgctgacgagcacattctgggccgcacgaccgagaacccgcgcttcaggatttctgttttggcagtcagtgggaatcattgcaagatatataaggacactgtgataggggagctgcaacgcgatgaacctgtgcctgtttacctcaaggacacgagcacgaatggcacatatgtcaactggaataaggttacgaaacgatcacctccaaccaagcttaatcatggggacatcatatcatttacccaacctcctcatcacgatgcctcttatgcatttgtctatcgggaagttaatgcggtcagctgcgtagggaatggtactaccatactcaaaagaaaatcaggggaggttggttctgaaagcaagaggctaaaaggtctgggcattggttcatctgatggtcctgtttcactagatgatattcgaagactnnaaaaatctaatgcagagctcnnngaacaactcgaggcacatgttgtgacaattgagacattgagagctgaaagcaaaacagctgaagcgcagc

SEQ ID NO: 100496 - DNA, 520 bp, Triticum aestivum
  unsure (1)..(520): unsure at all n locations
  Clone ID: PAT_TA_100496
gcacgaggattttcaacttctaccaaagaaaaaccaggcgctgagaaccaaatcacgcacgaaaacttccaagattggggctctgcatccgactttttatggtgcgtcgtgttttcaccttatgtcacacgcagataagctttggccggccggccggccgacttggtgttgtagtgcgtgtcaccttcctaagtgaaaagctctcaaccaagctctcaacctctgaccacaacggcttccctaagctttgtaccaaccgcatcgttttctttactttcacgggaggaatcatgttaagcctcggcccttctgcgatggagtgcacgccgaaaaggaaaaacgaccacgacctcgtaacttcaggaccggcacagcactaagcgtccaaaattggacacctatgctacggnntnntnntactgtgcgcatgcatgacacctatttgcgatctcgttttatatactgtatgcgtcatctgagactgtatcttatatatatataccgtactntattnnatatn

SEQ ID NO: 100497 - DNA, 622 bp, Triticum aestivum
  unsure (1)..(622): unsure at all n locations
  Clone ID: PAT_TA_100497
gcacgagggtttcctctcactcacctctagtctcatccctcgccaagaacccgcctccgcttccaagagtctcgacgtctccgccgtcgaccgaagcagcaacaacatgaagcgcttgctgagccggctctcccgcgtggccgccgccgacgcctgcgcagccgccgcgtaccagccgctccggcccgacgctgcggccaagggctcctccgcagtctcctctccctcgtcctcattcttcggcgcgcgaaggctcagcagaggcgcgtgggtgccgcaggggcacgtgccggtgtgcgtcggcgaggagggcggccccgtggagcgcttcgccgtgcgcgccgagctcctgggccagccggcgttcaaggccctgctctggcgctctgcgcaggagtacggctacggtcacccaggagcgctccgcatcccctgcgctgtggccaacttccgccgcctcctcctcggcctctccgaccccggctgcaaggccaccgacgacgacgatgccgcgctctactattagcctagcacttccccgtttcaccctcctcgttcggctnncatggagtggnnngcgtgattggaaatttgccccctggcgnnnnnnaagcggtgaacc

SEQ ID NO: 100498 - DNA, 332 bp, Triticum aestivum
  unsure (1)..(332): unsure at all n locations
  Clone ID: PAT_TA_100498
gaaggnnncacccatcatattataatcatnnnacaaccacccaactaatagctgcgctgaaaagaggatcatcatcgttgatccaacaaaggcggngatgccgcccgacaaaaaataatatttaaactaccngcattatttctccgtaaaagatgattcctcacccccaccaccacgaagatgatcgtcttcttcctccttcctcctaannagccggccaccagaaaacagcagcaaaagacggccgcccatccttccttcatgaaagaacgcccgctgttctgctgctgctgctgggggggcggctgctgctnctcctactgcggcgagcc

SEQ ID NO: 100499 - DNA, 601 bp, Triticum aestivum
  unsure (1)..(601): unsure at all n locations
  Clone ID: PAT_TA_100499
gcacgaggccgattccccacacctgtcgtcacacttctcattttctcccgaccaagagcgccggcgaccctgcttttcttcctccttcggaccaagtgcgtcaccggtccagctcctcttcctcttcctggcacgcgcgccaccgtccccgcgcctccttcctcctcctggcacgcgggccgccgtcccagcgcctccttcctcctcctggcacgcgcgcctccatccccgcgcctccttcctcctcctggcacgcgcgccgccgtccccgcgcctccttcctcctcttggaacctgtgccgccgcccccgcgcctccttccgcctcctagcacgtgcgccgccgccgccgcacctccttgcttctcctgccatgcgcgccgccgccccgacctttcctaccgcactctcctcccaggctcctgtcgccgccccgcccacatcacgaccagctccggccactgccgcgcccccatctcccccggctcccacaccgccacgcatctcgtcctggtggggcaccataaccggaccaccccagtccccnnntcgttcaacgccaccaccccagtccgttcattgcagcaacacccttngatcca

SEQ ID NO: 100500 - DNA, 307 bp, Triticum aestivum
  unsure (1)..(307): unsure at all n locations
  Clone ID: PAT_TA_100500
actccccaaaataaattattaaagtgtgaacacatccacacatgcatatcaaggacccatncnttaaccaacttaactgcaaaaaccaattgtcgnnnancgttgggctcgcggcncnaaaaaaaggattttcggagaagccctttcaggggaaagaaacnttcccgccgacaacaaggcccctacgggaactttgtaaaattaaaaaagaaaagcccactcaaactcttaaaggggcccataagggaaaggggtgcttccgnccccccctgttctttgttcggancatatacaaannnnannaggg

SEQ ID NO: 100501 - DNA, 318 bp, Triticum aestivum
  unsure (1)..(318): unsure at all n locations
  Clone ID: PAT_TA_100501
gcacgagggagcgacgtggtgagctgttcttcccccctcccctcttcgtggcctgctagtctgcgtgctctggcgggtgcgtccgtccgtcctccaggggggctattaagggcgtccagctgatgtcctctatgagcgggtaaagcggcgccgaggaggagcaggaagaagcgccattcttcgtgggctgcctgggagagttcttggctgctgctgctgctgtcgtttgtctgaggtcggaggttgaccaagggtggcaatggcgccgtcgttctgggggagggaggcgaggctgaacgacgggggcggnnnaacacc

SEQ ID NO: 100502 - DNA, 613 bp, Triticum aestivum
  unsure (1)..(613): unsure at all n locations
  Clone ID: PAT_TA_100502
gcacgaggactccacatccgctgaagtgtagccagagacaggagacggccatgagaggcaacaacgcgtggcggctccgcgcgctgctgctggtggtgctctgcgtggccgcgcacttccagggcgcgtcctgccgcggcggcggaggccatggagtcggtgggcacggtgggaggggtactggggacggcggccgatggaggggtggcggcgtgggtatgccgtggtcgcaacgacacagcggggccgctgaactgcgtgcaggcggcggcgtccactggaggatttccggctgcgccaccatcgcggccgcggcgctcgtcaggtggctctgaccgtacctacttccgcaagctaatctcgagagacttttagtgaactggtagctagctactagcaagtttttcttgatgaaatgtacttgcaagtgaagttagcagtagtaggtcaatggactgaatccaggttcgacgacgagtgatttccggtagtagatcactggatttgcgtgggttcttcaagatcaggttggtgtggatcgatgcataaacgagaagctagcaaaagctggacaacaaggtcaccgccccatgctttctgcagaaaacggann

SEQ ID NO: 100503 - DNA, 595 bp, Triticum aestivum
  unsure (1)..(595): unsure at all n locations
  Clone ID: PAT_TA_100503
gcacgagggcggtttggccgacacaatcaaaatcgcggggcggtggttcgttcatcctgcacccacccacacgcttacccagatctcgcgcgccgccgccagggcaatggtgtctgagcccgaccccgaccccgaccccgaccccgacgtctccctcctgccccccccctccgaaccctagccacaaaccctgcctccgggcagccaagaccacggccttcaagcgcgaggagcgccacaagcgcaaggagcagaagcgggagttcaagcggcagcgcaaggagcagaagcgggagcgcaaggagcagcgcaaggagcagaagcgggaggcgccgcaagcgcaaggaggagaagcgcgatcgccgcaagcgcaaggaggagaagcgcgagcgccgcaagcacaaggaggagaagcgcgagcgcaagcggcagcggaagcgggaggacaccctcgccctcgcgctcgcccagtgggagcccctcggtgccccggctgccgcctccgccccctgcgcgccacccgaagncaggcccgggccgcgtgacccgtcctcgcccgcgggcgccgcgccctccgnnncctggatctggggcc

SEQ ID NO: 100504 - DNA, 611 bp, Triticum aestivum
  unsure (1)..(611): unsure at all n locations
  Clone ID: PAT_TA_100504
gacaaagagactatcaatattgtgtaattgtctgtaatgtgataacaactctgatttcttccaatgccaaatgcagaaatgtaaggaagatgataggatcagcaagttgcccaacgacatactggtcaacattcttgaccgtctcaatttccgtgatgttacaagaaccagtgtcctctccagacgttggagtcagcttcctgccaatctctcacggcttaaaataagtgctcgtgattttctgtccccacaagctagcatacctgatgatgaattggatgaaaaattgcttcggatcaatgcattgcttaggatcaatgcagtcaatgcagccaatgcagctgtggtcaaagcgacaaagagcacgctggcacacagagatccaggtggatgcaccatccgcctcttgagcacgacgttctacttgagaggtgataccccaatatctgttgggcatactgttggcaatgccatggcgacactcaaggtcgagaaagccgaattcacagttttgacacagcagaaaggacgcgggtgtagtattgatgagnnnggtgaagtttgggacancggtttgtgtcattttttaatgaatgccacaatgcatttgn

SEQ ID NO: 100505 - DNA, 606 bp, Triticum aestivum
  unsure (1)..(606): unsure at all n locations
  Clone ID: PAT_TA_100505
gcacgaggggtccatcgcgcccacctcccgcatctcgtccaaacctcctcggcgggcttggaggcgagcttccccagcagccgcggaggtgtgcaggcaaagggcgacggcgccggcgtgcaggcaaagggcgacggtggcggcgctcgattcgttctgtaggagagagagaagatgagagggagcgagaaggaagaagatgagaggaaaagagagaaggggggaggagagggaggcgtcgtgtcagacgggagtgggtcaccggccggcgtgggcctgcgctggcgaggtcgggctcgaccttgtggttggtggcggctcgatctgctcctggatcgggacctactaggaggctggcgcacgtcttctaacctgtagcggactgtacagccagcgggagcgccggtccagatcatgggcatagctcggtcgagctacagcgagtgcatctgattccaacacatcaaggtgagcttcacacttcgttccctcttttattcttctcaggcaacgaggggtcagtggaaaggcaatgtgtttgatatgtggagttggtgttgnnnntggcggtagtacacnnggnnnnngcccatcgcttgatcttgg

SEQ ID NO: 100506 - DNA, 437 bp, Triticum aestivum
  unsure (1)..(437): unsure at all n locations
  Clone ID: PAT_TA_100506
gcacgagggagagagagagagagagaactagtctcgagttttgtgtgtgttatatttcaggatcatgatgaaaatgaccttctctttcatgtaatggttaaaatgagtcacggccctgttcgctgccagtctttttcccttcccggctaaatgaataaaatattatttcctttcggccaggtgaggaagggcggcgtcggcttgaccatgtcttctgttttngtcgtttcaaaaactaagtttctcattcaatggtgaggtgtttataaaaagcaaggcctcgctcgacaagtcatgtanncataggtttgagttccctaatcagtagtgtaagttccacaagtaagtagnntaacttccatttgaattccattagttngcaacgtttttgaatttgtatcacactgntgagtttcctagttttttnnnnntgcaag

SEQ ID NO: 100507 - DNA, 350 bp, Triticum aestivum
  unsure (1)..(350): unsure at all n locations
  Clone ID: PAT_TA_100507
aannnnncaaccacacccccctgaaacaaaaaattcatgaacgacccanatactaaaacccccaccaaaaacaaaacttaggggggggaaccaaccaacacttgcaggttctttcggacaaatggaaccaacgaaggagggggggaaccaactcaacccttgagctggccaaaaaacccttgtttttcgtccgggggaggaaaccgaccccccccaaactagaagaaggggcgaacaaacttgagcttgactccctccacggccaaaaaaaaggcttgctcaagcagggacggggggagggcacccacccgttggtgggggcccaccangcctcccttganaannaggta

SEQ ID NO: 100508 - DNA, 350 bp, Triticum aestivum
  unsure (1)..(350): unsure at all n locations
  Clone ID: PAT_TA_100508
cttggacaaggaatattttttttattaatcgcttgcgctaattggtttgcacgggcatgggctgggcggaatataaaatagtttcctttggtttgagcaaaatatacatttaacctacaaaatagtgcaaataagggcaacggcatgaaatgcaggacacggagggctccttatccatgtgttggagatagccgtacccatattgatcttgacggtccccgtcctcattgttttcgagggagatgaaatattacaatcggaagctgcatntcgcaacttatgcagctggccctngtctttgtgtctttatcttcatccggtccatgaactgggnnttagcctnnancctn

SEQ ID NO: 100509 - DNA, 596 bp, Triticum aestivum
  Clone ID: PAT_TA_100509
gcacgaggccccaatctcctcccgcactcaacccaatccccacctacccgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgaggccgccaaactcgcgcgctacaacaagaagcccaccatcacctcccgcgagatccagacctccgtccgcctcgtcctccccggggagctcgccaagcacgccgtctccgagggcaccaaagccgtcaccaagttcacctcctcctaggttcgcccgccccccctcatggtgaccgctgttgatcccctgctggatctgcctgcctatctagatatatatagtagtatt

SEQ ID NO: 100510 - DNA, 578 bp, Triticum aestivum
  unsure (1)..(578): unsure at all n locations
  Clone ID: PAT_TA_100510
acacccaaaactgagattacattacaatagccaagcaaagtacatagtacaaatctagtatttagctataaaatacaactaaatatacacataactagattcacacataactatctccagtgagctaaaaacgtattgctcgggggggtttttcttcgggattcttcttccttgagctcctgtacacccaacttttgaagaatgaaggccagcatcctggggcggccgaagatggggaaatgatgatctacttgttcttagacagctcaatgagcacccacagtttgtaggactctggactctgagtcaagcaccaaatgaacacatcaatggcctccttgtcaagctctccactattttcttgaattgccttcacaaccaacggcaaaagctgatgcgatgctggctaaacaaccttagagccaggagtaccaacaagagccagctcctttattgnnnnnnaggctnnttcaaacctttatgtnncctggccgcgcgttgccggtcggtctcgcctcaccgccgtggggagcgaggcaggggagggaggcnnnccaagatcttcactccacagannn

SEQ ID NO: 100511 - DNA, 461 bp, Triticum aestivum
  unsure (1)..(461): unsure at all n locations
  Clone ID: PAT_TA_100511
gcacgaggcagaaatccaccatgtccgaccacatcgacctcaacgccgccgccgtcccccaaaccctagcccccgccaagcgcggccgcggccgcccccgcaagaaccccccgtcccccagcaacgccactcccccgccccccgcggcgccggatccggccgccccaccccatgccctagccgggtctggctccccggccaccttcgcccccaaggacctggtctggggcaagaagctctcccacccgtcctggccgggggaggtcctctccgtcgcctccggcggcacccagctcctcgtctccttcttcggcgagaaggccctcgcctggtgcgacgcggcccagctcaggccctacgaggcctacttcaccgtgggggagctctacgacggcgacgccgacgacttcgacgccgccgtcgacgcgtccctcgacgagttctccagccgcgnnnaggcc

SEQ ID NO: 100512 - DNA, 601 bp, Triticum aestivum
  Clone ID: PAT_TA_100512
gcacgagggagagagagaactagtctaggatctttttttttaatgttcagttgagcgacatcctttacatctgtcacactatacatagatgcaactttgctatcttttgacctatagcctgcattcacaagcgtatggcataaaatgctggtccattctatttgcccattttttccgtgcctgcgtgaagtgggagtgcagcgttttggtgctcgggctacatggagcccttttttaaaaaacattcaaaaatgacatttcaatgtttcaaaaaattctggaaacaattccacattgacatgtggatgtataccacacgtgtgtaaaatttcatgagaaaatacattgattcgtgagctacacaaaaaagtgaaaatcgttggttcgtatagtgaacagtgcacacactgttcactgtttccattgtcagcaatttgccttttttgtgtagctctcatttcaatgtatttcgtcatgaaaatttgcgagtatgcagtatacatccatatgatactgtggattttttctcagaatttttgaagcattgaaattttcattttgtttttttttaaatgagctccatgtagctcgagctccaaaa

SEQ ID NO: 100513 - DNA, 484 bp, Triticum aestivum
  unsure (1)..(484): unsure at all n locations
  Clone ID: PAT_TA_100513
gcacgagggaacactcgccaaaaaacctccgcccaactttgccaagttgaccagaggcttgggggctactgacggagtaattgaccacgggtacgccgaagacgggaagacaatatttcaagacattggggctagcaaagcccctcagtccgactgcccggctgctcctgtcagctccccgtccggctgctctgtccgtctggctgccggctgccgactgcgccgaccagccggctgccgactacagcccgacccgacacctacccgacatcgacaagacaccgacgagatgaccgtaccgcgacgtcatctacagtgtactgtgtcccctnnntactgatttataaagtaccccaggggacaagcatgacatgcaccatgccactagctatgcctacatagcttggcttgtaagctacccaaggtagcttacaaccaaagccactaccacccatgccactagctaccttacaaaaaaaaaaaa

SEQ ID NO: 100514 - DNA, 535 bp, Triticum aestivum
  unsure (1)..(535): unsure at all n locations
  Clone ID: PAT_TA_100514
cgccaaacgagagccatttgtgaagcttctttccgatattccactttcttgtttcgtccctccccacctctcctcttccacccccctcacatggtgtgatcggccaagcgaagggaccaccgcagccatgcctccgccggtagccgccgcgctggtgatgctgctcgccgtggccttgggcgcggcgcgcgccgccgacgacctagcgtccgacaccgcggcgctgcaggccttcatcgcgccattcgggtcggcgtccgtgtcctggaacgcgtcccggcagacgtgctcctggaccggcgtcgtctgctccggcggccgcgtcacggggctccacctgcccggggacggcctccgcggctccgtccccgtcggcgcgctcggcggcctcaccaggctcaccgtgctctcgctgcgcttcaacgcgctctccggcccgctgccggccgacctggcctcctgcgtcaagctgcgggtcatcaacctgcagtccaaccacttctccggtgagctcccgnnngcgnnnctctcccnn

SEQ ID NO: 100515 - DNA, 605 bp, Triticum aestivum
  unsure (1)..(605): unsure at all n locations
  Clone ID: PAT_TA_100515
cgccattgagaggccgaaggaagccactgcagcgccgccgccgctgcaggccgtcgggcacggcaggaggagccctccgtgcgcctgctcttcccgacgctgtcgggtcaccgtccatggcgtgatctccgttgccgcgtttcctccccgatgctgcgcccacgaacgcggctggcccatccatctcattgacgcccgtgtcaccaccttcgtggtcctcctccagcgtccaccgtggtgggagcagagtgcagcccggccatgacgggtacctccttcccgcgctccctagcctcccagcatctactcgtcgtcgtcagccaccatggtcggcaaggccaacctccacggcgactggatctgccaccacagccacgaggacgaccatcctccatggccaccccactgcccgcctcaccatcggatccgccgtcctgggcgtacacccgcgcatggtcggcagatgtaggcgtcgccggccgcctctacaacgacgagcactgtgactgtcatctatctatttcccttttttgtaggatatccagtgaatnnngaagttttgttctactgatgaactnnntgatgtcaaactgatgaactaattt

SEQ ID NO: 100516 - DNA, 588 bp, Triticum aestivum
  unsure (1)..(588): unsure at all n locations
  Clone ID: PAT_TA_100516
gcacgaggacagaatagaatagaatcccatcctctccatcctaggagagcccgcattccctcccctccccacctcgttgccctcgcagatcccccacccccggcgaatggcgtcccgtctcgcgtcccgcctcctcctccgccgccccgccgccgtattaagtttgctccagagttctagacatgctagacatttcagcactcagttacttgaaggtgctccgagacttccaaagccaacatggtgacttggttgaagctgttgtgcccttcatgggtgaatctgtaactgatggaacccttgccaatttcttaaagaaacctggtgatagagttgaagctgatgaggcgatagctcagattgaaactgataaggttacaatagatgtttccagtccagaagctggggtaattgaaaagttcattgccagtgaaggtgacactgttactccaggtaccaaaattgccgtgatatctaagtctgctgctccaagtgaggcccatgttgcaccatctgaagagacctcccagannnagacncctcctccacctcctccagagnaacctaaggttgaggcaaaatcaccnn

SEQ ID NO: 100517 - DNA, 318 bp, Triticum aestivum
  unsure (1)..(318): unsure at all n locations
  Clone ID: PAT_TA_100517
accggttcgggccccccctttgaggaaaaaaaccctatgtcccgcttggtgttaatcatggggggcataccctttgcgaaaaattcccgggaaaagtttgaaatgctcccgaaaacccccaccttatttgccngatgggggctagggttttacaatgcaaatttccgatctaccccacccccaagatggcttgtagggatttgtcgaggggtatccaatgatctgggctcccgggtgccacccatggaaaaaggggcccttcgggccctttaacacccctgatgtggggccccctatggacnnnccccgacatattac

SEQ ID NO: 100518 - DNA, 583 bp, Triticum aestivum
  unsure (1)..(583): unsure at all n locations
  Clone ID: PAT_TA_100518
gcacgaggctcaaccggcggcaggtggtgacaccgtgccagatccggccctcctcgtcggtggagttctacccaagccgcccgcttcgccttcaattcaaccgtccccgtcccgtccgcctcacgtcggcagtaggggacgacgacgagggagaccacacctgcacaccactgtgggtgtgggtggggcagtgggattgggaaggaaggaggaaccgtcctcgtctggtctgcccacgcgcttccattccaagggaggatcacatgctcgctcgcggacgacgcacacctaccaattctgcagatcatcgtcctctcgccgccaccgccaccgccatctctacggcgccgcgctcctaatccccacccacccgaatcgctccgccactcgcgcgttaagtggcctccctctgagtcatcggtcggatctagcgcctctgcggattggccgcccgcgcgatctggtcatcgtggggatgcggggggaggaggggcggagggggaggcgatgagcggcgccgcctcgctggggctgcgcacggggagctgcggctccctgnnnnncggcgggcgcgngcgcnnnn

SEQ ID NO: 100519 - DNA, 358 bp, Triticum aestivum
  unsure (1)..(358): unsure at all n locations
  Clone ID: PAT_TA_100519
gcacgaggctccccgacgccatccgcctctcctctcctcctccgccccaccgccaccagggcgaccgatctccccatgccgccccggtagcctccgcctctcccccgaccccctccggcggaccaacgccgcccggccacgctctccgtgacctctctctttccccacccacgccccgcgggccctcccctcggcggaaaccctaaaaccacnngatccgtcgccgccgccctgtccccggctcgccctcgttgaccgacgacagcgggacgtacccgacctcaaaccctaccccctgctgcccgatcgaaggtcaaaggaggacaccgacgacgactacatacgacccgnnnnccgc

SEQ ID NO: 100520 - DNA, 274 bp, Triticum aestivum
  unsure (1)..(274): unsure at all n locations
  Clone ID: PAT_TA_100520
gacaagcgtgtgcacctcaacacagacacnctataaaaaaacacaaatacacacacaaaaaaccccgtgaagaataacaaaaaccccccgagacaaccgcggggctcaaccccgcacacaccagggctcataaacagccccacaactgtaacacaccgcggtattctgaaacacacatgctgagacacccaaagagccaccccactgaggccccacacacgaaaagcgcgaggcgnnnncatatatatggggagaagggggggaaannnntccc

SEQ ID NO: 100521 - DNA, 607 bp, Triticum aestivum
  unsure (1)..(607): unsure at all n locations
  Clone ID: PAT_TA_100521
gcacgagggagagagagagagcgaaggtggacagacaaaactcaactgttttcaaaggaaacaatgatgatgcatcttataatggtctagcacatggaaataatgaactgggcaagagagtcatttctactaaaacactctactatcttagaccattcgagcgggtgaaagatgctcaggtcagagattcaagagccaccaatgcaggtcaagtaattttccaaccaggacgggaagtcggaacaacggaaatgattagagaggcgtctcaagctcgagaagcagaaaaggttgagttggaaacaataattgatcatcttaagaaacaagtggtggcgctagaggtgcagttgcgggacaggagaacctaggaaatttgacgtataacttaacatagtatagcggtagcttgggtgtttagaagacatctcccgatgaagagtaccacaatatggtgggctagtcttgccggtgaaatgatcctcatcagctaattgtgagtgcagaaactacacctcttacatcctaccttaaactctgattatttatatgttcctggttgcttttttctttatgttgtgaaattcaggggaatacataactgcnn

SEQ ID NO: 100522 - DNA, 583 bp, Triticum aestivum
  unsure (1)..(583): unsure at all n locations
  Clone ID: PAT_TA_100522
gcacgaggctccccaacaccaaagccaagaaccaccacacctccgctccctccaactaaacccgcatcccctccgccctctccctccccgccgcgagcctagagatcagccgcggcgcgtgcgagccgagagagggggggtgcagtgcgggattggttgcgcggtcacctccggcggtcgccatcggcgcccttttccacccatctctttaggcgtccaactcccggcccggccccgcctcgcctcttgctttcccacacccctgcttcaatgatgatggggcggtggcggtggtgggtttggtcctgaagccccatccatccccaggtcccaatccaccagctgctcctttctccccctccctccctccccgcttctcttttcagctaaggttggacggacggcaggctctcttttcctttccttgctggggattgggaggccttgagtcgaagccacctcccccgtccacatccccgcgcccgcctccctccctctgcaattggctcgatttggggcnnnnttcttggcctcttgnnnggagtctagggccagcgccaccaccaacctgcgcgtcccgtgt

SEQ ID NO: 100523 - DNA, 588 bp, Triticum aestivum
  unsure (1)..(588): unsure at all n locations
  Clone ID: PAT_TA_100523
gcacgaggctgaagctgcgtcccgtgagcatccaccggaaggtgggggcaggccgccgccgcccaccgccgatccttggctcggacgccgcttttgccgaagatcagttggggatggaggccctggagatccctcgggaacttgtgggaggagcctctgtcaaagctagacgtcggtagtgcggcagcgctccctctccccacctcccccgacccccaacaacaccgcaccctctctgagcagctagcctcgctgcctcccctcgccgacctcgccttggcgactttcccttgcctcagctgtctttccaatcccccgattctaacgcctcgccttggccatcttcacctcgctgtcagcctccccgacttcgccgatggctgcaaccccatcctgactatggatggcggcgtatgcatggtctggaagatgcgcgtcctatcgggccttcctatcgcttccagtggggagctgctcgagatcatcgatggcctcttgtgggctttgccaccgccagcctctttgtgtcctagcctgcgcggtaagcctcctgcctccatggggtcagccctgntnnngcggttctgg

SEQ ID NO: 100524 - DNA, 605 bp, Triticum aestivum
  Clone ID: PAT_TA_100524
gcacgaggctcacaagcacaacggtccgctctacttacgacgaatccattcgtcccacgctggaggctgccatggagagatgcatctacgaccatcccaaccgtcccatgttgatatggatgaaatgaatatttggcaaaattcaagcaggctggtagaagctgcagctgctcacagttagcatgagcaacaagatgggtgaacatggtaatagggtgacactgaaaagccaagggcacagcaataaccggacggaagttcttgttacatcagttagtggtattctacctatccaaaagtttatttcaagaaaactgttttcttgaaatgtttctagacatgggcaatcagcgtggtgtacctcatggctgatggtcatcattttcattgtgttccttcgttgtttgttaaagtgagcaagtgacattgtaaaactttcttaagtgctccctccatctaaaataagtgacacttattttgggacggagggagtacgtagttacatcaacatcttctttgcggggaagccgattcgctctggagccactcccccggccagcgaggacgaggaggctctccgcgatgccatccaccgacttgaacta

SEQ ID NO: 100525 - DNA, 594 bp, Triticum aestivum
  unsure (1)..(594): unsure at all n locations
  Clone ID: PAT_TA_100525
gcacgagggatattccaaattttgggcataaaggccacagggtttctttcaaggcactaggcaaatcacgaatagctcgccccttgtgctatatttatagcaggttgtacccggcatatattgtgagatttgatctggtagagacgaaggaccgagatagtctggtcttacctacatatatgagtcgttattgaggactgagcatcgagcgtgattccgtttccagtccatgtagattaggcattggacgacttagctagaaactttataggtttttagtttatatatcagttatgttgtcatgatttgctttttatgaaccttgataatactatcctggatttgtgacaacagtctacagatttttccctttattttttatcattgtgaagaacaaatctacaaaattcaaccagttgtgaactcatcaagtacgagatctctgtctaatatcatttctgtaggtcgaacctgaaaggatgccagccgattgcttttccaaaactgaagtttcatgtcttgaaactttccccatttttcttttcagnnnacaaaggacatccggattagttagcttctttttacagttcctat

SEQ ID NO: 100526 - DNA, 391 bp, Triticum aestivum
  unsure (1)..(391): unsure at all n locations
  Clone ID: PAT_TA_100526
ctgaaatggccagagcagctaacaagtacggcaatacaccagcaagattggttgtactttataacaaggttgacatgctacgagtattgctagaacatgattgttctttagggtatgaagtgagcacaaaaggtttttccctgcttcatgctgccgcatatcgaggtcatattgatgttgctagagagattcttaaacattgtcctgatgctccttattgtcaagtagataaccaagatggtttgacactcctacatacaactataaccaacaatcatgcagagtttgctgactttatcctgnnnacaccgcaacttcgcaaagtcattaacatgcangnnnacnannnaaaaccccctctacattatgcagtcnnnngntgcaatnntaa

SEQ ID NO: 100527 - DNA, 590 bp, Triticum aestivum
  unsure (1)..(590): unsure at all n locations
  Clone ID: PAT_TA_100527
gcacgaggctctcacaccgcacatccgtcagtccgtcgctccacccttccgccgccgtcgcctcctcctcctccactgctctcctcgggctcggaccagagcgcgctagggcccactcggcgagggagcagcggccttccccatcccttcttcccctccggagagagtggcgccgccaccaggagaccacgaccccgaggccggccatggcgactagttccggcagccggtaaacctggggtcgggtcgggacgatgacaagcatctcaggggaatggattggtgacgctgttgtttgaacggtaggcgtggagctctgttgcgcgtgcaattggaatatcaagcaaggcggtacttgtaactttgagttctcgtggcgatggatggtggtacctctagcaagagacgagtagaagccccgggacaggaggagagcagctgcaagaggcagaatgtcaccatggggatggacgccctcgactgccccgtctgctttcatcccctccgacctccgatataccagtgttctgtggggcatttcatatgctcttcttgccgtcccaagctcgtgcgcaacaattgtcactnan

SEQ ID NO: 100528 - DNA, 220 bp, Triticum aestivum
  Clone ID: PAT_TA_100528
gcacgagggttccgcttcacgtcttggctacaccgcgggcgcaggcatcgtgcaatcacgacgtgtagttcggaattcatattgtgctcctccaaatggttctagcaatttgaaggctcatttctttaacaatactttttgtattaatatcaagaagatataagtatgcttgtcctcttcatcaatgcaatgtcatatatataccgataaaaaaaaaaaa

SEQ ID NO: 100529 - DNA, 321 bp, Triticum aestivum
  Clone ID: PAT_TA_100529
gcacgagggtcagtttcgctcggaggcaacgatgacttccggagagctacaagaagagagagacgcattggactgcaccgcgaaggagacagggacgagcggcaggccggcgaccagctgcgcatctctcttcttcgttgctgattcctgcccaggatttgcaaccaggatgttgtgcgcagttttcttctctcattgcgcgtcggacaacgacacgacattcggcatgtttttccgggatccgaatgaaagacttgtgctactgccatgctctgtgacagagcgtttccccaagcactttgctagtgactttctgaactt

SEQ ID NO: 100530 - DNA, 646 bp, Triticum aestivum
  unsure (1)..(646): unsure at all n locations
  Clone ID: PAT_TA_100530
cccccttgctccgctggaagaaagaaccattcttgatccagattccgcacgcccgcgcgcctccgccccgatcgcccgcccgcagaaaccctaggacggaccccgccgcgccgaattcgatcgctttgatcccgggaattcgcggcgcggcgtggtgggggacggcgagggcgggggcgaatcggatggtgtaggggcgggttgaggggggaagctgcgttcttcgctgcggcggcggcggcggccggccggccatgcatctctcgctgtggaagccgctgtcgcagtgcgcggcgatgctcatggacaagcgccaccgcccgccgcgcccgccggcggcgggcgccggggccgggtccggcggcgggcggcggctgcaggagagcaagctgcgggaggcgctggaggaggcctccgaggacgggtgcctcaccaagtcccgcgacgcggcgctgctcgacgacggggacggcggggaggacggggccggctccggctccggctccgtcagccggacgcggtcgctggcgcgcctcaacgcgcagcgcgagttcctgcgcgccacgnccgtggccgcggagcgcgccttcctgtcanccggcgcgctcccggcgctggccgacgcgctcgccacgnnnnnnnnnnn

SEQ ID NO: 100531 - DNA, 637 bp, Triticum aestivum
  unsure (1)..(637): unsure at all n locations
  Clone ID: PAT_TA_100531
gcacgaggcagatccgctcgtcggcggcccgcgtccccatcgccagcctcccctctgccactccccctcgacgtcggtctctctgcctctccctctcgacgtcgccggcctcttccaccacccgtcctccagtcacagtctgtatgcgccactgaaaaatttgatttttttccgccggtgacgagcttctatgcggtggaggcgcgcgggcgctcgatctacgtgcgccggtggatccacccctccctagctcctacctccacccctacagaaggcgaagaagactcggcccagctccctcctctcccggatccccaggcccagcacgacgtcgccggcggccccgccggcgctcgggcgcttgaagaggcggaatcggagctgctgctggtggtggaggcccccgggggaggcactgggggaggaggcctccgccgcgtccttgggcgggctgcccatgccgtcagtccgcggcgagcgcagggagccactagtggcgaacaattccgtggcggcggcgccggactacggggactacagggagttcctgtcccattactgcaggttctgaagaatggtgtggannnngaagttgaagnnnaatgccctgagtgtcttggaagctcannnnnnnnnn

SEQ ID NO: 100532 - DNA, 580 bp, Triticum aestivum
  unsure (1)..(580): unsure at all n locations
  Clone ID: PAT_TA_100532
tccgcttcccccttctcccctccccttctccgtagggtttagcggcgggaggagaggtctccggatggcgtcgtccgacgagtggggcgacgacgcggccggcggggagtggaccaccgtcactcgctccggccggcccagccacgccggcgcggccgggcgctcccccaacgccaagcgggccgctccccggccccccaagccggccgcgccgacggtgggcgaggtcggcgaggggctggcggggctcgacgtcgacggcgcgagccggacagggaggctggacaagtacgacataccggtggaggtgagcggcgacggcgcgcccgcgccggcggacgggttcgagcaggccgggctcgcggaggccgtgctccggaacgtggcgaggtgcggctangacaaccccacgccggtgcagcgctactcgatcccgatagtgctgtccgggagggacctcatggcgtgcgcgcagnccgggtccgggaagacggccgcgttctgcctcccggtggtcagcgggctggtgtcggcggcggagggagggcaaggaggcgannncggtcgcggcgacagggat

SEQ ID NO: 100533 - DNA, 635 bp, Triticum aestivum
  unsure (1)..(635): unsure at all n locations
  Clone ID: PAT_TA_100533
taaggtttcagcccaaggatgttaatactgaagcagcttcaaaagagcgagagcaaagtattcctgatacactgaagtccttctttgtacggtttgttaggctcaatggaattcttttcacaaggactagtttggagacatttgaggaactgtttgatgtggtcatcaacgatctgaaagttctcctctcttctggtccaaatgaagagttccattttggttctgatgctgcagagaacgcattagttattgttcgacttgttgcaatccttatattcacagtgcacaacgtgaaaaaggaaccagataaccagtcatatgctgaaattgtccaacgcagggtccttcttcaaaatgcatttacagctgcttttgagtttgttggacatattctcaaaaggtgctcagagcttcgtgacattgcatcaagtttctatcttccagccattgtggtctacatcgaatggctggcatgccatccggagttagctgctgattcggagatggacgagaagcatgcgaatgctcgatctttcttctggaaccagtgtgtcttgcttatgaataagctcatccttacagaccttgcgtccattgatggtgatgatgatgnnnnntgcnnntttgatatgggc

SEQ ID NO: 100534 - DNA, 461 bp, Triticum aestivum
  unsure (1)..(461): unsure at all n locations
  Clone ID: PAT_TA_100534
aacaattatcagtttcattaaattattaggcaaagatactaaaacaaaaaaccaacctccttttaggcggaaaaaaaaacactaacgggaattgccagcttactaaacataatgaaaactctgtcatgtcatacaaagttaccaattttcattgcccgttcttggctcatgggaatttgaaattagntggcctttccccgctgggggcagcatcatngncttcagcgagggggggcgcaccctccttntaagggcatatgtacctttgaacaaataccttctcgacataactgaaaactgaatagtagtccctgtcgcgatctaacaatccatttgccttgaaaaacttcacaacatnntaccggggcctgagccggccatccaggctataattgaccattgccggccgatgaacgatgtactccggttccaacccgacctcnnnnnnnangaactctgat

SEQ ID NO: 100535 - DNA, 590 bp, Triticum aestivum
  unsure (1)..(590): unsure at all n locations
  Clone ID: PAT_TA_100535
ctcgggcggcgccgctcctcccgccgcagcaggccccctctctccagcttcccctcccctcgccgccgccagacggactcctccgggcgaagcccctacggatccggcggcggcggggacctggcgacccgggctgctttacacgggcgggggctcgtgttctggcggccggcacggcgcttctccgcgcttgctgcgggtgctcggcggcggcttggcgggggtgttggctgcggaggtgggcggcctggaggtgcggggcgtgcacggagtgcggggcggctcagatcggtcgcggcgccggcatgctctcctctgccccggatctggacggggggcctggcccaaggcgcgcggcgggctggtcacggctccttcggtctctcgtgcggcatgaggtgtcggccgatgctggttctgctgccgatggctgatgtctcggggcttcatgcgcagttccgcccagatctcgctgtctctggcggctctgctcgtttgtgaaggtcnnnacgaggtggcggtggctgttcaggaacgaagtgcttggccgaggtgggttgcagtgggtggtggnnngtgctnnnnntgta

SEQ ID NO: 100536 - DNA, 626 bp, Triticum aestivum
  unsure (1)..(626): unsure at all n locations
  Clone ID: PAT_TA_100536
gcacgaggctgagccgagccgtgctgtgagggtggggggcaaggcaaaccattcaatccgttccagtcttcccatcctctgctcaggccgaggcctccgtctcccctgcctcgcttcctaccatggctgccaggtgggccccgccggccggcctcctcctgctcctgctgctggcggtcctgctgccggcgcgcgcggacaggccggcgaggaccgcccacgcggacgacgacccggaggcctcctccgccgtcttccagctctacggcaacgtctacccccacgggttgtactacgtggccatgagcattggcaacccggcgaaaccatacttccttgacgtcgacaccggcagcgacctcacctggctgcagtgcgacgccccctgcgtcagctgctccaaggtgccacacccgctctacagaccaacaaagaacaagctggtaccgtgtgttgatcagctgtgcacctctctgcacggcggcctcagtaaaaaccacaagtgcgactcaccgaagcagcagtgcgactatgaagttaagtatgccgaccnnngttcatccctttggcgtgctcgtcaacgacagnnnnngcagtccgccttgcgaatgcnnnngttgtccgcc

SEQ ID NO: 100537 - DNA, 439 bp, Triticum aestivum
  unsure (1)..(439): unsure at all n locations
  Clone ID: PAT_TA_100537
aggggccgagggaaacaaatgaagacccaggctgagctcctgaagatgcccgtgattcactgacacgggacgtggtcaaacagcaaagccaggcaggggactgctgtgcagctggcactttcggggcctcccttgaggttgtgtcactgaccctgaatttcaactttgcccaagaccttctagacattgggccttgatttatccatactgacacagaaaggtttgggctaagttgtttcaaaggaatttctgactccttcgatctgtgagatttggtgtctgaattaatgaatgatttcagctaaagatgacacttattttggaaaactaaaggcgaccaatgaacaactgcagttccatgaatggctgcattatcttggggtctgggcactgtgaaggtcactgccagggtccgtgtcntcnnnnagcttcaagccgt

SEQ ID NO: 100538 - DNA, 626 bp, Triticum aestivum
  unsure (1)..(626): unsure at all n locations
  Clone ID: PAT_TA_100538
gcacgaggctaatgcttcatcttcttcttgtccacttgtcctaactagctagcttggagccttggattcatggagtccccgcagaacaaggctggattcatggacggcagcgagaagacgcctcttcctcatctgctgccggtgaccgtggcaaagaagacgcctcgtccggatgttgtccgagaggtcagcgagtgggtgctcgtgaccgccttctccttcgccttcgccttcgtgttctccttcggcttggcctacgcactcgagctcttccacgtccagtgcagccagtcctctttctttcttcggtgcggtctgctgacggacgcggaggaagctgtgatgaacgccctagggatcgggatgctgtgctgcgtcgcgctccaggcggccgcagcggcgttggcgctgcgtctccagtgccgccgtcgctgggtccgccgtgccctcgcctacctcgcgctcgcgctcaccatcggcggccactgcttctacgccgcgctagcccgcctcttcctcgtcgccgacncnnnagncctcttcttcnnnntctgctcaaccgtgggcatcttcgtctacgcggcgggagacatcatcagcttcctggcnnnnntgctcanncgcnn

SEQ ID NO: 100539 - DNA, 563 bp, Triticum aestivum
  unsure (1)..(563): unsure at all n locations
  Clone ID: PAT_TA_100539
caacggcggcacccgcacccaaaccgccccgccaccgcccgcatctcgatcgcctccccggtccccgcggccgcgtcgctctcgccgcccaatcggctcaccaccgccggccctagcatccagctcgatcgagcgcgcgccgttcggggctcccggatcgcctccgcccctcgctgccacgattccggcgcgcgggggcggcccgtccaatcgacgggtccccgagggccgagggcgcctcgccgcgtgccccggtggtggtatctagggccgagggcggaaagctcccggcttggcgagcggggcgtcccggttctccggcggttcgtccatggcggagaggcggtccggctacagggactgggacagggcggcggccgaggccggcaggtgctggaggcctccgcgttcccaggctcacggtggtggaaatgtgtctgttccactatgggagaagaaattttgcattgatgcttgttctataccctnnngtaagctatgtgaggccangaaactgatgtcattgtacacgaatattgttgactgggatgattcnnnngcat

SEQ ID NO: 100540 - DNA, 602 bp, Triticum aestivum
  unsure (1)..(602): unsure at all n locations
  Clone ID: PAT_TA_100540
gcacgaggcaacaacaacaacacacagttggggcgcacgcgaaaaccgaggtgaggcgatcgcgccgcccccgctgagctacacaatcttccgctgggccggcggctcggtgtcgtctctcctgcgaccgaccgcggcacggaatggcgtcgccgccgccggaggtcgccgtgccggttgacgaggaggaccgggagacggagggagaggatatctgcgcgttcgacatacccggcaagaacgccccgcgcgatcgcctgcgccggtggaggcaaattgctctcgtgctcaacgcttcacgtcgttttagatatactctagatctcgcgagggatgaagagagagaaaacttgagaagaattatacgagctcatgcacaagttatacgggcagtattccttttcaaaaacgctggtcaaaaggcgctacaagaatcttacgatggtacaaaatttgagtcactctctcagagatttccaattgatctggaaaagcttgtaatgttgaacagagaccatgaggcaattatgcttcannnngttggaggggtcagtgggctttcggatttactaaagagtaatttagncagnnnngttagctcn

SEQ ID NO: 100541 - DNA, 549 bp, Triticum aestivum
  unsure (1)..(549): unsure at all n locations
  Clone ID: PAT_TA_100541
ctccgcccccctcccctcccccaaaacgccaaaacccaaaccccacccggcgaggaagcggcgcaatgctggaggcggcgatccccgcgctgtggagcaccgtccacggctggttcaccccgtgggtgctcttcctcgtgctcaacatcgtcatcggcaccatcgccgtcacctccaaggcctcgcccccggcggggggcggggaaggcgccgcggccgcggccggcggcgagaggaggagcctgtcccgcgtgccgtcaatggcgctcgaccggctccgctcgttcaacatgtcccgcttcaccgcccccgccccggaggccccggtgagcggggtgctggatctggggtctgacgagcagctgccgccgctcgagatggagccggaggctcagggcgagctggagcacgagcacgtgcacatggaaaggagcatgtccgaggcggcggccgaggccgagctcccgcggctgccggcgcggctccgcaagtcggcaagcgacaagtcggcgttcgcacacttcgtggccgnnnnnnacaccgnnntgg

SEQ ID NO: 100542 - DNA, 550 bp, Triticum aestivum
  unsure (1)..(550): unsure at all n locations
  Clone ID: PAT_TA_100542
gcgctcaccacccaccagcgaatccccccaacccgaagcatcgatggcccccaaggcggagaagaagcccaaggccgagaagcggctgccggcgggcaagaccgcctccaaggagggcggcgagaagaggggccgcaagaagggcaagaagagcgtggagacgtacaagatctacatcttcaaggtgctcaagcaggtccaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcctcgtagattgccatgttcgcatctcagaaactgtagtttgctgccgtgtatctaaaactagtgtttattgctgaatggaaattcgtggaatgctgttagtttttggttcnnnnnnnnnnnnnnnnn

SEQ ID NO: 100543 - DNA, 631 bp, Triticum aestivum
  unsure (1)..(631): unsure at all n locations
  Clone ID: PAT_TA_100543
gcacgagggtctcttcacatcgacaagcacagcatagaagaacttatgagcactaaatggaacaaactgagtgcatcgataaagcggtggaatcgggcaatgaaggcttttgtccgagtctaccttgcgagcgagaggcgccttagcagtcttgtctttggtgacctttcagaaacaactgtagacttgtgcttctatgagatttcatttagctcggtcatgcagcttctgagcttttatgagtctgtagcaattggaccacttaagccggaaaagcttttccggattcttgatatgtatgaggtcttggatgatctgctccctgaagcagagttcttgttccaagcagggggcaatgatatggttttagctgagtatcatgaagtcctacttcagctgggagaatcggcaaggaaaacatttgcagagttcaagtatgccatccaatcctacacgtcatccagtgcagtgcctactggtgcagtgcatcccctcaccaagtatgtcatgaactatataaaggctgtcactgtttacagcaaaactcttgactcactgctcnnnnntgcggatcaacagcctataccaaactcatgcactcatttcacgnnnacagcattgcatctgcann

SEQ ID NO: 100544 - DNA, 351 bp, Triticum aestivum
  unsure (1)..(351): unsure at all n locations
  Clone ID: PAT_TA_100544
aaaaaaattacgggggggccccatttttttttccaaatttaattttttgttttaaccaaaaacccctttggttaaaaaaactttttcgattccaaatttttacaaaatccttatgggggccttttgtaaaaattgggcccagggggtaagggttttaaaggcaaaaaaaaacccttttcaaatttaaaccggtgggccccccagatcagggaaggggcaaaacttccccaccctgtttccagcagggggaataaaggccttaatccaaccccatttttttttcccgggcggggctttgggaggaccaaatttttttattttttttttgggaaacagnnccaattnggggnn

SEQ ID NO: 100545 - DNA, 626 bp, Triticum aestivum
  unsure (1)..(626): unsure at all n locations
  Clone ID: PAT_TA_100545
ctcaaggccgtcgccggtgggatcctgcgtccctccgccatcttcctggtcaagtgacgccagggccgaccccgccgcgttcctctactcctctcgcctcaagcacctgccgcttaacaccaccttcgtcttctgctgctgcttcaccgatgagcacaggccgccgccgcgttgctttgccttcgcctcccggcttcgtccgcgagaacggttacagccacttgggttcgacaagttgccgagtaccactgcatttaccatgtacatctacaccgagacgagaccgccaagatgcatcctgacgtcgccgaagacacgtgaacatctacacgacgaaccgagaacaactaccgtggacgtgcattttgccaagtaccactaccgccgtcgcaagaacgggagcggaaagtccgaagaccctaagtaccacgacaccgatgacatgaacatctacggaatgtgtacgactacgcgatgtgacgccaagttcgatgacgaccgtgtacccctaccgctcctcgaacatgaacgtctacttcctcttcgactcgtgaacgtctacttccactacttccactacgaacgtcccgannangtctacttcctctacttggcaccgatcgnnn

SEQ ID NO: 100546 - DNA, 261 bp, Triticum aestivum
  unsure (1)..(261): unsure at all n locations
  Clone ID: PAT_TA_100546
ggccctcccttgnggaacanntattccgccctaaacccccaaaggggtacaacaacatgaaccgggcgggggaaaaagaaccccatggcatgacaaaaccccacccaacacacccgggcctggtcacgggcccgggcaccaaaaaaaaacggcgggcaaacctaaaccggccacttaaacgccaaaaaaaanntaaaacgggactggcccaagtcacgggcacccctcttttccttggaccaataaaattttttannnttg

SEQ ID NO: 100547 - DNA, 601 bp, Triticum aestivum
  unsure (1)..(601): unsure at all n locations
  Clone ID: PAT_TA_100547
gcacgaggacccgccgccactcttctcaccatctacatcgcgatcttgcccgatccaccaaccagcgccagccactgctctcaattgacccatcccaccaaccagagcaaccatcgatccacctcgtccttgcgcccgagacccaagatgaaccgagctcctcctccaaccagaacgagcgccaccgccgccgtttggagcgccgccgtaccggagatgagtgcctcgcgcccatctcttctccttccttcaattcttcttcccactcgcttacatctctctccctctgtcttcttgtacagggagctcccacgcctcgaagttgcagcgccgccgtcgagtcgccatggcctcggactcttgctgtcctgtccacgccttgccggagaggctccgccttagccaagccccgcttccgctgctgcttcgctggagagttccgccgcgccaagttccactgcttccccttcgaacctcgctgccgaagcctcaagatcttgctgccaagccctcccgtagcgccatggcctcgttgagttctgcctgccccggtgcctcaagccgcnacagctcgctccnnntncggnngncctccgccann

SEQ ID NO: 100548 - DNA, 609 bp, Triticum aestivum
  unsure (1)..(609): unsure at all n locations
  Clone ID: PAT_TA_100548
gcacgaggaaacgcccgattccaattccagatcgcggtcgccatggccctccgcggctggtcgcacttcgcgccggatctcctcgtgaccgtctccggcgacctcacggagctcgcggacatcgcccgcttccgctccgtctgcaccacctggcgcgacgcgggggtggatgccgcggccgcgcctccgtcgcagcccccgtggctcgtcctcccgtcctccccgtcgccgctcttcttcaacccctcggaggaccgcctctaccgcaacatccgtctgtccgtccccgccgcggacgcccaccgacgccgccgccgccgccgcctctcggcgtccccgcacggctggatcctcgccgtcgaccccaccgatctcgccgcgtccctcctccaccccttcaccggctccgttcgccccctcccgccgctccccgccttcttcgcggagacggatgacctggcctgggacctgtccccgcacagcctcatggcgtcctgcggcgnnnncgtcctggtctgcgccctcgnnnctctcgctgactcnnnnnncccggtccccgccatgcccgactnnnacgtgagcagcatcaactacgccggcggcgatttc

SEQ ID NO: 100549 - DNA, 602 bp, Triticum aestivum
  unsure (1)..(602): unsure at all n locations
  Clone ID: PAT_TA_100549
gcacgagggcgcccgcgaggccacattcctgcccttgcaatcgcacccggaccggactctcggggacgacggcgccgcgccggagaggaaggggctgaggtgctgctcctccaacgcggcaacggtgggcgccaaggagcgcagccacccctccggcgacacggccgcgtccattcgaccgcccgccgtcgcggcgggcccgtgccgcatggtcgcccgcttcccagtctccctccgctggtttggcggcctactgcgggctagcagcagccgccgccgccgcggcgtatccgtgatggccggaggaggcgaagaggcgcagctcggggggttcctcgagtacatggacatgctccgcaactacgagcgttccggcgtgccgcgcggcgccgggaccgactccgacgacggcttcgacctcggccgcatgcgccgcctcctccgccgcctcggcgacccccacacccactacccgtctgtccatatcgccggcaccaaggggaaaggttcgactgccgcgttcctgtctaatatcatgagggagcaaggatacaatgtgggctnnnattccagtccacaccttctaacaatccgagagcgnn

SEQ ID NO: 100550 - DNA, 569 bp, Triticum aestivum
  unsure (1)..(569): unsure at all n locations
  Clone ID: PAT_TA_100550
gcacgaggaagagtttcgtccccaatctcttccccctctctcggacccgtcgcgccgccggcgagagagagatccccgccgaaattccgggagagacccccgccgcgatgccgagaaggtggcaggtctggggccggcccgacggcagccaagtctggatccccgcccccgaccccgacgcgccgccaccgccgcccgccgcggccccgcctcctccgccggggcgcgcggcggggacagccgccgcttcactcgaggacgcgccggtcaaaggccggggcgctgctgacggatgccgcgtcgagtccatggccgacctcctcgtccaagctcggaacaagctactcgaaggtgatgggatggccggagcaaccgtcgatgctggaaaaggtgagctgttctgcactgcatcgggaagaccggtgtctgtcagtgagagagctataaggagggccagggcgttggtcggggaggaggtggagaaggctggcattaagagaaagcaatcatttggcgatgtatctgatgtagagggcgaattgagagnnntggacgccccatttagnnna

SEQ ID NO: 100551 - DNA, 454 bp, Triticum aestivum
  unsure (1)..(454): unsure at all n locations
  Clone ID: PAT_TA_100551
gcacgaggacgagcggccctccgtcacacgggcgttgagcggctgcagcccggcaagacggagcagattccagtaactctgactagctagctgcatcctgtccacgactccatggtagcaacttgaagaagatttgctcaagtagtacagtagcttagtagtattccctccgttcgcttttataagtcgtttcagacagctgaaaatgaactgatttgcatgttgtctgaaatgtcttcaaggacttataaaagtgaacagagggagtagtagtaataataagttgctgtagtcctatgtttatgtcaactgtcgtcgtgagtttatgtctgattatgactgcaccggatatgcatgcttgggattatgtatgtgtgtgtgtgagggtttgtgagactgtgagtaggagtagctagtacgactgtttaaggttgataaattttgcatgnnnnnn

SEQ ID NO: 100552 - DNA, 622 bp, Triticum aestivum
  unsure (1)..(622): unsure at all n locations
  Clone ID: PAT_TA_100552
ctgggtagcagagcagcaggatctgggtggcctcgggcttgccggcatctgccgcgaggtcacccgagtcctctgcgccaccatcttcaattcctcctgcttaggtcccatgctgctctccctcatcttgccctgcgccaatgacgtccttagctcccgcgtcgactccaaccaagacagcctcctccgcctcgccgcgtactgggccgctttacttctcttcaagctcctctactttggtctctgctacgtgttcacgctcttctgcacctgcgcctacgtgttcctagtcgcttctctctattgcaccggcggcgatttcgccgccgccaatcacggccgccacgccctcccagtcgacccgtccaggcggcttaatcgcaccttcttcttcctcgcaatccctctactgatcacattctacgccggcgcccaagcctggatcgcgctccagcagctggacgctccgggcgtggtcaccctgccgctgcagctcatgggcgnnnccgcgtgccttgccggcgccgcgtacgccgnngtcgtctgccagctggcctgcgtggtctccctcctcgnnnacgcctggcttctcaccgccatacgcnnnnnccgcgcgctcctc

SEQ ID NO: 100553 - DNA, 557 bp, Triticum aestivum
  unsure (1)..(557): unsure at all n locations
  Clone ID: PAT_TA_100553
tggagaacccggagggaggtagtggtaacataattcgtcgttctgggcagcgcgtcggtccatagccaaagccatacttgtactgtacgtacgtgagcgagagccgagagaatttgcattgacgtgtctgtgctcgccgctcgatgcggctataaccacccacccagctcgtccgtttcacttcgccgctcaagctacactggtgcacgtgctcggcgccgcgccgccatgggcttcagcttcctccccgtgatggagtacctctcacgccgcgccttccacgccgccggcctctgcccccacaccgtcaccctcccctgcgaccccggcgaaggcagcgggacccaaacgatccactactgggctccggcgccggcgggggagccgcgcctgccgccgctcctcctcatccacggcttcgggcccatggcgacctggcagtggcgccgccaggtgggcgccttctcccgccgcttccacgtcgtcgtcccggacctgctctnnnnnnnncgtctccgccccctgcccctcctccccggcgccctnnnnnnnnnnnn

SEQ ID NO: 100554 - DNA, 547 bp, Triticum aestivum
  unsure (1)..(547): unsure at all n locations
  Clone ID: PAT_TA_100554
gcacgagggttgttcgttacggttgttcttatgttcttgaatcacccatcttatgagcagagatggggtgatacattatggttgttctgatggttgcttatttagtgttctttccaattgggttcttcttgtcatgctttgcttatgttcccaatgtctgtctttccatatatggggatgcgttcaggggtgcaaactgtgtaggccatggtgctttttatactagctatggtgtgttttatactatctgatgtggaaagtggaattattgatatcacttctgtgttagtatacttggtatggtgtgttttatttaagtaattaaccacatctcttacaaattttccttgagttacatgtttatatggcaggagtgattgtcttgacgaataatcatttatgctaacttggtattggcagttcctgatcgtaggtacagacatgtggatctggacatttcacatttgttctttattgtcttgctaaggacactgaacggtttgtctgggccaccgcacagcctnnnnngtagtgattnnngagaagc

SEQ ID NO: 100555 - DNA, 620 bp, Triticum aestivum
  unsure (1)..(620): unsure at all n locations
  Clone ID: PAT_TA_100555
gcacgagggatgccaagagggccaagaagaagcttcatgctgctgcagctgctgccgccggcgatgtctctgcttccgatttggcgaatgataaggttttggtggaggagacaaagaaggagctctcaaggattcaggccgagctatcatcgacgaatcggaacctcaacttctcggatcaacagattgaggccatctcaacaaagctcccactagacaagtctgacctcaagacattcttcccaaaggcatggtgtgaccagaacggggaaggcgtgatcgacgccgcgcaaaaggagttcaaggggcacgtcgaggagatggagaagcagaggggggaggaggacatcgccggcggtgacgagggctgggcggctgcttttgatgaggacaacttcaaccccagggccttctcagatgccaaggggaagaaagttcaagagagccttgacagtgaacatttcaccaaccctttctatgatgagaagaagaacagcaacccattcgggagccaaagctacaactgatcagcctgttgcgtgagnnngcagcgtgtcttgtatcttcttgctaatatgtgttgtagtacttgcgatggttcaattgttatattggacctg

SEQ ID NO: 100556 - DNA, 498 bp, Triticum aestivum
  unsure (1)..(498): unsure at all n locations
  Clone ID: PAT_TA_100556
gcacgcggaggcacgccggcggccgccgccgtccgtccacgcgcggcaccacttcctatggcccggcgtctgctccacctccggccccgcctccaggcgctcgccccccgcctcgtcccttcgcggcagtacatgtccgacatgcgccgctccgtcttcctcgaccgcctcctccgctccctccgctccgagatctcctcctgccgcgccgagcccgccccgcggccgccgccctccgccgcgccgttcgccctcgacgaccgtcccggcgagcagtgggtccgcctccgccgcgcgttcggggagcagcaggaggaggaggtcagggtggatgcctcgatggtcgacggcgccgtggcgcccacccgctcgggcgtggccgcggaagacggcgggccacaggacaggatgcacattagcgtccacgntcgaggtctccaagcccgcgcggcctgactttgnnctnngtttcgagtgctctgcctnncnnnnggagnt

SEQ ID NO: 100557 - DNA, 610 bp, Triticum aestivum
  unsure (1)..(610): unsure at all n locations
  Clone ID: PAT_TA_100557
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaagtgatnaacgaggtggaggaggtcaaagaaggagtaacctgacgcgtacgtccgcatcatccgattcgacaacatgcgccaagtgcagtgggtcagcttcaattgccttaaancaacggggctgcgaagantccgggaaaggctaaacaagtcaacnaacaacgggccanatataaagtgcaantgcan

SEQ ID NO: 100558 - DNA, 555 bp, Triticum aestivum
  unsure (1)..(555): unsure at all n locations
  Clone ID: PAT_TA_100558
caagatccgcaaaaagcagagaggaacaactccaccggcgatggcgatggcgatggcggccctaagacgcgaggggcggngtgtcctcctcaacaccccctccccggcaaccaccatggctgcgctctcccgggctgcctcccagtcattgctccgcttggtgcacggtcnatntcaacacaaattgtgagggaaccgcaagaaaagtgtcaaagaacatccaaaaagattaccaaagcaattgaaattggtgcaacaatcaaaagcttcctngtgtttaaaacaaagaaatggagaattcaactgggccaatnggaagcattcaaaantnttccctggggaatctnccaatccaaanaaaanaagcaagtttgtncaantnaggaaaaaagggaaanntnaaatcaacccttantccnnggaacaaattttaatggcagtttcntagttncaaaaaaaaccnttcaantntacanaaggtgctgtgttnggaaattatatcccttaaaaantttntaaattattgccntaaaaaatgttttttaaaaaattaaa

SEQ ID NO: 100559 - DNA, 623 bp, Triticum aestivum
  unsure (1)..(623): unsure at all n locations
  Clone ID: PAT_TA_100559
ggagagaactagncggantttttttttttttttttttttttttttttttttgggtttanggangtttctttnactggntcacncactctgcgaaaatggcaccagtctgcttgtttgttnatgatacaggaaattttacaacaancatgaactttttgctttgcttccacttgagctaactttatgtacatgtaagaaagctatgtatcaccaactgctatatatacaacactacagcggtctcaagcctccctgcattttgtatcaggaatgtttgccacgaacccacccgctagtgagaatcacaaaaagttccttaacttgcaaaccgcnagcanccattttattggatgacgcncaaccaacnagcctaanccctcctgaacgttaaaacntctgcggtnacaactggcattngagcaacaaaaaagcaaaaaaccngncctccgggnggtaaaggtaaaattcctggngggaaantccctcaaanggggggtncnaaaaaaaatnggaaaaattnggnttaaaaaatttccccnaaccccggattccttttanaaggaaaaaaaaaanattgccctttcccttttccanttttnctnctncccaaanttccanaaagt

SEQ ID NO: 100560 - DNA, 568 bp, Triticum aestivum
  Clone ID: PAT_TA_100560
ggaacaggggcacctacggcccggccatcaaggccggggaggcaacgttcccggggcaggcgacgccggtcccgcagctcttctgctgcggcgactccaccttccccgggatcggcgtgcccgcggtggccgccagcggggccattgtcgccaacacgctcgtctccgtggcgcagcactcggagctcctcgacgccgtcggcatctgaccggtaactgtgcccagtgcaggacacgttctggtaaagtggcaggcaggcagctgtggagaagaaccatgcaacattttgttcagtggagtataaagatacaagagaaaaagaaagcagcttattgctcggtactgcacatgagaagatttattaatcagcacatgcagaagagacaggcagagttttcttatgtgctccctccgtaacttaatataagatgttttttgacactatgacagtgccaaaaaatgttttatgtttttgatacaataaaaaagagggggtaatttgcaaaaaaaagaaaaaacaatggttgagaatgcaatataaagtgttacaatgctggcttgtaaaaa

SEQ ID NO: 100561 - DNA, 600 bp, Triticum aestivum
  unsure (1)..(600): unsure at all n locations
  Clone ID: PAT_TA_100561
ggagagaactattctcgagttttttttttttttttttttttttttttttttttttttttaaaaaaatgaacgcaaggnaggttccatcaancgccaaagtttcattcaactcataagcagaanacagcatgaattacaaagtcctacagctganangggaagaanagattgcagaanggggcaagaactgttgccatgagtaaaatanntacagtagaaaacaggttttgttcttganttgngaacctgangagcacaattatgggcaatgccattagtattcctgnanatatggaaggtagacagcatgcatatgnctggnggtatcctgcacaaaattgctgaaaggcgctcagcttctccaagttatactcataatataaatatgaaatcccaaatacaccaccgtgatatatctttggcgctaggtgcaacaaggntnatcctccagaggatntgagcaaaacaaaggtccaaggcaataagcttggcagttcaaaatgtacaaattatcnattggcgtccccctctcncaanaagcctacacgagtaacccaaaattccctaagggccttaggggacanaagggnngggctaatg

SEQ ID NO: 100562 - DNA, 609 bp, Triticum aestivum
  unsure (1)..(609): unsure at all n locations
  Clone ID: PAT_TA_100562
gattccctcagccgccgncactcctatccttctctgccgctccacaccaagcaccggngacagcacagaaccanccttacctctcccgatccaccactccgtgcccgcctccatccatcatctgtcctcttccttctccgtgtccggtgaacaagcacggcgagctccgaaggtcacctcctacgacccngaggcncgcgtgggtggggctcctganatccgtggtagtgtcgaccaagacggcaacgacggcggcgtccgcgaagatgcgaaatncgtcatcacgggggcgtccgcgaagatncgaaatncatggtggtggcgtgccnaagtgaggtacatgatgtggcgacancgccacaaattcaaagtataagccttgtgggctgggtcaattatccgtntaccaacgccgccgtcgggggccctcntcnttgcgggagtcctccccatccgtgggngaaaaancccccaaccccccgctattcacttttctcccggccgggnaaaaacaaatttgtttaatccncantcgtcccntaaacctcccccccccttttgnttaaacnccaatggganggatttttcccgtttnttggtaaagggang

SEQ ID NO: 100563 - DNA, 395 bp, Triticum aestivum
  unsure (1)..(395): unsure at all n locations
  Clone ID: PAT_TA_100563
gtccagatctactccactgccgcctccaatggcgtctccagcaggaaaccctaatccgaaccccggcaaccccaatccccccttcgagatgtccatgctcttcaggccgcctcccaaccccgcgccgaccgccgcgcccatgttccccggcgccgccggcccgccgccgcactccggcccctactcctacccccccgccacccctcccttccaactccgcccctacctccaataacccgcaagattcccaagccccccatgcccccgacggtcatcccttccccatgcccaaacccgnaacgcgaaccccnacccngggcngctaaaacccattgggcggccggggggcccaaacccccgggggcccgcctcaatgcaagcttgtncgggaagct

SEQ ID NO: 100564 - DNA, 579 bp, Triticum aestivum
  unsure (1)..(579): unsure at all n locations
  Clone ID: PAT_TA_100564
gattatatgggaatgtaagttcatggcaattagaatcttgggaagtacaactaatgagcactcgcgcaatgcatttcatgcatatgcccggcacaattatgtggctatctatgtgaaatacaacatcaagtgcctggggactcatgtttgttaaattatttgcttangtgtaatgcatgttgcgggttagttataaagttaagactaacaacttgggttgggcataagcaatgcaagtattgttagcaagataacaaaccttcaagattgggttaagccaatgccaataataccttttttttaagaagaaaagggagggagaaccccaacttccgcaacaattggtggggcaaaaaaccaaagtngcaaaaacctgccggtnaatttaataaaaccgggggaaggtttccaattcaaaaagacaacaatgccaaatnttaaaaagggaaaaatgggggaattggttaataaacaagcaantgaagttaaatgttcnattttagtttaataaagnccnaagcaagggtccccctcctcctgggcanaatcntantttcccaaatnagattccaaaaaagg

SEQ ID NO: 100565 - DNA, 650 bp, Triticum aestivum
  unsure (1)..(650): unsure at all n locations
  Clone ID: PAT_TA_100565
ccgccccaatcttcttcttcttcttcttcttcttcttcttcttctctccttgcttgaaacacaggcaacggatggatggaggcctctccttgcctttgcccttcttcatcacaagaaggcaaaaggatggttcatggatggatggaggcctctcttctcttcaagacaagaaggnaaaaggaggattcatggatggatggacggncaccatgacacgattcgggcacctcctccttggatntacaatttttttttctttcggagcaaaagtcgcccttggatctgcaaagtttttggggcaaagtccgtccatggtgtgctactcaacaagccccgtcaaggattcgccaanggctccctaaccaatggcgggagaacnaactcaagttccctccttcctttctttccttccaaagaaggaaaggaaaatgggcaatgggccaancaacaatttcgcccggccgaacaaaggcaaagcaacaattttcgcccggccgaaaggcccaaagcgttccccgggacgaacaaaagggccaaanaacaaatttcgccccggcngaacnaaangggccaaaaaacaaatttcgncccaaccgaacaaaggggccaanaaacaaatttcgcccaaccgaacaaaagggccaagggtt

SEQ ID NO: 100566 - DNA, 616 bp, Triticum aestivum
  unsure (1)..(616): unsure at all n locations
  Clone ID: PAT_TA_100566
agctacgacttcaaaacacataagagcatctcatgtgcaagaaaggttaatccttcagatgtaataattttggaaggaattctacttttccatgattcacgtgtccgggatctaatgaacatgaagatcttcgttgatacagatgctgatgtgcgattaacaaggaggatccgtcgtgataccattgagaagggtagagatattatagctgtgttagatcagtactcgaagtttgtaaagacagcttttgaagacttcattctccccacaaagaagtatgctgatattatcatcccacgaggcgcagataacagtgtggcaattgacctaatcgttcagcatattcgcactaaacttggtcaaaatgatctatgtaaaatacacccaaatttatatgttattcagactacttaccagatacgaggcatgcacacaataatacgagatgctgccactacgacacacgaattcatattttaagcctgatcggttaantcnatngggttgtcnagcatgggccttgggtcatctcccttcaagggaaaaagcaagtcaattactccaactgggntntggttaaaccgggggtggntttcccaaaaaagtttatgtgggg

SEQ ID NO: 100567 - DNA, 580 bp, Triticum aestivum
  unsure (1)..(580): unsure at all n locations
  Clone ID: PAT_TA_100567
gctcctctcctccagataatacattaccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggccgatactggacaatgtggaagctgcctatgttcgggtgcactgacgccacacaggtgctgaacgaggtggaggaggtcaagaaggagtancctgacgcctaagtccgtgtcatcggcttcgaaaacctgcgccaagtggaagtgcgttagctttaacccccttaaggcaaccgggnttccaaggagtcccggaaaggcctaactaacaagttgaaaaaatgggct

SEQ ID NO: 100568 - DNA, 604 bp, Triticum aestivum
  unsure (1)..(604): unsure at all n locations
  Clone ID: PAT_TA_100568
gcatcgctgatcaccaagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaagggcaacaggttcacagtcatggcagcggaaaacatcgacgagaagaggaacacagacaagtggaagggtcttgcctacgatatctccgacgaccaagcaggacatcaccaagagggaagggcatcgtggactccctcttccaggcgcccacgggcgacggcacccacgagggcgtcctcaagctcctacgagtacgtcagccaaggactcaagaagtacgacttcgacaacancatgggaagnttctacatcgcctctgctttcatggacaagcttgtttgtccatctctccaaagaacttcatgaccctgcccaacatcaaagattccactcatcntggggtatctggggaagnaagggtcaaaggaaatcccttcaatgtgagcntttcctcccccaaanatngggaatnaac

SEQ ID NO: 100569 - DNA, 639 bp, Triticum aestivum
  unsure (1)..(639): unsure at all n locations
  Clone ID: PAT_TA_100569
cttcattcccctcgactcgacaccatcgtctccctcccctagattgtttcatcaattgttgctagttgtaggctatagctaggtggaccatttcactccagctacagcactgtcttctttatctatcctctagtgatcgctgtgtgtgtgagattcacccatccaccatcgaccatgagcatctccgtgaacgggcattcggtggtgccgccggggttccggttccaccccacggaggaggagctgctcacctactacctcgccaagaaggtggcgtcccagcccatcgacctcgacgtcatccccgacgtcgacctcaacaagctcgaagccatgggacatccaagagcgctgccggattgggcacaagccccgcaaaacgactggtacctgttcagccacaaaggacaagaaatactcgacgggggacgcgcaacaaaccgcggcaacggccgcccgggttctggnaaggcaaccgggccgggacaanggcaatctactctgccggccgggtcccggccgnatcggnaatgngcnaagacgcttcgtcctnctanaaggggccgtggcccaaaatgggccnnaagttctgacnggttatgcatgantaccgcctttaanaaccccntcccccctngg

SEQ ID NO: 100570 - DNA, 377 bp, Triticum aestivum
  Clone ID: PAT_TA_100570
gccctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcgaacctgttgctggggaagacattgccattctgaattaatttgaaaaaaatgtgtttttacctaaa

SEQ ID NO: 100571 - DNA, 626 bp, Triticum aestivum
  unsure (1)..(626): unsure at all n locations
  Clone ID: PAT_TA_100571
ggaggagatgtggagtttatccgggatgtcacctaccgcaatgggatcttcaagttcattgagattgataatttttgcataccagctattgctcgtgatgagacttctaatatcatttccaagacgatgcagcattttgacagcaacgatatcatacatgattcagagctcatctatcctgttttaaagcaagcggaacctattattgtccctgatggttggaaagattcaagtcatattttaggtttccttcacgggactattgggctcaggacccatgctgttcaatgttgatgacatcctcccgagtatgaccaaaagtantggtaagggtggtccccctcaagtgggctttgcnttttgcctgaaaaccccgacaanttgagggnaacctgaaaacaataattggccccgancctttgggcaattcaatgggtgacaagtggttgtcctaccnttttaagcaaaaagggtgaaaancctggaaagaattacaaagacaatngggattggntggggtggttggacaattgaaaaaagaaaaaattgttggagacctaaattcaaacaatataccttatgccgggaanggngggctaatgccnctaaccaaangttgccttccc

SEQ ID NO: 100572 - DNA, 630 bp, Triticum aestivum
  unsure (1)..(630): unsure at all n locations
  Clone ID: PAT_TA_100572
caagccccccatccgatctcgccgggaaatctctccgatcgaagcgaggcgaaggctctctcgtcctcctcctcaagatgcagatcttcgtgaagacccttactggcaagaccatcacccttgaggttgagtcctctgacaccatcgacaatgtcaaggcaaagatacaggacaaggagggnatccccccggaccaagcaagcgtctcatctttgctggnaagcaagctcgaggatggccgcacccttgcggactacaacatccaagaagggagtccaacctccacctggttntcangctccgtggtggtatgcaaatatttgtcaagaacctcactgggaaaaacatcaacctggagggtgagtcctccggacaccaattacaatntgaaaggcaaaattcaagaacaangngggttttccaacggggttaacaacgtctcaatcttttccgggaaagnaaacnttganggatgggcgcaacccttcaagactnanaaaaatncaanaaaggggnccacnccncccacnttggggctcaaagncncccttgggggggaatnnaaattttttttccaaaaaaccccaaaaagggnaaaacaatnacccttgggggttggnntccccggna

SEQ ID NO: 100573 - DNA, 419 bp, Triticum aestivum
  unsure (1)..(419): unsure at all n locations
  Clone ID: PAT_TA_100573
gctccaatccaatccccacagaaatccccatctcaaaaccctatcccgtccgatcccggcgagatggtancccnagggtgttcttcgacatgaccgtcggcggcgcgccggccgggcgcatcgtgatggagctgtacaaggacgcggtgccgcnggacngtggagaacttccgcgcgctctgcaccggcgaaaagggcgtcggcaagagcggnaagccactgcactacaaaggggcagctcgtttcaaccgcgttgatnccccgactttatgttgccaagggcgggggacttcaccaaaggggcaaacnggnaaccggggggngaagtccaatcttacggggaagaaagnttcgnccgaccaaaaaantncttccaaaaaggnanaaccaaagcccgggggattcttccccaatggggc

SEQ ID NO: 100574 - DNA, 527 bp, Triticum aestivum
  unsure (1)..(527): unsure at all n locations
  Clone ID: PAT_TA_100574
gcctctttctcctcccccctctcctcctcatcttcccacctccttcgtcaaaccccagggccaagcaaccgccgccgccgccccgccccgcccntcccccgccgaatccgccgcgcccgcgctcccccggcccgccccccgcgccgatccgccggaatccgtcgcaaaggnggcgcctttccaagctctcccccgatgtacagcaacttcaaggagcaagggattgagtacgtgaagcaagccgtccaaagaggacaatgccgggaantacgtcaaggngttcccgctctacatgaacgcgctcgagtacttcaagacccacctcaaagtacgagaagaancccaaagattnaaggaggncatcancgccaaagttcaacganttaccttccgccgcgccngaangaaatttggggccgttctncaaaaagggnggggggggggggccccccgggggcgnccaaaggggggggaaaccgccgtngccaaccggggncaaaaacaaangggaaagganggggggaggg

SEQ ID NO: 100575 - DNA, 333 bp, Triticum aestivum
  unsure (1)..(333): unsure at all n locations
  Clone ID: PAT_TA_100575
gtcattcatcgctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagaagctccaaggncaacaagttcaaaatcatggnaacgggaaaaatcnacnaagaaaanggaaaaaagacaaagtgggaangggtcctgnctaacatntttcccaccaacaagaaggcatnaacaaaaggaanggnancctgggatccccc

SEQ ID NO: 100576 - DNA, 614 bp, Triticum aestivum
  unsure (1)..(614): unsure at all n locations
  Clone ID: PAT_TA_100576
gagttttttttttttttttttttttttttttttttttttttttttggggncccgcaaccaagacaaaaaaaacattacgactattcctctatttccagtacaagattagacctttttccatcctctanagtcagtttaccattgatgcanatctttgngcgcctcttattaatccttctaacagcagctaaacatacaacaagacagtaaaaagccttatttcttttgcttacacggcagacaagtggcaagaacttggagaccctgctgtttgaggcgcgatgactacaacaactgatgcttccacgttagtctgctgtgatgggccggcactgatcctgccgtccantgcctgatcctccggtcgcgtgtgctcatctctaaggcccacatgatgctgcgcatttgaagaacagtcctccttcgatgggtttgtgnttccaaattnngttgggagcgacccttgcaactcctggggggaatcaaggaggcgatactcgggaaaangaggggcaaagtaggggttnttaaaaaaaaccaagtggggcaaatgcnaatccantgtngggaaaggngngaacanaaaggggggtnttcctcggnaanccccccnn

SEQ ID NO: 100577 - DNA, 613 bp, Triticum aestivum
  unsure (1)..(613): unsure at all n locations
  Clone ID: PAT_TA_100577
ggaaactggccgccctcaccttccttcgcctgcagccccgatgccttcctttcttgcgccgccaccacaccgcacgacgcccggcagccccatctcctccctgtaccttgccgtcgagtaggcggaagctcctccgtcacctcctccacgatcatcttgtcctctcccctgttcgagatctgattgtcctcctgcacgctgattccccgcaacatcgcggccgccctacacctacacgcgagcccgccgccggcacgggagcctgcccgccgtcaccccaagcccgcctctgctgaggctgttgccatgtgagcctgccgtccccgcgagaaccggcttccgctgaggactccgccatgcgaacccgcggccgctgcaccacgggagcctgcccgccgtcgccccaagcccgcctccgctgaggccgttgccatgtgagcccgccgtcgccgcgcgaaccggcttgagctgangcatccgccacaacacgtttttttcttaaaaagtgcanattcaaataaggancgtaagggtnctggtctggnactgtggatgctngtgancanaataangtttgggggnaaaattccaanaaacaaatngatcnaacgaa

SEQ ID NO: 100578 - DNA, 626 bp, Triticum aestivum
  unsure (1)..(626): unsure at all n locations
  Clone ID: PAT_TA_100578
gctctctctctccttcccgcgcccctccctgccccaccgccgccggccgccgccgccgtcgccgctcgcccgggcaactatccacgaacccgcgccaaccctctcctcttcctcccaactcacctctatctttctctctctcctcttcaaaacctaaccctagccaacaagctccgctccctgncggcgncttcgcgtttgtctcctcctccccggccctncttcggtcctcaagaaggagggaagcacggntcccccgccgcaaacttgctcctgnctcaaaggnagaaggtgatttaagattaaccccaaantgcaaaaagaaaaacgcgcgttcgggcaancgcaaccggntttcaaaggntttcggggggggggggggngaaagggaanaggggcaanntttgaacctcnaaanttcaaagtgtttncaaaagganggggggncaaagggcantccgcnggggggcaattnattcaaanccaaaaancccgccttggggggtnttggaatcttgggcgnccccccgttccccaaaaaaaaggggnttcnnctttgnctgggaaaaaaanaaaagggttncacttncccnnccccgggtttaaccnaggnggtttctttttnt

SEQ ID NO: 100579 - DNA, 461 bp, Triticum aestivum
  unsure (1)..(461): unsure at all n locations
  Clone ID: PAT_TA_100579
ggcaagcgcagacagacagagcttgagagagcgcgcgcgagatggcagcctccatgatcacctcgccgattgtggcgccgacgagcctgccgtccctctcccgccggggctcctccttcgccgtcgtctgcaacggtggnaaaaaaatnaaggtccacaaagcccctcggactcngaggngggttgacaatccaaatccaancccaagggaagaaagtcnggaaaaaaggcgtgtancaatttgtttaaaagtnangggccnaantccaanggtaaaagccaatctaaaacccnggngaatngnctnaatccggtgaacgctnacccngngggaacaacgggcttnntaactggggcgttaacctncccgggctnctncgggggggggttctnctcntctaaaaaaacaaagctttncnccggtaaaaaaacanctaacttntaaaaaaagggccggtctc

SEQ ID NO: 100580 - DNA, 572 bp, Triticum aestivum
  unsure (1)..(572): unsure at all n locations
  Clone ID: PAT_TA_100580
ttggtttgatgatgatgcaggcgggagggncgtcgtacccggtggagctggggcngctggacggcaaagtgggcacgcgcgccgtcgttaagcacagcctccccggcgccggcttctccctggaccagctcaacaagctcttcgccnccaaaggactcacccaaaccgacatgatcgccctctcaggtcaagtttgtacggcctgattgattgattgttgatntcctccggcctcngcaacatcacnccaaaacattccctctgaattgaattattanccgctcaagatanattttaagcanttactgacgtggaaaaacaatncggtgcaagggggcaaangatnggggtgacgcactgcgaanaattcgtgcggggggtgtacaacttcaaaggggggcnggcgcaataaaaccccncccattaaactggcgttccnnccgnaaatgccggggaagttccccctcaaataaaaanccgggcancgtnggcanagcnngaaccccctcnacccccaanaaggtctnnaaangggtnatnacaaacncngcaacaanaaaaaggcctccttn

SEQ ID NO: 100581 - DNA, 614 bp, Triticum aestivum
  unsure (1)..(614): unsure at all n locations
  Clone ID: PAT_TA_100581
gccgcancaaacaagcaagcggacaaacgcccccgaccccctctcgctcctgccgtcgccctcaccancgtgatccgattatacgcgcgcgcgcgcttcccttcccgcgagcaagccgaggaaagcgggggtgagaaaggagggaggctanggcaagaaagccacgggcggngggaatgtccgggggaaaaagaaagcgaagggggcaaagtgtctcnccnaaaganaataacaanctcgtgaagcccccgccccccaanatnnctccccnggctccggtttcctcttcncaagantttaaaattannttaaataatccccaagcncaaacccaggaagggccngnttttttctcnccncccccaaaattantttcccggaaaaagggccttttaagttgtgggggggcttaaannggccggggttaantaaaaaatgggttgggccgtncaaaattttgggttttttgggccctttcccnnccaaaatttaaatcccnaanaaacccttgggccccctntnaaaaatgganaaggaatttgncctntttttnagggnaaaaggtnaaaagggggngggggannaaaattggggttaaagggaagnancgacgn

SEQ ID NO: 100582 - DNA, 301 bp, Triticum aestivum
  unsure (1)..(301): unsure at all n locations
  Clone ID: PAT_TA_100582
gcaacaaccaaccatacgagaggaacgacctcacaaccgtgtgaagcgaggtgagctaggggatcatcactgcccagcgatgtcggccggtgagatgcggaagacggcgtgcgtcaccggagggagtggctacatagcttcagcgctcgtcgagacgcttctgggagaaggggtacgccgtcaagacgacggtcagagaccccgaggacacgggagaaagaattcccaactcaagggacttgcaaagcgcttggtccctttggagatnatcccgtncccggtttggaccaaaaaaggaact

SEQ ID NO: 100583 - DNA, 532 bp, Triticum aestivum
  unsure (1)..(532): unsure at all n locations
  Clone ID: PAT_TA_100583
aatctctccctcgcccaaaccctcgccgccgccatggccgcagccacctcccccgccgtcgcattctcgggcgccgccgccgccgccgccgccatacccaaacccgcccgccagcctctcccgcgccaccaagcccgcctcgcgccgcgcgctccccgcccgcatcgtcaggtgctgcgccgcgtcccccgccgccacctccgtcgcgcctcccgccaacgcgctccggncgtggggnccctccgagccccgcaagggcgccgacatcctcgtccaagngctggagcgctgcggcatcgtcgacgtcttcgcctaacctgggggggcgtncaaggagatncaacaagcgctgacgcgctcgccaatcatcaacaaacaactcttncgncaagaataaggggaggngtttccaggntgtncnggtaaagcccgngcgttccgggcgcgtccggggttttgngttnccancttcggggncnggggggcaaaaaacttggttttcgggggttcgaaanntaatnttcttgggaac

SEQ ID NO: 100584 - DNA, 599 bp, Triticum aestivum
  unsure (1)..(599): unsure at all n locations
  Clone ID: PAT_TA_100584
cgcgcacaaacgcaccgcacgcgcacagtcacggtgagtgggggagaaggaaggagaacggtcgaaaggattccggtggcggctgcgaggaggcgatggggtgcgcgcggacggtgaaggccggggctgcggccgcggcggccgtgctggtggcggccggggtgaggatggtggggccggcggcggcggggttcgtggcggaggagatnccgcgcgcgcaagcggtggcggccacctggctcacgccgccctaactgtacctcgtcatcaacgccatcatcatctccatcgccgcgtcctccaaagtttcaaaacaaccgcggcgtccggctcccaacgcccgctttngggaacggaccggttccaattgcttcncccgggtctggngaatcccattggaatttnctntnaccccaantggctaaggggaatggngtnccccgtttcccgtgggngccttgttccttanagaaatttnccgtnctcaaaaaaacccccccngcccccgtntcccgggggcccgggaatttgggggnngggggngggacntcccnanttnaaaaatttgncaatggacccccaaancnaaaggngccagg

SEQ ID NO: 100585 - DNA, 573 bp, Triticum aestivum
  unsure (1)..(573): unsure at all n locations
  Clone ID: PAT_TA_100585
gaccgcttcctcgtgtccgaactaagccccaatcccaccaccaccgccgctggtgctcggcgcgatggcgcagaaggacgccgccaatggcaacggtgccaccacgcgcccgccgcccactccctcccccatccgcttctccaagttcttccaggccaacatgcggatcctggtgaccggcggagctgggttcatcggntcgcaactcgtccacaagctcatggngaacgagaagaaccaggtcattgttnctgacaaatttttcactgggtcaaaaaaaaaccctgaanaagtggntnggncaaccaagatttnaactcaaccgtnaagaattcaccgaaacaatngtcngtggggggtgacaaanttaacaactttgttggcccngctcaacaaatcctcctaaaaanaaaaaccccgtttaagancaacaaanaagaatgtctnttgngtacctttaaaanacttnggccttcnanaaaaaagnttgggccnnaaaaattgnttaccttccaccnccgaaaatttaaaggggattccccttggggaaaccncnaaaaggggggggggttg

SEQ ID NO: 100586 - DNA, 347 bp, Triticum aestivum
  unsure (1)..(347): unsure at all n locations
  Clone ID: PAT_TA_100586
gtctcctcggcttgcctcactaatcactgcacctccaccaccataccaccactactagtacctcccctatatgcttgcttccctctcgatccctctcctcctcccttccgtttcataagccacctccaagagtaatcgagctactgcaccatctatctcccacaggcagcggaagcaatacaagcggtagcgcctatgtcgggcnaagttccaagttccacgacnaagctccgcgttcgcctcttcaacgcaagcgggtcggggggccgggggatgcantnaatcaagggagcaagcaanggcctccctgggctncncccttntaatctggnaaggaccnccccaat

SEQ ID NO: 100587 - DNA, 542 bp, Triticum aestivum
  unsure (1)..(542): unsure at all n locations
  Clone ID: PAT_TA_100587
gtttttgataggaaatgtatttaacttcagacattactgttacaccaagatacgagatatggtttcaaacantgtcgacatcaataaacagagaaatccaaaactttgnccttttaagcaacacctcccnncattcatancttatagcagtaaaggaaaaacaaaacttatattgaattaaacaagatgcaagtcagccctatgatcggnaagtgggcatgaacaagtcatgactgatgggccanggtngacatgctccgctcaattccaaccaataccaagcatntggaaacctcttnctcctccttcannctcaacaatcancaaagggggtanggtcctcaatcaactccccaattggnaacagttngggacatncgtcgccnatcntgnggtgncanttcngacctngtangccccccttccntgtcaaaanttatcccnaaaccttaattctngnttgggctccaaatcncgaacnaaacatntcatactcaattttncctcctctcttcctccgncttttggcctnttcccaaagg

SEQ ID NO: 100588 - DNA, 279 bp, Triticum aestivum
  unsure (1)..(279): unsure at all n locations
  Clone ID: PAT_TA_100588
cgaaccggataggggatagtagatagatcgcccccaaatctttgccctgaacaccgcgccggccggccgcttccacccaccaccacgccctcccgctctccccaagattcggctctccgtggagatttccgggatctttccgccggcgacgtcgcccatggcgtgctactgacatggtccgccgcgccacaagctgccgccgtgcacantcgcttcgattcggcgaaccaagaagatgaacggggcgccgattcccgcgggggncggngccgaacccgc

SEQ ID NO: 100589 - DNA, 569 bp, Triticum aestivum
  unsure (1)..(569): unsure at all n locations
  Clone ID: PAT_TA_100589
ggtgccacctctgcctccaccccgacgagccgccacacccctccctccctcatcctctcctcacctgcagccgccggccttgtctctccactcgcctcctctcctctaccacgtcgtcatcgatccaccgtcggccttctcctctgcttacctcctcctgttctcttccatgtcgccgtcgatccaaatcggccgttatcgtcatgggggaacaacgccggcagggtcttcgcggtgcggatggggggtaagatgttacaaaaaagggaaaggagaaggcggtnangaaaggaaacaataagngggtgggggctaangggnaaggtnagggctcccgcaactngctgggggggccgaccggttttaatttcccgggncaacaaagtcntnccctcctctggggccaanaggggggcaacttttngcttcaacccccaacgggaaaaggncnccaagttaanaagnaatnttgggaaaggnaaaaggaacattanctcaactctcccccaatngntgtctcctgganctngggtnaaangngaaaaanaatngccttnttggggggggnn

SEQ ID NO: 100590 - DNA, 187 bp, Triticum aestivum
  unsure (1)..(187): unsure at all n locations
  Clone ID: PAT_TA_100590
gctccattccatcccccagnccagctctctctccctcgcctccgaggttctctgcccgccgcggcatttgcgtccggtagagcacggcggaggggatggactcggacgcctccgtgtccccgcggnggcggagctgctacagcgacagtggcgactcctcctgctccgagcccttcancgagtgcgg

SEQ ID NO: 100591 - DNA, 266 bp, Triticum aestivum
  unsure (1)..(266): unsure at all n locations
  Clone ID: PAT_TA_100591
ggaccaatcttcttccctggcaatagtatggagtgtggtggataggaagcaatctctttgtgtggtccgcccctctgccaggtcaccggtccgcggcacctaccctcctcttccggctttgccggcggtgcgcgctacctccccgatctcaatgtgtggtcaacccctctggcacggtcgccggtccaaggcatctcccgccttttgccggtagtgancgccgcctcccctnaattttgcgtgtggttaagccccctttggaacgt

SEQ ID NO: 100592 - DNA, 440 bp, Triticum aestivum
  unsure (1)..(440): unsure at all n locations
  Clone ID: PAT_TA_100592
gtcacttctcccgtcctcccgcaaagcccaccccgcagcagaaagggagggagcgcggaggaatctccgtctccgcctccgcctccccctccatgcccccgctccccgccgggcccggcccanatctcccgcgcggcggccgctagccgatccgcctagccccgctcgatccgatgggcggggaggtgccggagccgcggcggctcatccgcgcgctcagcttcggctgcggcggcgtgcccgacgaggcgctgcacctccgtcatgggctaagttcgacgcccccgcgcgaacgggagggccgcctccntcgtnctgccgccggcttggnaaccggcaatccgaanccgcttaacccgcaaagcaacgttaanccgtcccctttttggctnncgccnccganccggggnctggnctcccttcgttctggttttccntgg

SEQ ID NO: 100593 - DNA, 543 bp, Triticum aestivum
  unsure (1)..(543): unsure at all n locations
  Clone ID: PAT_TA_100593
ggaattacaagcgtcaccagtgccaaatgcaccaatggtgctacaaccgacgggcgttaggatagtgcttaaggtgccgatgaactacagtaacagcaaatcactcatcttgcgagctatgtcaaaggtcaaagtcattgacattcgacagcagcgagagcacgctgacggtggtgggaaacgtggacgtggtggtggtcgtgacggcgctgcgcaagatgaagtacctcgcgcaaatnattatggtggatgccacaagagaaggtggacatccccgtccacgaccaaaagcctgactcccgcactaagagtctgtggaacctcatctcacgtggaaagcaaaagttcctccaaaaataaaaatctttgcctcanctaaccactgatacttgggtgttcaatgttnnagtaatccaaacatgttnnnagtaaagatacgtgttntagtnaaagatagggaatcataatatgagtccgtttaaagttttctaataacaagtactaatcaatcagncntcatcaaaaggaaacatattntggggg

SEQ ID NO: 100594 - DNA, 251 bp, Triticum aestivum
  unsure (1)..(251): unsure at all n locations
  Clone ID: PAT_TA_100594
gccgcctcgcngttccaaaaccctcncctcacccccgcccccctanggttcgcctcgcctcgccgcgccgcgccgtcgnacncatgggctcctcactcccggccaaggangccaaccttttcaaagtnatcgtcaaatcatatganactaagcantataagaaagggctgagggctgcagattccatattatnagaantttcccgaacatggagaaactttatcgctgaaaaggttgacaccaaatttgta

SEQ ID NO: 100595 - DNA, 283 bp, Triticum aestivum
  unsure (1)..(283): unsure at all n locations
  Clone ID: PAT_TA_100595
gcctctccaccctccccggcggcatctagctcnccnaaacccagtgaggaccctgaaacttcttcgccggtgcaccataaacccgaagcanaggtataggatcacctcgatcttccggccgtccactggttggtggttgctgcctgggaaaggaagtgctgctgctagctgccaatacggctccaccgcgtgtggctccgggtcttcccgccgtcccgggtcactctgggcttcctcgtggggcccccgcttcgtctcacgctnaataatggggtgtgggggg

SEQ ID NO: 100596 - DNA, 449 bp, Triticum aestivum
  unsure (1)..(449): unsure at all n locations
  Clone ID: PAT_TA_100596
ctttgaggagtccgacgtttgttctgacacggctagatgattggtttaggacaggttatttttgcgttgtgtttgtaattgtcgctgtggagtgtggagttcctgctacacttgttccaagtaaggtgtagtttctttgcaagttttctgccttctataataatatggtacgcctaggcgtattctccaaaaaaatcgcctgaatagtcttcttttccgttcttaaaaaatggtaagcctgggtatttatgtgtccgtttccgtanaaaatgacaaaagaaaaagcccaaaagcacaagcgatgtattaacaatgggccctttggcgcaaaaaaagggaattaacaatnggccctaagangcgggcaaaaaattnactggtgggccaatcctntgtaccaaaaacctggancaagangggggggcaatnnccaaaaaaaaaaaaaagga

SEQ ID NO: 100597 - DNA, 487 bp, Triticum aestivum
  unsure (1)..(487): unsure at all n locations
  Clone ID: PAT_TA_100597
gcctcgtgccgaattcggcacgaggcccacctccacccttctccgatcccccaaccaccgccaccaccgcctccgatnccatcctcctcctcctcccccgcctccggcatgagcggggcggcggaggaggcggactccccgccgacgcacatgtccgaggactcctccccgggctcctcctccggcggcagcggcggcaggcggacgccggatntgaggggcggcaacaacggnggggggccgcgcgcctcctcctccgggccgcccgaacaagtcctcgaaaaagtgctggagaacgtgctcgaattcctcaacgccgcgcgggaacgcaaagccgcctcgctcgtctgccgctcctggtaacgcgccnaagngcaaaaacgccgcgagctcttcaatcggaaatggtaaaccgtngaaccgcgccgggccgtncggcgctttcgcgcccgtttccgccgtttttctcaaaggnaaaccgcgcttt

SEQ ID NO: 100598 - DNA, 392 bp, Triticum aestivum
  unsure (1)..(392): unsure at all n locations
  Clone ID: PAT_TA_100598
gacacaccacgcctgcctcatctctcggagcaggaggaggaggagcttgcaggaacaatggcggcccagggtcttctctctgggaggcagctgctggggaggcctctgcagtcttccatctccaggtcgtcttcctcccggaagtcccccttcgtcgtcagggcatcttccaagcccccctgccaagcaaaatgacaacaggcagctgtggtttgcgtccaagcagtccctcacctacctcgacggcacgctgcccggtgactttggcttcnaccccttggggctgtccgacccaanaggcaccggggggtttatcnaacccaagtgggtggcctaaggggaaattttcaaanggccgggacgggnnaataatgggggtggtgggcaatgat

SEQ ID NO: 100599 - DNA, 553 bp, Triticum aestivum
  unsure (1)..(553): unsure at all n locations
  Clone ID: PAT_TA_100599
cgacgctcaagcccccagacgccgcagcgccgccactccacccncancggcaaccatggcggtcggcaanaacanagcgcatctccaaggggaggaagggtagcaagaagaaggccgtcgatccgttcaccaagaagcagtggtatgacatcaaggcgccgctgctgttcaccaagccgcaacgtcggcaagaccctcgtgtccaaggacacagggtaccaagattgcctcaaagggtctgaagcacaaggtgtttgaaagtatctctancttgatcttcaagaacgacgaagaacaagcctacaagaaagattaagactccggtgctggaaggatgttcaagggatnaatntcctcaacaacttttggggcatgggacttcaccaatgaaaagctcaagtnccttgttagggaantnggaaacnctcattgagggtcaanttgatgttaaaaaaacttacaactacattctttnnaagttncccaatttgcttcaccaaaanaaccccnaaacaagttaaacgcacttnctttgcccaacaagttaaattat

SEQ ID NO: 100600 - DNA, 517 bp, Triticum aestivum
  unsure (1)..(517): unsure at all n locations
  Clone ID: PAT_TA_100600
ngccggancacatggnggacggntcgcantgccccgtgtgcaaggatgagttcgagctcggcgagaccgcgcgcganctgccgtgcaagcacncctaccactccgactgcatcgtgccgtggctccggctccacaactcctgccctgtctgccggcaggagctgccaatgccggccggtgatgaatctcccgatggcgcgggcgcaagcgacggaggcgaagaaacggttccgccgtggcaactgcttgccggctgggggccaactggcttggctgctaacgccgggggaaaccggacgtnggcggcttggaaaaagggtttcngcaacgttggaacggaacccaccccnattaaaacggggggnaatgtcaatcntggggccaacnaatccctcaatccctttgtttctccntcccttccctgccttttccttntcccccctttcccntttgaaaaaaatgnacaattgggngactgtcacnnngtgcaaaatcaattntttccggaaaanaaaaa

SEQ ID NO: 100601 - DNA, 539 bp, Triticum aestivum
  unsure (1)..(539): unsure at all n locations
  Clone ID: PAT_TA_100601
gccgcagccagtcagctagctaggttcccggttaggcgcggcgagctagcgacgacgagccccggagcccgcccacatgtcccccggcgcgcgctcccgaaagatggaacacgcgctgctcgccgcactcctggcgtgcgcgctcgcgtcggccggtagcgcgcaaccggcggagccggggcaagggggctatgacaacgacgtggccgaccaagaaaatgcgcgtcaagcaacgaacattgtcncgctggctgggcgcccgttctccccgtnttntttctcaatcctcccctncaattaattaacctncggccaatngaacngggtnatncgtaaccccaaccccccncggcgggaanaatcccncgggttcnggcccngggccgggttttncaactttaancccaagggggaacaaaggggggnggggaaaccccgggtncccccccaagttgtccaagggtttcccaacaatgccnaanccgngggcaaagggctttcccttgggaaaaaaggggggccccccttgaattttccgg

SEQ ID NO: 100602 - DNA, 272 bp, Triticum aestivum
  unsure (1)..(272): unsure at all n locations
  Clone ID: PAT_TA_100602
gtaaaaaggaggctccctaaaagaacngantaanaggcatggtncctgaagttttttcttcattcatgttgtaacnatcgctatatctgtattttacatttaaacatagaanaatacattttcctttgaagatattancanaaaaaaaaaanctagaaaaaaaaantctnanaaaanaacaaccaaaaaaaaaaaaactcttgcncttggcttcgccgccctccnttcggntggtggcnaantcccgtnggncttcccncaaccggccttcc

SEQ ID NO: 100603 - DNA, 530 bp, Triticum aestivum
  unsure (1)..(530): unsure at all n locations
  Clone ID: PAT_TA_100603
gcccacacacacacgcacgcgtttgacattttccgcccaccaccgccggagggagctccaaccatggccgccaagtgctacccgacggtcaagcgacgaagtacctggccgccgtcgccaaggccaagcgcaagctccgcggcttcatcgccgagaagaactgcgcgccccttatgctccgcctcgcgtggcactcggccgggaccttcgacgtggccaccaaagaacggngggcccttcgggaacatgaaatgccccgcggagctngcncaagggggccaacgccgggctccaaatnccccgtnaaggtnntccaacccaataaagggcaatttcccaacctctcctaagccgaattttaacaactccctnggatcctccccctccaaggcanccggggggccnaaggtcccttccaacccgggggaaaaggaaaanccgancctcctccaaaaaggcgtcttcctganncttcccaagggttaacaacttaaggaagggtttttcaaacaanagggtttggttacaaa

SEQ ID NO: 100604 - DNA, 355 bp, Triticum aestivum
  unsure (1)..(355): unsure at all n locations
  Clone ID: PAT_TA_100604
ggactttaaattcttttctttattcaaataaaggtatgaaccaaaattgaaattgcctaaatctcaataagaaacggggaacttcaactcgaaatcctccccgaagaacaacgaaagcccgccgaagggggggaagccgccgagtcctcctgggttctgggaccgggggccgggtggggaactcgggtccacctccgcgccgttgacggggnnngggaactttttcggggccgccggggaacggggggccaagaacaccaccttggtgannnacaacgtcctgnnctgggcgtacaaattgggcaccnnctccgnnctcactttgaagganccnnnnntccccgttgggcnnnng

SEQ ID NO: 100605 - DNA, 646 bp, Triticum aestivum
  unsure (1)..(646): unsure at all n locations
  Clone ID: PAT_TA_100605
gcacgaggaataatcctcccctcgtctcctctcccccgcgactactcgccgccactgccaccgccacgacccatgccggccgattccggcgagtcccagcggcgggtgacacactaacacctcccctggccctactccttccttccatccgtccagatccgtcctcctctcctcgtctctctcctccgcgtcttcctctaggaagccttgcggctgcagtaggagaggagtcaagggggccgggctagccgatttcctcgccggatctggagcacaggggcgccgccgctgccgcgcgcacaacaagccgcagccacttccactccggcgccgattgatgggcctctccaccctcgcgcacccgcctcccgcctcccgcccccaggacctgcagatccttgccttcacatgggtgatgtctctagtgaaggagggcggaggctcgcgcccccgtcgacctgtccttctcgtcggtcgcgccccatgctagcaggtgggcagagcctcatcatcgtcagcgggaggaggctagcagcaatcgcagcaggtggcggtggtggtgaaagaatcgatgatggcgcaaggcccaccgcttcttctgctgnnnnnctgcacaacggcgtctctgnnnnnntcggtgatgacn

SEQ ID NO: 100606 - DNA, 662 bp, Triticum aestivum
  unsure (1)..(662): unsure at all n locations
  Clone ID: PAT_TA_100606
ctccactaccccctgagctgaatggccgtccacgtcgtaccacccctcctcctcctcctcctcgccacggccctcccgtacaccgccctcgccgttttctccccggatttctccttcttcctcgcgtgcggcgcaggcgcggacgtccccttcccatccgacaaccccacgcgcaccttcgtgcgggacgacggctacctctcgcaagggcgccccgccgcggtgtctgccagtgccagctccggcgcggcctccaaccctctgtacgccgccgcgcgcgccgacagctcggccttctcctaccgcctcgcgtaccccgccacggcgggcgcgtcgtcgttcctcgtcctgcgcctccacttcttcccgttcgtccccgcctcctcctccaccagcctttcctccgcgcgcttcaccgtctcagtcctcgacgcctacgccctcctgcctaccttctcgccgccggtcgccggcgtcgtcaaggagttcttcgtcccgcgcgacgggtcgaaagatttcaccatcaggttcaccccggacgccggctcctccgcgttcgtcaacgccgtcgagctgttctcggccccgccggnnctgctgtggaacaacacggcggtaccggtngannccgtggggagcaatgacctgccngnnnngnngnn

SEQ ID NO: 100607 - DNA, 231 bp, Triticum aestivum
  unsure (1)..(231): unsure at all n locations
  Clone ID: PAT_TA_100607
agaacgaaatttcgtnnntataccatgatgccatattatttacacgcacgcacgcactccagagtacatatggctccaccagcagttcatatgtcgcaaatagagtagagaaacagcaagtacatgtgttacaagacaataacttgccactagttcaataatccaagatatatacacacaatcaccacaactgnnnnnngcnnnnaatcaacaggaatgacaggaggacag

SEQ ID NO: 100608 - DNA, 648 bp, Triticum aestivum
  unsure (1)..(648): unsure at all n locations
  Clone ID: PAT_TA_100608
gcacgagggaagcaagttactggtgttgttaatttgggaaattcagtactttgtttatactgctttgttttaggggatgaagtaaatagaagaagaaattcctgggatggatctatatgtgcccgttatgctgtcatgtaaattccacaacacatctgtatgcgtgtatccttcttatagtttctattacccacttatagtcatgcttgacagcctgagggctgaggctaacaattcttttcgtctctgtgccccttatttcagtgcattgtgctactgtatactactgttataatgacatgtgcatttagtaaaatcccttaataatggcagcatgtaaaaaattaaatgtttcctgagtgctgactgtggtatagattcgtttaagttctgaaacctgcaagtacttaattagataataattctgtaggatgataaaaaagaagaagatgatgattcagttatcaagaggatgtgtgaactctgaacctgaagaacaggaaataaaacatgaggaagataatggaagagaagaagaagcagacattagnataatgaaagagaatgagtagataatgagaatggtaatgaaagnnnanacgagatgcaccttggcnnngtaaagngctnnnnntgaaattgccaata

SEQ ID NO: 100609 - DNA, 644 bp, Triticum aestivum
  unsure (1)..(644): unsure at all n locations
  Clone ID: PAT_TA_100609
ttgacacctacctacctagcctagccctcctcttccagcctttgagtactctcttcccgcagcacacgcgcacacacatcccgaagcgacgggtacttaaccgcttacccgccctggcatacacctgcgtgcaccatatagattagctagtttcataggcgcactgcagctctggcatgtatgccctaatggtacatggctgagcagccttcagcaacctcctcgtctgctgctgctcctcctcaggtgcaagtgcaagctgctgctgaaccggcgaccgaactttccccgggtgctcctgcctcgccccattccccgccggttcacctaggcgacacggtggggacaacgacggcaacggcgttggcggcgacgagctccggggagccgtcgccgcggtccactgggaagcaccccttctaccgcggcatccggtgcagaaacggcaagtgggtctccgagatccgcgagccgcgcaaggcgcgccgcatatggctcggaacttacccgacggccgagatggctgccgcggcctatgacgtggccgcccgcgcgctgcgcggctccgacgccgtgctcaatttccctggcgccgccgcctcgcgccctgtccccgcgtctgcctccccnnnnnacatacgtga

SEQ ID NO: 100610 - DNA, 645 bp, Triticum aestivum
  unsure (1)..(645): unsure at all n locations
  Clone ID: PAT_TA_100610
gcacgaggcttcctgtaacctccgcatcgagcaccgccgggagagggccgccgccgcctaccaagctgagggttgtggggggtgtgagccgcctacagcgccgagatcgagcgccacagccgcgtcgggaagggccgccactccgtgaggaaccgaggggatggagccccccgtggccaagaaagcgacgcaaccagaggaggaagataggttgagcgtgctgatggatgatgttttactgtctatcttgcggaaagtcgacataagcaccactgtaaggacaagttcgctgtcaacgcggtggaggaagctgccctggctgctgcctgagctcagcattgatgtcaggcatttcctacctgttccatgcccagactcgatcacggcaaatgactgtcagcaagctatggtggctctaaccaaagcagccaagtgtttgcttgctaaacctcacagacaatccaccatcacaactctgcagcttaagctctacttgatcagcactttcttgagcgacattggccctctattaggtgatgtgatcgacagtggtttgctgaaagatttggacctttgcctgcttgatgatctgaaacctggtgactcttctgagttgcacatgatacagctcgccaannncatgtt

SEQ ID NO: 100611 - DNA, 652 bp, Triticum aestivum
  unsure (1)..(652): unsure at all n locations
  Clone ID: PAT_TA_100611
gcacgaggcagcagttcatcagcatcctgactggccatgttaactccgcgtcctacttctcgatggacgctgcatccttccccagcaggctgccaatggctgcgtgcctgcgccctgctgcttctgcgccggtgccggccaccacgcccaatcgccacggccagcggcagcagtctcctcggcggacggcagtgtgcaagtgtgcaccctggcactgggaactagagacgtgcaacatagaaggccagcagctaagagctgagcagctatacacagagccggaggtgtcggagcaacagcgagcaacggaccttttctcgcagaaggtgcagaggtcgtcgttcagcacgtcggacaaagtaatgtcatcttacaaattcttacaaaagtttcatacctacaagacacaaacagaatgaattgatatttgtatatgccatggaattttgagcaggttcttcagctgtcggacgaggtggaggcacgcttcctgtagcacttcgcgggtaaagactcgaggtgcaggtgacatctattattctcactnnnnngaatctgaaatnnngtgagaatgcaaccttttgggaattctggacttctcttttgcgctaatacaatgatattanntgtttgttggttgctatatatggnn

SEQ ID NO: 100612 - DNA, 626 bp, Triticum aestivum
  unsure (1)..(626): unsure at all n locations
  Clone ID: PAT_TA_100612
cctcgtgccgaattcggcacgaggaactcctcagaagtctcatcctttctcgaccaaacatacccgctgattagattaggtcgcccccagctcaaaaaaattgcatctctaccgggccaaagaccccgtctggagctgagaaaaatcccttctttcgtcgtacattcacggcgctccgattgttccccccaattcaatcgattcattggttgcatctccgtcgtggatttggatcccatctaatcgcaagcatagaaacaagtcctgaatagcgagcgatccaccaagaactccaccacacgagttccccaatcattcctcgccgctgcatttggcccactccaggaaatccccactcggctcgcccccaagccgcaccggattacagctcatcacaagggccagattttcagagcagggcagggaaaaggaggaagcaatgacggaggtggcgcttctccggggcccgaccaacctcgcttcccccgcaagccgcagcccctcctcctccctgcgctatttagccaatgccgacagcgacgtgctgcagnnnnntggcagcggagagagccctacaggatccgnnngacggactgagcgagnnntacnnnnntcggannaagann

SEQ ID NO: 100613 - DNA, 645 bp, Triticum aestivum
  unsure (1)..(645): unsure at all n locations
  Clone ID: PAT_TA_100613
gcacgaggcctcgtgccgccttctctcctcccagctagggttcccaccaccgccgccgccgccgccgccaccctcacggcgctcgtgcttcgtatcccgtcccgagctccacctatcatccaacaccgtctcccgccgccggcgtctggcagcgcgttggcgccgccgcggccacgctacttgcggtggtcctcgtcgccgtcgcgttggggcgccagcgcctccgccacagggctccggccgaagggatccccgcgctggaggacggctgcacggtcgctcacggcatagggagcgaggcagtcgatgacctgacagacctcatcattgtcggagccggggtggccggatcctaatttcttcacttccttcctttgccatgttcctccaccctgcagggaggaagttggttacaatttttgttcgtaaggtgcagcaggcacaaaaatctctctctctctctctctctaatctagccatcaagagttcggtgagttactgtcaagtctgtattcactctcgatgagttcatgagaaagcgaccatgaaatcagannnntcttcacttgactggattgtnnnnngccttgtgtgctctcgtttcgttttcagctgagtgctcnnnnngtcagctgctctgcttgc

SEQ ID NO: 100614 - DNA, 588 bp, Triticum aestivum
  unsure (1)..(588): unsure at all n locations
  Clone ID: PAT_TA_100614
gcacgaggcgcttcctcccgccgtcgctgtccccaccggcctcccccccgcagccccatccatggcctctcgaaatcatggccctacccccgcctcctccctcgccacgcccctcctctccgactccatcacgcccaccacgcccacccgcgccgccaacggccacgcgcggggccacgacggcgacgacgacctctgcgccgccgcctcggtgtgcgacggcggcgacccgttcgcgttcctctcgggggacagccgcccgccgcggccgccgggcccgtcccccgccgacccgttccgcaacaggacgccgtggctgggcggcccgtacgggtgggccaggacgctgctgctcgcgccggtcgcggcggcgcggctcgtgctcttcgggctggccatcgcgatcgggtacgccgccacgtgggtggcgctgcgcggctggaccgactcgcgggagcgcccgcgggagggcgccggccccatgccggcctggcgccgccggctcatgtgggtcactcggctctccgcgcgttgcatcctcttcnnnttcgggtatcactggatcacacgaaaagnnnnnnntgcgcc

SEQ ID NO: 100615 - DNA, 643 bp, Triticum aestivum
  unsure (1)..(643): unsure at all n locations
  Clone ID: PAT_TA_100615
gcacgagggttctttctatctcggacgtgccgccgagacaggacttttcggatatccaagactgacttcagatacagtgatctgctggatgatattcaaagcattgattcacttcttcttgatctgtcaacactaagagtagctacaaatgactttggtgaaggaactatgcttggtaaaggaggttttgggatggttcataaggtacaaaccatgccatacgtagaatttatcaactttatatatttaccaatgagcgtgtatttttctttttccacagggagtcctgcctgacggtaaacaaatagcagtaaaaaggctatgtaagagttccaaacaaggaataggggaactgaaaagtgaactagtcctggttgctaagcttcgccacaggaatcttgtgagcctcattggtgtttgtttggaagaacaagagaaaatacttgtgtatgaatttatgcccaacagaagccttgataccattctttttggtacaacnnnttcactccgagctttaatagtagtagtgcaagtgccaccaaactttcactgcaatgctgatacttctattctgaatgacagattctgannaatgcaaagacntnnncnnngnnnnnngattcaagattatcagtngnngtac

SEQ ID NO: 100616 - DNA, 643 bp, Triticum aestivum
  unsure (1)..(643): unsure at all n locations
  Clone ID: PAT_TA_100616
gcacgagggtcattcatcactgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggnnnnctggnnnnnggcac

SEQ ID NO: 100617 - DNA, 659 bp, Triticum aestivum
  unsure (1)..(659): unsure at all n locations
  Clone ID: PAT_TA_100617
gcacgaggcagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggnnagctggnnngtggcaacgccggnnnnncagcnnagctcatcnnnnagcgnn

SEQ ID NO: 100618 - DNA, 235 bp, Triticum aestivum
  unsure (1)..(235): unsure at all n locations
  Clone ID: PAT_TA_100618
ggatataataacacgggataatcttatttatgtgtgcataatcctgagtccaaaattttccaaccaaaaaacttttgtgaaatcaaacctttttgtacaggatactacaggcctggcagccattcttggggaaaagattttccaaaatgatacattctgcccaggttacatgatgaaattgacattgttcgtttaccaacccacgcaaataactggacaaaccgggagntcactn

SEQ ID NO: 100619 - DNA, 587 bp, Triticum aestivum
  unsure (1)..(587): unsure at all n locations
  Clone ID: PAT_TA_100619
ctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcnnnnnaccgggttgcgaggagtctggcaaggcntnnnctacgagttgaaacaatggcctatgtatgnnnnnnnnnnnnnnnctta

SEQ ID NO: 100620 - DNA, 629 bp, Triticum aestivum
  unsure (1)..(629): unsure at all n locations
  Clone ID: PAT_TA_100620
cannttggcngctngagtatgctnatgacannntcaaaggtgaaggtgttcgggccgggcaagtcgaggaacgtggcccgggtgctgatgtgcttggtggaggtcggcgtcgagtacgaggtcgtcgacatggatttgaaggccctggagcacaagagccccgagcatctcgccagaaacccgttcgggcaaacccctgctttccaggatgggaatctaattctcttcgagtcgcgcgcaatttcaaggtacgtgcttcgcaaatacaagacgaacgaagtcgacctgctgagggaaggtaacctgaaagaagccgcgttggtggatgtatggaccgaggtcgatgcccacgcctacaacccagccatctcgcctgtagtgtacgaatgcctcataaacccgctcgtgctcggcatacccaccaaccagaaggtggtggacgaaagcatagagaagctgaagaaggtgctggaggtctacgaggcgcatttgtccaagcacaagtacttggcgggggatttcatcagctttgcggatatcaaccatttcccccacacttgctccttcatggcgacgcctcacgcggtcctcttcgactcgtatcctaacgtgannnnatggtgggagaa

SEQ ID NO: 100621 - DNA, 636 bp, Triticum aestivum
  unsure (1)..(636): unsure at all n locations
  Clone ID: PAT_TA_100621
gcacgaggagctaattcaacttgagaggcaaatggagcaaagggataaagccctagtgctcatcgcacggcagctgaacatgagactacaagcaggggagaagctcgcagaggaagaccatcaacgtctttatgcagtaatgacgagtgtgagaaatattctggatgaggaagggaaaaggatgaaagttccattgctagacctcttcaaaagagagcaggctaacagcaaagagctccaagagaatcgccaagagttgattcagggttttgagaacatgccgattagtgggggcgccgttgttggaatcaaaaggatgggccaacttgatgaaaatccttttcgcgccgcatgcaatttgaaatacaggggcaatgatccagagggcaaagctgcaaggttggtctcgtattggcaggaggaaatacagaagnnnatcatggcgtccgtttactaatattcaggtcgatgaagaagataaggaggttatagatgacaatgatccaagactaagcaagctacggtctgattatggcgacaacgtctgcaatgcagtgaaggatgcactgagngagctcaacgagtatagtcctgacaagcggcgcatcatgaatgnnnnctggaacttccgggnnn

SEQ ID NO: 100622 - DNA, 618 bp, Triticum aestivum
  unsure (1)..(618): unsure at all n locations
  Clone ID: PAT_TA_100622
gcacgaggacaccacgcaccaccgctctgccccccgcgccgatcgatcgatcaccatacgagacgaggagaggcccatggaggcgcacgcggctgtcccgcttcctcaaatggccggcgccgccgcggctaggtcctgcgcccgtatgagcagtgcccgcggttaggtgcgcgcgtgctcacgtacgtgcacagtggtcggcgtctttaccaacgttggtccatcatggccgggatgctccccggagtggagtgcgcgcggcggcggcggatgtggcagggcgggggcgcgggggccgaccaggcggccgcgggcacgaggcggctctccttctgcctctacgcggccgggcacggcgccgcgcacgccgtcggcaccggcagttccggcagcaagcagaggagcggcgccatggacgggtgggcgctggacagcaatgcccgggaggccaaggagcggctggaccagaagctcaagagcaatggcaccgggcccgacaccgtcatcaagnnncatcacagcacnnnnagcatcaaggttagcagnnnaaacgganncggcggcggcggtggcgnnnnnggctcgtcggcgnnnnnngcgannngcgtgcnnnnggag

SEQ ID NO: 100623 - DNA, 630 bp, Triticum aestivum
  unsure (1)..(630): unsure at all n locations
  Clone ID: PAT_TA_100623
gcacgaggcgagataaaaggaccttcacctgaaatggtagagtaccttggtatgcaaaacttgattaatgctgtaaaggaaagtgtcgggctaagcgaagggaaactgctatttggattcaaagccaatttatgtggaaagtttgtgtggggagcacttgacgatgttgtaatgggcggtgttagtgaaagtgcattccaaatccaaccaacaggaagtgaaactggtgaagcaactggattattcaaaggtaccgtgtctacttcaaataacggtggcttcactagtataaggacaaagaattttaccgtgcccgaggacctgtcggcatacgatggtgttgaactacgagttaagggcgatggccggaggtacaaacttatcataagaactagctacgaatgggatactatcggctacactgcaagcttcgacaccacaaagggcgaatggcaaagcgttagaatacctttctcttcgctgatacctgtatttcgtgcccgtaccgcaactgatgctccgccctttgatgcaagcaatatcactgcactacagctcatgttcagcaagtttgaatacgacggaaagctcaacccaacatttgcannnngtcaattcgagctccctttt

SEQ ID NO: 100624 - DNA, 638 bp, Triticum aestivum
  unsure (1)..(638): unsure at all n locations
  Clone ID: PAT_TA_100624
gcacgaggagcagcagtcattcatcactgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggnnngnn

SEQ ID NO: 100625 - DNA, 631 bp, Triticum aestivum
  unsure (1)..(631): unsure at all n locations
  Clone ID: PAT_TA_100625
gcacgaggccattccgagaaccaaaagatgatgttttggatgctgatcaaataactggcaaaagcagccctgtgaatgaaacttcagacatcgatatgagctccgatgctgcagagtgctccagcatgaacactaatgctggtgaggatgacatgacgactgaaggtggcatgctatttttcttgaatactgaaaggttcccgaaccagcgcatgaagatagaaatggatcaaactattacactttccaatttgcagaagcgtttgattgtgtctgtgagttggcaggataatggtctcaagcaatataaccttgattctttggattcgcttcctgaggtttacaagatcgtgctgtttacaaggagaccacaggaaacctgttccctgtatgcatgtcttgaagcatttataaaggaggaaccattgggcccagannacatgtggtattgcccaggttgtaaagaacaccgacaagctagtaagaaactagacctttggaggttaccggagatcctcataatacacctaaaaagattttcatacagtcgctacacaaaaaacaagctggatacatatgtggacttcccgattcatgatcttgacttgtcgagttatatccgcgacagaag

SEQ ID NO: 100626 - DNA, 555 bp, Triticum aestivum
  unsure (1)..(555): unsure at all n locations
  Clone ID: PAT_TA_100626
cccacgccgccgtcaagctctctttcaccctcccaggcccagggcggaggagcagagggagacggggagagctctgccccagctcgtcctcttcttccccacccctcgcgcgcgcgcccgcctcaaagccagcgtctttctgagctcttcttgatccaaccgcctcgtcctactctaccgcccctcggccctcctgcgatttgccccgcccattcccgccgcgggctgatgcgagccgccccggggctccgcttctcgggcagggccgcgctctagcgccgcgcgcgcttccgggtggcgcctttggggaggggggcaatgggcgctggcaggctgctggtcctgtgcctggcgctttgcgcggcggcggcggcggcgcagcgggggattcggcggccgaggacggtgtccgtcggcgcgctcttcacgtacgaatccaccattggccgcgcggcgcggctcgccatcgagctcgccgtcgacgacgtcaacgcggaccgcaccgtgctcgccnngnncaccctgaannngatcancnnnnacaccaactgcagc

SEQ ID NO: 100627 - DNA, 564 bp, Triticum aestivum
  unsure (1)..(564): unsure at all n locations
  Clone ID: PAT_TA_100627
gcacgagggagagaggcggctattggcgctgcagttcgctccgcaattggggccgcgggcgggctcatcggcagcgtggtgaataagctctccgataaggtggtggaggcgtatgttgccagctccgagctcggcctcaactacaagaagattaaacaggatctcatgttgacgcaagggctgctgcatgaggcccgaggggggtgagcgacaatcctggtctgcaggggttggtgcagcagctcagcggcaaggccgaccaggctgaagacaccctggacgagctccactacttcatcatccaggaccagcttgacggcacccggtagccggtacgcggtgccagatcttgctgatggcctatccggttttcttcaacatgtacgcggttccatgtactgactactgataagcaataaccgttagtaccaacaacaacaacaaaaacaagggtacgtatgtccttgtcgtaataatttgccatgctgtcagtgcataattctgaaatcaacnnntgagttactcgaatnnnnngcacgnnnnntgtactttgccgatgccaca

SEQ ID NO: 100628 - DNA, 619 bp, Triticum aestivum
  unsure (1)..(619): unsure at all n locations
  Clone ID: PAT_TA_100628
gtctatctccccacgattcatggccacagacggcggcgctcttcccgtgctggaaccgtcgatgcgccgtgccggaagctctacggttgaaaccggcgaagtaaattgctggaaccggctacttgatttgctacaagagagggttcaagaccttgcagccatggtggtgaaggtattttttgctgcaacccgcgagctgatttgctggaaccggctactggatttgctggatccagcgaagtttttgttgtgaccggcgacggcgacacatgtctttttgttgtaaccgctatactattttcatgccatcggtgatttgttttgctacaaccctttcattttttgctacattccttcacccatggcggtgtttgtccatggcggcaatggctttcttcttcgatgggatcggcaagcaatttttgatacaaccgacaagcaattttgcttcaaccagcatctttttttgctggaacctttggattttttttgctggagcctatgtttttccagagatgcaaagcaatttttgatacaaccggaaagaaattttgcttcaaccagtttttaatnnngctggaaccaggaattccaaagctgcaacaaccgaagnnnnttt

SEQ ID NO: 100629 - DNA, 638 bp, Triticum aestivum
  unsure (1)..(638): unsure at all n locations
  Clone ID: PAT_TA_100629
gcacgaggatttgatttcccaatacaatcagcagacgacgttaggaatcaaaacgatctacaggcttctctgtgtgttctattgcggatcatcatccataaattgagtaacttagttgacaactccattattcctgtcgctgctgacaatttgatgctcctgtttttccgtgtgttcaatcaccgcacttgtggttctactgtacatgacaaggctatgctagctactggtgctcttgcttatgccattggtcaagattttgagaagcacatgcctaaattattgctgaactatagtgaataccaactcacccctgtctctcttggggtactaggtaatatttgtcatgtcttggagcatcaaatgttgacatcctctgtgaaagttatggatgtttttaaaaaggctctctcaaacccgatgcttgatcggtctgtcaaaccggcaattttttcatgctttggagaccttgcccttgccataggcgagcattttgacggatacctgccgactgttatggaaatgcttaaagaagatgccgaccttggtattgataaagnnnatgttggttaccgcaaccagcttagntgggcaatctgcnnnncatacagtggtatactaaatggtnnnnnnnncnn

SEQ ID NO: 100630 - DNA, 635 bp, Triticum aestivum
  unsure (1)..(635): unsure at all n locations
  Clone ID: PAT_TA_100630
ctcgatctcttctgttcttctccgcgcctctctctccgctctctccaccatggccatggacacgctctaagggccgctgccctgctgcctcatcagctctaagtgctgctgcctcacaagctccacgcgaccaagctccacatgcgttacagcgctcgtcggtgacaccgtttctacgatgcggtggccgtcgatggctgcggcgcggcaacatgatgtctcccaagctccatgcgaacggtgctgcattgcagcgttcatcgatgaagctggctctatgacgcggtggtcctcggtggccgccagcgctgcgacacggtggtccgcggtggccgctggcgacgcatacctcatcggtgcttccagcggcgtgatgcagcactcgcgccgctgcaaggggcaccgggtgttgtgatgcagcgctcgttgatgatgtcggtgctgctatgcagcggtgctggagctacgacgggccgccggtgctacgatggagcaccgccgcgtcggtgtcatggctgtaatgaagcatcgccggagcttcaacgggctacccgcgctgcgttggagcactgccacgccgctgtcgcggttgcaatggagcatggcnnnnnccgcaacnnncngnnggtgctgcc

SEQ ID NO: 100631 - DNA, 660 bp, Triticum aestivum
  unsure (1)..(660): unsure at all n locations
  Clone ID: PAT_TA_100631
gcacgaggctcataagcccctctaggtagccaagcgactggaggtggccgtcttcttgctctccggcagctacgaccaccgccactctccggatggttctgatgccgtccagctctccctctcctagatttcttcaccaccagcctcctcgagcacccactgatctatccccgcactcaatttttctcgggagccaccttggcgaaacgcccaattcgcctccaccggagatcttcaggagacctcaccgctggcgactccgtccaccccggcaactaaggacagtacccacgggacggccccaacctcctgaactcttgggtggccttggtttttcgaacggtgccgccgtttgctggcaagcctcgccggagcgccgcctctgttctgccaaaggagaagacacgggcggctcaccagtcaaacctgactggtgggcccgtgggacccatggtcagcgagtcccacgtcactgcgcactgacttagtgagagcgtattctgcgaagtacgtctgctcccctggaaagcgtattctatcccaaaccgttttctttttctatttttatttaaaaatagaattttgaccaaagtttgactgcctctagtttttaaaccaaaactccaaatgagttgattcttnnnccgannatctttaaan

SEQ ID NO: 100632 - DNA, 553 bp, Triticum aestivum
  unsure (1)..(553): unsure at all n locations
  Clone ID: PAT_TA_100632
ggcactcgctgctcaccggcggcggtggagggacggccgacaaccaccgaaacccggcggctttcaggccatggatcggtcactgagtggcggtcagacgctcttattacttgttgtcgccaccctaaccctgcaacatagtgctaccgcttatgagtctgagtcctctgggagcatccgcatggcgcggcctgactgcccggacaagtgtggtagcgtcagcatcccgtacccgttcggcaccggaaaaggctgcttccaagaaccctttgatgtcacatgcaatgccactgggccatatctagcttcaaccagagttaggatactggacatcaatcttgccatgggtgagattcgtgttctgaacccacatatagcatgggaatgtaactacaccaacggcaccaatagcagcggttcggatggcttaacccttgatccttttcataagctttccaacaccaagaacaagttgatatcgatcggttgtgctacacttggattgatcttnnnagccaccannnncaagnaccnncttgagttccccattgtt

SEQ ID NO: 100633 - DNA, 641 bp, Triticum aestivum
  unsure (1)..(641): unsure at all n locations
  Clone ID: PAT_TA_100633
gcacgaggctcgctcgcaccaagaaatacatacataccacagccctactgcactctctccggttgatccatcggcctcgaggtgggatccagcggcagccagcggcgtcaaacaggatcggcacgaggagaaatcgtgaggttcggttgttgcgcggcgcgatgggcgtgctcttctcgtgtcccgtggaggacgacggcgaatgcggcctcgtcgcggcggcggcggcggcggaggagcagcagcaggcgacgttcctcaaggcctcgctcggctccggcaagctccggatcgagggctccctcagcttcaagcggctccagctggtggagcccaagatccccgtcgccacgccnnncgcggtcaccgcgccggtgcccgtgccggtgccgatgccgagggagctcctccggacgcggttcgccgacgcggcggtggcggcgtcggcggcgccgccggagagccccaagcacgaggcggctgcggtgacgctgcaganngtgtacaagagcttccggacgcggcgccggctcgccgactgcgccgtgctcgtggagcagaactggtgggagctgctggacttcgcgctgctcaagcgcagctccgtctcattcttcgacatcgannnncnnnnnnnngnn

SEQ ID NO: 100634 - DNA, 517 bp, Triticum aestivum
  unsure (1)..(517): unsure at all n locations
  Clone ID: PAT_TA_100634
ctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggnngccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagnnnnngtaccctgacgcctatgtccgcgtcatcggcttcgacaacctgcgccnnntgcagtgcgtcagcnncatcnnnnnnnnnnnaccgggttgc

SEQ ID NO: 100635 - DNA, 348 bp, Triticum aestivum
  unsure (1)..(348): unsure at all n locations
  Clone ID: PAT_TA_100635
gttttttttttttttttttttttttttttttttttttttgggccagngattattaactgggccgcaaccttacacccacccnnagggggggcattaaccacccttaacttttcccctgaaagttttggggcttttttataccgggattttttttttacattaaccccatccggggaaacccacccaaaaatccctttgccttcccttatttatcccgtaatgttcaaatgcttttaccatcttttcataaacccttttcatgggttcccacctgacttaacccctggggccccaaaccaacttttttgnnataaggttgcgcccttcaacttttttttttntcattcc

SEQ ID NO: 100636 - DNA, 443 bp, Triticum aestivum
  unsure (1)..(443): unsure at all n locations
  Clone ID: PAT_TA_100636
aagccccaaacaatttttaaatttgggcccctttttgaattgaaaaaaaaaggggacagttgggacccccaagggaaaaagggggggggggcataaaaccaaacggggtttccgctccccccctaacccggggggggaccagggggtccttccggggggaaggaaaacaaagccctgcatgttattggcacttggggggggttccggggcacggggaaaaaaaaccgttgccgtgggccctgccgttaatggggatcccattactgccgttggtggtgcctgcgtccctttgtttaagggggggtttttttaccccccatttgggaagggggtgaacatccctcccaaaagcaacccnttggggatttgggggggtccagcttacccagttgaccccccccgaggggccaannnggggctcanaaanatttccactagctttg

SEQ ID NO: 100637 - DNA, 620 bp, Triticum aestivum
  unsure (1)..(620): unsure at all n locations
  Clone ID: PAT_TA_100637
gcacgaggagcaccctcacagccacagacgacgcgcgaagcgatatcacgagtgagagtctaggggccatggcacagtcgatgctcatgtccggcgtcaacggcgtggcctccggcaggagcctgctgcaggcggcgcggccgtcgtcggcgtccacgcccttctcgcggctcgcgctctcctcgtcgtcctcggcggcaagaagaccaaggccgcgccggccaagaaggtcgctgcccccaagcccaagacggaggacggcatcttcggcacgtccggcgggatcggtttcaccaaggagaacgagctcttcgtcggccgtgttgccatgattggcttcgccgcatcgatcttgggagaggccatcaccggcaagggcatcctgtcccagctgaaccttgagaccggcatcccgatctacgaggcggagcccctcctcctcttcttcatcctcttcaccctcctcggcgccatcggcgcgctcggagaccgcggcaggttcgtcgacgagcagcccaccggcctcgacaaggccgtcatcgcccccggcaannncttccgctccgccctcggcctcagcganngnnngccgctgttcgggttcaccaagtcgaacgnnn

SEQ ID NO: 100638 - DNA, 588 bp, Triticum aestivum
  unsure (1)..(588): unsure at all n locations
  Clone ID: PAT_TA_100638
cacccgcgccccccgcgccgctcccacccggacgacgccctcgaccccgccgcccgcgcccgcgggcccaagcccggccagcgccgcccgcgcacggcctggatcccggcgccccacggcggcgccgacggctacgaggacgaggagggccaccaccactactacgacgacgccgaccagtccgactccgccgccgccgccgcccgggccgctagggtttcgggcagccgcgaggccagcgtcgacgagtccgacggcgtcgccgactggggcctccccaacggcggcgcggcctgctacggcggcggcggcggcgtcagggcctggctcgacggcctcggcctctcccggtacgcccccgtgttcgagatccacgaggtggacgacgaggtgctcccgctgctcaccctggaggacctcaaggacatgggcatcggcgccgtcggctccaggaggaagatgttcgccgccatccagaagctccgcagcaccgacaccgtgtcctgagttgggtgagaccttcagttcctagctagctagcttttnnnctctctccattttnnnnntccnctcnnatagnaagctagt

SEQ ID NO: 100639 - DNA, 652 bp, Triticum aestivum
  unsure (1)..(652): unsure at all n locations
  Clone ID: PAT_TA_100639
gcacgaggctctgctttcccttttcggcgggggcagcagcagcagcagcagcttgatcggagagggagggcggcggagtcgtgcgcgcgcgacggagcggagcgggcggccatggcggccatggccgcggcggcggcgaggtgcatgaacgcggcgtgcggcgcgccggccccgacggcggcgggggtgggcgagtggcggaagggctggccgctgcgatccggcggcttcgccgtgctctgcgacaagtgcgggttggcgttcgagcagcttgtcttctgcgatatattccaccaaaaggagtctggttggagggactgttcgttttgtgggaagcgtctccattgcggctgtgttgcttcgaagaattcctttgatctgcttgacagcggaggagttcaatgcgtgaattgcatgaagaatccaggagctcaacctgttccatgtcaagtggctccaaagctttttttacctcctcaaaataaccagnnactctttggtaaaagcgatgaatttttgccaggtagaccgttggagtcgccgtcccttatgctcgattccagaaatgatgatattgctattatagctannnncaatcatccattcgtggnnnaaaacttggannnnnnncaaagcagtancattttgnnnn

SEQ ID NO: 100640 - DNA, 635 bp, Triticum aestivum
  unsure (1)..(635): unsure at all n locations
  Clone ID: PAT_TA_100640
tttcgctcttttaattttacaggtgctctttgctgtgctgtggtaaccagtgaagttgagcaactgttcagacttcagactttagagttcagaccaagcaaattggcttcagacttcagttcgtgaggtatttacctgcttggctccaccgttaccttcccctcccttcctactgaaagtccggcaaatttccgctccgctcgccgccaatcggctccctgagcctaccaattgtcacagggtgctctttgttgtgctgtggtaaccagtgcagttgagcaactattcagacttcagatttcagagttcagaccaagcaaattggcttcagacttcagttcgtgaggtgctctttgctgtgttgtggtaaccagtgcagttgagcaactgttcagacttcagacttcagaattcagaccaagcaaattggcttcagacttcagttcgtgaggtgctctttgctgtgctgtggtaaccagtgcagttgagcaactgttcagacttcagacttcagagttcagacaaagcaaattggcttcagacttcagttcgtgaggtgctctttgctgtgccatggtaaccagtgcagttgagcaactgttcatacttcannnntcagaattcagaccaagcac

SEQ ID NO: 100641 - DNA, 606 bp, Triticum aestivum
  unsure (1)..(606): unsure at all n locations
  Clone ID: PAT_TA_100641
gcacgaggcgcaagccggctacctcagcacacgagcgcgcgcagcccgaaagctttctcgcgacaccgacctcacctcggactccacgtcgccatggtgccgaggctggagcgcggcggcggtggcgggttccagctccccaactccgagcaggagaactcgctcttcctccgcgcgctcatctccgtcgtgtccggggacaccggggcccccgccctgcacccggagccatcgaacccgccgtttgccgctgccgctgccgctccggtgcctgcgtgcggcaggtgcggcgcggacgggtgccccggctgcgagtttgccgctgcggcggccgcggcgacgaccgggtcgagcanngagggggaggagtgctcggccgcgagcttcgtgaggaacggcggcgtgggcaagcggcgggctggcggcagcgggagcaagttcaagggcgtgcggcnnnnnccgtggggcaagtgggcggcnnnnntccgcgacccgcaccgcgccgtgcgcaagtggctcgnnaccttcgacaccgacnnngnnnncgcgcgcgcctacgacgtcgnnnnnctngagtnnngcggccaccgcgccaagctcaacttc

SEQ ID NO: 100642 - DNA, 583 bp, Triticum aestivum
  unsure (1)..(583): unsure at all n locations
  Clone ID: PAT_TA_100642
gcacgagggtggctcgtatctacggcggcgtgagaggaggggtccgggatggggaccagggggcggggaggcgatggtgtgctcctcgatcctgttgcgtggcggcgtggtagaccgaaaccacccggatccgtccccgaggaggttctggggggaaggtggtggtaggtagccagcgccggcgccagggggacacccaagatttggcccaaacaaatcagtagatgtcttcattcaacgacccacaagccgacagcccacacagcatgccggctacaggcctacaactcagctgaccaccttgttacattgattcgttcgaccccaatccataccccaacctaacctagcgcgagcggcggcggcggcggtgtggccagtactacaagcagcggccaagggccaacggagccggcgacgggcgaccagatgaagaagggtgttagcatatttgcattgtgggaaagagcttcgaangcaaagaaaacatgttctacatctactgatctacatcaaaacctttgctggtcgtggattgcgccctgcacgtcgtttcgcaatgagccangatagaggttgttgg

SEQ ID NO: 100643 - DNA, 626 bp, Triticum aestivum
  unsure (1)..(626): unsure at all n locations
  Clone ID: PAT_TA_100643
ccgccgcaatgttccgcccaccctggcaacaccgtcgtcgacctggcccgtccagatcggccggcaaagcgctgccacccccaccctcttcatcaagcatgccgcctccctgcacccctaacccatgccgcccctcccgcaccccgagtccttgacccacgccgccacctagtcccctcgacggccggcacccgcgcgccctccgacccatgccgccacccagtccccatcggcgacgacctacacccacgcttctgacgtctcacgctgccacccagtccccatcggtgatgacctacaccagcaatccacgccgccgcccgtccccatcgatccactttgcaaccatgcccccacccagaaccgccgccccattcctcgagcacgacgctgcctcagccccctcaccacccatgtcgctgtcccaatcccccaccacgaaacctccccattcccttcgccattgccgcctctgcttcgcatcgcatagtagcacgacgtcttgtgtcaaaggagaaggtccaagtgaagtaagttattcattaacttgatttcacttgtgttctacatcaaagtgctccatatgtgatgcttcttactaaanngaatcccgtctcaacacatca

SEQ ID NO: 100644 - DNA, 619 bp, Triticum aestivum
  unsure (1)..(619): unsure at all n locations
  Clone ID: PAT_TA_100644
gcacgaggaaatgacagttcaatagtaaaaagggatgaaattccagcatcccctgcagacaaccagagtatattagtttctctgtcctcgcgttgtgtttggaaagaagctatatgtgagcggcctcaccttcttcgcataaaatattatggtaactttgacaaacctttaggcaggtttttgcgtgacgagctatttgatcagagcaattgttgtctctcttgtgagctggcaccagaggcccatgtttattgctatgttcacccccaaggcagcttaacaatatcagtgcggaaactcatagtgaagttacctggtgaacatgatggtaaaatctggatgtggcatagatgcttacgctgtccgcgcgataaagggctccctccagcaactaaaagagtagtgatgtctgatgctgcctggggcttatcttttggtaaatttttggaacttagtttttcaaatcatgcagcagcaagtagggtagccagctgtggtcattctcttcacagggactgccttcgtttttatggtttcggtgaaatggttgcttgcttcagntacgcannnnntcaagttcactcagtctatttgcctccgccgaaacttgattttacnn

SEQ ID NO: 100645 - DNA, 632 bp, Triticum aestivum
  unsure (1)..(632): unsure at all n locations
  Clone ID: PAT_TA_100645
ctctccttggcggtagtagcctttcccccagtcaggccataacctgatgcaggcctgggcgtccgaaagcgcctcgtcgccgacaccaaggcgcagccagcagagactcttgtttgcatatatggaggcgtctatgtcgtttggatcatcgaacttcagtgccatgttgtacataagtatagccgtgtcgtagtccttgatttcgtaggccttgttccgcagaaccctaagatcgccaacgccctccgggatctcttggagcgcacgaagggcgcctcggtttcgcggcgcctggaggaaggggtgcaaggaagaagccaggttctgtctgggccgtgtgatcaaacagtccgagggcagggctcatttgtgcaggcgctaggtagaggtcagccactatccagtggccagtnnnnaaacggtggagcggtgtggcgggagtctgatgctgtatagttgtgtttctggcgggctttgtggtttggttttgcgcgcctgttgttgtttaacgcgtcgtatagcacgtcgccttccccccaatgtgatgatcccccgccctgcatagtaccttttgaaacgggcctcgcctttcccaacgtcatcatcgcactatgcttatgaaaaaaaaaaaa

SEQ ID NO: 100646 - DNA, 620 bp, Triticum aestivum
  unsure (1)..(620): unsure at all n locations
  Clone ID: PAT_TA_100646
gcacgaggggaaagttaggatttgaaattgattgccataaaactgaatattattgattggtaatgtgctatcggctcctgcccgtttgtaacgtgtctagttaggaaaattttgaaaggtcatgaaagtttttattgtgagggtaaaaaaccaacgtcaggagatatgatggtgggatgtgagataaaaataaaccagacaaaaataaatcatggatactattcaaccaactcatccattagaagtagagatagcctttgaggtaatttagatttattaccatataattaccatattcgaaatttcctgagttatggccttagcatacctggattgatagcctttggagtaatttaaatttattgccatataattaccatattcgaaatttcctgagtcatggccttaccatatctggattaatttattactataattatcatatttgagatttttgagtttatagccttactatacgtggattaattgtgattgattaccataaatacgttgggtattgccggccaaacgagaaaagnnnaaaactgatggaaggggtggtgggnnntggaacgaaaaaaaccnnntnaaaaaaaccggacgaaagtggtgggactann

SEQ ID NO: 100647 - DNA, 649 bp, Triticum aestivum
  unsure (1)..(649): unsure at all n locations
  Clone ID: PAT_TA_100647
cgcgtccgcatcgcaccgcacaccaaccaaacactcgcctgccttccttccttccttgttcgttcctcgacgcacgcacgcagatctcatccatccaagccaaggcaggtcaggtctctcccctccccccgaatcttcttcctccccccccttgccccccgatccgatccccgtcgcgccgtcgcccagcccggccgtggcttccggcggggcgctcgctcgtcggcccaaagaacctaggtaccttttttccttcttggctgggttaggcagtggcttgatcagatccatggcaggtagctctagctgactaagtaacgggaggggggagacagctagttgaattcgacagcagtacgcatgccttgccggctgacacacagacaggaccaccagttctcctgcctgcgcctctactactgtaccatgtgttgttcctactactagctctagctctagttggggatgccctgttttctctgttttttctttatgtaatcttttctctgtttttcctttttttccgcatgatagatagatgaagctcggacctagatataagaaccatacacaactgcggatgacaaacactctctccaatttaatctgaaattgccatcatgatcctaacaaacactactcctcnnnn

SEQ ID NO: 100648 - DNA, 633 bp, Triticum aestivum
  unsure (1)..(633): unsure at all n locations
  Clone ID: PAT_TA_100648
gcacgagggaaacgaagtcggggtacttcttttcctcgaagagttgtcagaactgacattatggtcattgtttgcttcatatcgctcaccagatgactcctctttttctctcctagcagaaatgcttcgaacagtccaattgcttttggcactgattagttcttccaatgttaataaatgcttcccttttacatccagccaatataacttgaagagatattcccaactatttttatcatcaaaatcaaccatcacctttgtagcatcttggtctttggactctatcaacaatatagtggcatagcaagtgtcacagaagcccttgttccctctaacaccaaagaatttgccctgtttgacgcatgccttgcagagggagtaagtacaagtatagcacatgtactgtgctgccttttcacagctgctgcaaatgtgccaaccacaattccacttgccacgggagcggaaaaacgactcgtcacgcttgatgcaggcaggatggtacaccttggagcaacccctgcggtcgcaaaccacgnnnctgcccccgtcgaagcagataaagcacaccacctcctcgtcgtcattcttcttcactggctnnnnnnnngcnnncnnnnncaccgctccgnn

SEQ ID NO: 100649 - DNA, 595 bp, Triticum aestivum
  unsure (1)..(595): unsure at all n locations
  Clone ID: PAT_TA_100649
gcacgaggccaccacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctcgcccgcaacggcgtcaagttcggcgaggccgtgtggttcaaggccggctcccagatcttcagcgagggcggcctcgactacctcggcaaccccagcctcgtccacgcgcagngcatccttgccatctgggcctgccaggtcgtgctcatgggcgccgtcgnn

SEQ ID NO: 100650 - DNA, 640 bp, Triticum aestivum
  unsure (1)..(640): unsure at all n locations
  Clone ID: PAT_TA_100650
gcacgagggcgccgccgaagcttgggcaccctgccgccacatcgactcctccgccgtccgccgtccggtgcgacgccggagcatccgtcgcatgccggcgagctcaccatcaagcagcagcagccgcgccgccctccaactttgccttttccccgtcctttcctgctcctctctcacctctctgtgcctcgcctccacagggacaacgggacgccgccggcacgcggaatgatgccgccccaactggatccacaccctcctccatcgcctgctctctatcgtccgtcctcgcctcgaatcggtcgtgccggcagccgtcgttgccagatcctcgcgtcgccgcccgctgaaagatccagcctctcaccgtcgagggaggtaggaacgacggagccgtgcatgtgtcggcgcccatgtggtgcgtgcggatccaccgccttgcggagcggctgcaggcctgcagcgcgccctgcctcaaacaacacgcatgggcgacggctgagacgtcagaggagcttcagcaggatgtggtgatccaatagtactccttccaatacaacactaaactatgcaaagtggccctttctttcccctgcccagttccaatctttgatccgtccatgtcgnnnnnatgtgtnnn

SEQ ID NO: 100651 - DNA, 267 bp, Triticum aestivum
  unsure (1)..(267): unsure at all n locations
  Clone ID: PAT_TA_100651
aaaaaaccaaaaaaaaaaaantnnncaaagtgaaaacacacacacacacacaccctctacccatatattcacagctccaaaaaaaatttcaaggggaaaatttaaaaagcgggggttctcctttttggagaactccctttttgaaaaactaagtaacaaaaagagacccagaatactcgagctaaatgtcccatagggtttttcacaacggggcgccccccaaagaagaaaaaaaacatngaaaaaaagagaatctcacatatgagc

SEQ ID NO: 100652 - DNA, 602 bp, Triticum aestivum
  unsure (1)..(602): unsure at all n locations
  Clone ID: PAT_TA_100652
ccaaagtccatagcaccgcacctgcattcgacgatgaagccttcggcatgattagcacagccagccatctctggtgtgtgacgtcgtctcttcagacataatctgcaaattgaatttgattctctttttgaagactcaaagatcaaataaaacgaaatactgaggtgaaactgcaaaatggcagatgctgctctccttcttgtcacaaaaaaaattggaaaagcggtggcagcagaaacactgagttatgctagaccatttcttgaaaagaaatctagatctattaaagcgctcccagataagatgatactgataaagaatgatcttgagcttatccgagcatatctcaaggaagttgacaggaaaggtttcacagatctagtcactgaaatatggacagggcaagcccgaaaattggcgtatgatatggaagacattgtggatcagtttacttatgtggttggtaaacaccatctagatggagcatggtggagtttcttcactaaatctcnnnncccgtttacacttgatgaaattgctactgcagttaagagaataaatnnnnnactgaaacggcttnnnnnatgcagagactggactca

SEQ ID NO: 100653 - DNA, 622 bp, Triticum aestivum
  unsure (1)..(622): unsure at all n locations
  Clone ID: PAT_TA_100653
ctcctgtagaatatacaaccagtgaaatcattgatggcaagccggttaatactgttgaagggctcaaggtttatgaaggtttggtaaatgtgactgagataaacaagattgtttctttagttaatgaaacaaaagcttcttctcgccgaggagggttcgaagtgggccagactgttattgttggtaaaagaccactgaagggtcatggaagcgtaattattcagctgggagttcctatcattgaaggccctcttgaagatgaaaatcaaagagagacaacaagggtggagcctgttcctgggttgctgcatgacctgtttgatcgcttctttcggcagggaattgtaccttttaagccagactattgtgttgtcgacttctactatgaggaggaatattcccatcctcagcaacctccctcttggtatggtaggccactttgtaccctctgcctgacagagtgtgatatggtgtttggccgagttatttttggagaacgaggcgataacagnnnccctttgaagctctctctctctacagggtctcttgtagttttgcaagggagaagtgctgatgtagccanncgagctattcctgctacacgtaagcagcgaatccttct

SEQ ID NO: 100654 - DNA, 429 bp, Triticum aestivum
  unsure (1)..(429): unsure at all n locations
  Clone ID: PAT_TA_100654
gcacgaggagaactagtctcgccgctcaagctccacatgacccatcgctccgccgccgcgggcgcgacggggacgggcgccttcttcctcgactcggccgagaaagacgccgtccgtatcgatacgatgcataggagagtcgccctgtctggctccggcgcggcccagcggggctcggggccaagaagggcgttgtcggagcgggtcgtggccacggtggagtccggcgtggcggtcggctcgggggagtacctggtggacgtgtacgtgggcacgccgccccgccggttccggatgatcatggacacgggaagtgacctcaactgggtgcagtgcgcgccctgcctcgactgcttcgagcagagcgggcccgtcttcgacccggcggcgtccnnnctcctaccgcaacgtcacctgnnncgannngng

SEQ ID NO: 100655 - DNA, 639 bp, Triticum aestivum
  unsure (1)..(639): unsure at all n locations
  Clone ID: PAT_TA_100655
gcacgagggcggatgacaaacactgcaatttaatctaaaattgtcatcatgatcctagcaaatactcatcaaataactgtaaattgttgcatgattagtgtctagtgtagattcaaaataaggttgcacttctagaggagataagccactgatgttggatgcttggtaattgtcttgtgttgtgtgcatgtcggtactagcagtatgttcatgagcaacaagcatatgatttgtgcctgtgctctactgtattggcctcattggtcatggctgattgacctggattatagcttattccttcagcgtactatctctttctcaagtcaactcaagcaacaattcatactaaatagcacttcttaattttcatgcatacttgctccagctcttcttaatttttatgcatgtttcttttcggacttgatcatactaaatagcacctgattcatgctgtttgatgaactagtacccgcgactagcagggaacttgcaaacttaagttttctcaccagtagtcacttatcctgttgttcatgtccatacaacatttttcctggttctatgttacagctgctgcaaacaatttattaatgtgggatgtggctctatgtcnnnntctgtttctcttgtaannnantn

SEQ ID NO: 100656 - DNA, 537 bp, Triticum aestivum
  unsure (1)..(537): unsure at all n locations
  Clone ID: PAT_TA_100656
gaaaatcctcgaccgatcggaagacaagcgcccctcacgctccttcaagatgcagatcttcgtgaagaccctcaccggcaagaccatcacccttgaggtcgagtcgtctgacacgatcgacaatgtgaaggccaagatccaggacaaggagggaatccccccggaccagcagcgcctcatctttgccggcaagcagctcgaggatggccgcaccctggctgactacaacatccagaaggagtccaccctccacctggtgctccgcctccgtggaggcatgcagatctttgtcaagaccctcactggcaagaccatcacgctggaggtggagtcctcggacaccatcgacaatgtgaaggccaagatccaggacaaggagggcatccccccggaccagcagcgcctcatctttgccggcaagcagctggaggatggccgcaccctggctgactataacatccagaaagagtctaccctccacctggtgctcnnnntccgtnnnnnnatgcagannnncgtcaagannctcaccgnnna

SEQ ID NO: 100657 - DNA, 593 bp, Triticum aestivum
  unsure (1)..(593): unsure at all n locations
  Clone ID: PAT_TA_100657
gcacgaggcaagaatttagagtggtttcattagtctcggagggtgacatgcactgtgatctgatcaacggattccagatgacatggagaagaactcgcatctcaaggatctgcaggcgctcggccccttggaggtcctccgtgcagacctcgtcgaagagggcagcttcgacggcgccgtcgccggctgcgactacgccttcctcgtcgccgctccggtgaacctctacgcagaggaccctgaggtgaacggcaccaaccaccacactcactgtcgttttgtcatcagttcgtcaagtgcacctgtacacggcgcgcattattcaggctgtcggcacactgcttttttaattcgtcccgcgatggcagagagatgtgatcgagccggccgtgcacggaaccctcaacgtgttgaggtcgtgcgtgagagcgggcacggtgaggcgcgtggtcctgacatcgtcggcggnngncgtctccagccggccgctggnnngcgacggccatgtcctggacgnnnnntcctggtccgacgtcgagtttcttagatcgnnnaagaccggtgcttgggcgtaccctgtgtcnnngnngctt

SEQ ID NO: 100658 - DNA, 631 bp, Triticum aestivum
  Clone ID: PAT_TA_100658
gcacgagggttcaatttagaaggaactaaaattcaaagaaacatcaattaataaaccaacaatatggtagtaaaaccaaacttcaataataccaatacatcataaagtctggatagtttgataataccaaaacatcataatttttttaaatgtacgtgtatatatgcctgcgttgggattgcacgaggtacagaaggcttagttagtttttccaaaataaaaatatactgcgtgcgtgccttgtttacttttctggctcccgtgaaaaaaggaagggtgggggagagatggacgaaggacgacgacgtaagacaaaagacggaacactacattttcaaggtatactgtagacgtagaatacattattcatattgtcaaaaggataattctcaaaggtccatgataattctcaaactgtagtagccatttatttgcgacatttcaatatgcattagtgcatagtcagccgtccaaaaacctcaaggccgctctaatttcatctggcatacttctagtgtccattgttactcgcttgaacaacaccattgacgtacgcacgtatttcatcatgtgtcatgaggctggcttcatggatatctacgataaaaatcagtgctatatagtagtgaca

SEQ ID NO: 100659 - DNA, 612 bp, Triticum aestivum
  unsure (1)..(612): unsure at all n locations
  Clone ID: PAT_TA_100659
ggtacaggcgacagttaactgcatacctatcaacccgtcaaaaaaatgcatactccctccgtccgggaaaagttgtccgcgacttagttcaactttaattttgcgaaaaaccctttctacgttttaaactgttgcaaatcagcccccctcagcttcttcctccttcctccgtcgcccgatccatccaccgtccggcccccgccagcgaggccctggccgcgctctcccaccgccccgctgacctgcccgtggacttcgccgccgctgtcggccacgagatcgccgaggaggacggccgcgtcgtcgagggacaggagcagcacatccgcgtcccggaggagggaggagatcgaggggctcgagcacggccggcgagcggggcagcagcatcgcctccagcgccggcgccgcctgcgtcatcgaggagcccgaccccgactgcggctgctcctccgaggagcccgaccccgactgtagctgctcctnnnnncggcctcctcatcgacgggcgcctcctcctcgtcgctctcctcgccggcgcaggttcctcgtgcctgcagcaaccccagccgnnnntccctctccctgactttggcaggcagggcnnngcgg

SEQ ID NO: 100660 - DNA, 518 bp, Triticum aestivum
  unsure (1)..(518): unsure at all n locations
  Clone ID: PAT_TA_100660
gcacgaggcaaaagggttcttattttcactagaggcagatacgcatattgttagatgtgtggggtacatgtgtttcatggacttccacctatgatcaatgctgtaagcctatagggggtccaaccagttagaacgttttcctttccactatcaacttttggaccataagttctacaaatcgtaagttcaaagttgacataagcttaaacctacctgatgggttgtactggcattattagcactcaagtatgctttactccgcatgccagtttcaacaaacaagacagctaagacttgttcagcttgtaaaaggccaggagctacttcccctgattttggctcagctgttgcttgtgcataagcctgtttttggctaaccgcacaaaaccatnnggccgtgctggcccatgcccatacatggtttttataccattagcaaagatgggtgcataccatgaacatccagtggtnnnatatgccnnnatcnncccaccgannnaannnttgagnnnnnnnnn

SEQ ID NO: 100661 - DNA, 436 bp, Triticum aestivum
  unsure (1)..(436): unsure at all n locations
  Clone ID: PAT_TA_100661
gcacgagggagagaagaaagctacacaagatgaagcgggactactttcggcagcacggtggtctgatattatttgatgagatgaggtcaaagcaaggtattacattcaagatcttcacggaagaagaactgcagcaagccacaaacaagttcagcgaacaacaagtactaggtcaagggggctatgggacagtgtacaaggggcttcttaagggcgacgtggaaatagctgtcaagagatgcaagacggttgatgagcaacagaagaaagaattcggaaaagagatgttaatcctgtcccaggtcaaccatagaaacattgtgaagctcctcgggtgttgcctcgaagtgaaagtccctatgctggtatacgagttcgtcccnnncggcaccctcttccagttcatacacggtaaccatggcatgtgtatnncnnt

SEQ ID NO: 100662 - DNA, 654 bp, Triticum aestivum
  unsure (1)..(654): unsure at all n locations
  Clone ID: PAT_TA_100662
gcacgaggcaccattgccgcccgcagctatccggcgacatgggtctgcccatggcgcgcggcccgtgctgctgctcgccgtcatcgtcgtcctcctcctcctcgccgtggatgctgcaggcccagctccccaagaacccccaccctccactgagtgggaggtcagtttgctctgaatcgttgagagttctggccctgcatctcttgctcaatcggcgcgctaatcttagccggcgctggggtgacatcaccagaactgctgcatcttcatccggtttgcttcagataacagggaacatgtcaggctgctcaccaaaaataaaggtggatgccgaaagaacatcccttgatggtgctcttgacaggaatgcgcagttcgacatgatctacgaggacatgtcttcttggatgaatggggcacacacaagtggcaacagtttgcagtataacttgttgatgcaaaacatccatgtgttacagagtagtttggctgctcaagatttggtgttgctggagagagatatccttgtacatattgaacagcttggagctctgaaatggtttaacgcgtcgnnntccggtgccaccataacacatacctcacatgcaccagnnnttgcactcccttggaatgatactgaatttgctccgnnnn

SEQ ID NO: 100663 - DNA, 582 bp, Triticum aestivum
  unsure (1)..(582): unsure at all n locations
  Clone ID: PAT_TA_100663
gcacgaggctcccgcgtaccaagccaccgaccaacatggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcattccgacatgagggaggtcgcaagcaagtgcgccgacgccgccaagatggccggcttcgccctcgccacctctgccctcctcgtctccggcgcgagcgcggagggggcgcccaagaggctgaccttagacgagatccagagcaagacctacatggaggtgaagggtaccggcaccgcgaaccagtgcccgaccatcgncnnnnncgtcgactccttccccttcaaggccggcaagtacgagatgaagaagttctgcctggagcccacctacttcaccgtcaaggccgagggcatccacnagaacgagccnnnggccttnnnnnngaccaagctcatgacccgtctcacctacacccttgacnngatngnnnnnnnactcnnnntnnncgcnnnnnncacnctcaagttcg

SEQ ID NO: 100664 - DNA, 613 bp, Triticum aestivum
  unsure (1)..(613): unsure at all n locations
  Clone ID: PAT_TA_100664
gcacgaggaacccccggctgcaccagctcccattcctcgccggcgagctcaccggacacagcccgaagccaagatggtaagcggatctagacttctccaccttgtttgaaaggatgcccccttgtcgggacgagtcggtgctgatcggttagcagcggatccggatctggatctgcgtatgggatcctcgccttgacacatttggatacgatcccttcgtgttctcgattctgatttggtcctgatgtttgcgcttggttgggagaaataggttctatcattttcgtggatccgcgtgatacgttggttttgtgcagttgtgggctagcagtgctcggagcgctggatttaccgttagcatcgagccttttacgggaatcggatgctgttgttttatttctcgcggcgaggatggatcaggaataggtagatacaggggttatttgagtcgaatggcactggaaattaggtatttatgttctccgtcaagtcctcataatggggagattggatgatttgccacgatttattccgtcttggataattagtactaatgaattagtgatgactcttnnntagnaatgnnntatttgtatttgctattgcnnncnga

SEQ ID NO: 100665 - DNA, 619 bp, Triticum aestivum
  Clone ID: PAT_TA_100665
gcacgaggtacaaaagcagctcagtttttgtaggcatagcttcatctcatttcctcctcatcttcatttttcacagaaatgtttgaagctttggttgcagctctgttgttctctgttcttaactatggaatcaacagagccacagcaagtggtgatggagatttcttccataactgcacaccatcaaggtgcagcgaagaaggcacaatagagatccgatttccgttccgccttgcaaccagcccccaatcgtgcggagcacctggcttggagctagcatgctctagggaagcagataccatgctacttcacccaatccttggactatgcaaggtcactgcaattgactacatatttggtggccttaatgtcatcccgcttgaagaatcatggactaggtgcccgcttcagaagatctctaccaccaatctatcaactagtgtatacatacctgacagttacggaggtgaaactgcaaacctggtacgctgttcaagagagttgataccaacagagaaggccggtacaataccaggtatgggggacaatattgttggcccaatctcttgcctgagcaacacaagccagttcatatatttgatggacggtagtgaaccac

SEQ ID NO: 100666 - DNA, 638 bp, Triticum aestivum
  unsure (1)..(638): unsure at all n locations
  Clone ID: PAT_TA_100666
gcacgaggcttgttcttttgcccaatcaaacgaccttcaactgttttgttggttggtagctgattcgtattgagttttttaatttgtgttaagagataggttagtagtaggccatgacaaaattaggagaaatatttcaaaataatgtggcaatttctgtggagtgacacgacaaataatcatatgatataattcatattcttttgtctactcacactttccatttatagataaattttgaatttagtcgcatggaattttttcctaaagtgacacaacacatgttttcagacattgacatggcaattttcttaaaagtaggttactcaaacatgacatatttcaggtagcgaccttgccatgcccctaccaagtatatggacaatttttgccatgatatttagacagtgacctttgtcatgaccctactatgtagacaatgtcaaatatgtttaacatcccatggaaatctattttatttaaatagcatggcagattcatatatgcacagttgtcatgatctttcggagctagtttggccatggtatttactgttttacattcttttcttcaaggaagaaatatatgcatggcaaaatttcttttctgcaccatggaaatnnnagtttgtgcannnn

SEQ ID NO: 100667 - DNA, 629 bp, Triticum aestivum
  unsure (1)..(629): unsure at all n locations
  Clone ID: PAT_TA_100667
cgggaggaggaggaggaggagctcctccgatccagctcgaccggattgggtttggattggtttggggtggatcatcccgcgccgggagatgtgttgagcttgttgtatcgtccttgttcgctagtccaagcaatgggagaccttcccgatctcgaccgtgctcaggcagccggcgcgggccggcgggacaggctcgcggcgctgctcgagctcgctgcggcggacgacgttgatgggatgagggcggcgctcgagggagctggcgaggaggcggctgagctggccgatgacgtcgggctctggtatggccggagcaaggcgtacgagccgcgcacgccgctcatggtggcggccacgtacggcagcgcgcgcgtggtctcgctgctgctcggccgcgccggctgggtcgatgtagctcgtcggcctggcggcgatggcttcaccccgcttcactgtgccgcctccggcggctcctgcaacgccgtccaggtcgtcaagatgcttctggacgccggcgcggacccagctactgtcgactccaccggccgcgccccggctgacgtcgttcgggctcatccggcttcggcagacgccctnnncgatcttgagatacttcttggccgccgccg

SEQ ID NO: 100668 - DNA, 637 bp, Triticum aestivum
  unsure (1)..(637): unsure at all n locations
  Clone ID: PAT_TA_100668
gcacgaggcacacggcgctcccctgagcccgagtcttcctgaacggcctcctctgttcgtccagcagttcagagtttcagaccttgagagttcacacacacacgccgcggcttgatggtgggcggcgccatggaggacggagcgcgggaggtggagcggtgggaggggtacgtggactggaggagccggccggcggtgaagggccggcacggcggcatggtcgccgcctccttcgtgctggttgcggaggtgcttgagaacctggcgttcctggcgaacgcgagcaacctggtgacgtacctgatgaagtccatgcactactcgccggcgcagtcagccaccacggtgaccaacttcatgggcacggccttcctgctcggcctcttcggcggcttcctctccgacgccgtctgcaccacctacgccgtctacctcatcagcgccttcgtcgagttcatgggtttggtggtcctgacgatccaggcgcggtcaccgtcgctgatgccaccggagtgtaccaaggctgctggcgcgctgccgtgcgagccggtgtctgggggtaagannncgatgctgttcgtggggctgtacctgacggctctgggcatcggcggcatcaanngctccctgnngtcgc

SEQ ID NO: 100669 - DNA, 260 bp, Triticum aestivum
  unsure (1)..(260): unsure at all n locations
  Clone ID: PAT_TA_100669
ttttttttttgantaacaaatatgaatggtttattgaaaaaaaaatcaagtttccgtacttgaaattattccaccngtgcaaggacattcattcaacactggtacaaagaaatggacnnncataaaaaaaatntnggctgcccaactaaactgcaaaaaccngntaaacggagaaaaaacaacacacccccgcaaaaacaactactaacangnnnaaaantaaaaataannggccaaacaannnnaacaaaacnnnnnnn

SEQ ID NO: 100670 - DNA, 640 bp, Triticum aestivum
  unsure (1)..(640): unsure at all n locations
  Clone ID: PAT_TA_100670
ccaaagtgcattggccagcagtttggcattttacaagatcttctagagagatctgatgatgcggttcaaagcactaatgatgctatgctgtacactctttccaaggaagaattgttagaattatttgaaacagtgagcgaccaactttcacttgtatggagtggattcctgaagtttcataggacaaataaattaaagatactggattacttgcatgatatttgggatgttgatcggaaatcagaatggtcaatatggattgttcattcaaaaattgagattccacatcgttacatgcacggtatgggtgacagttcgtctccccgccattcactccggagggtttccagctcaaagaagttgcatcatgatcctgtacagaatgcttcttcacgagctgaactccacagaaaaagtattgcgcaaatgaagattaacgcacggtctgttcaagatatgcatatctatgctaatccttcacgtgttcctgttgttcttatagaacaacatgtcatggtcgttccacaacatggttgtaacaaggatttgttggcaaatgctccagatctgtataatacttctgtaccacctaacctacaaggagnttcttttgcnnnnagtcctagcgntggtaaaaacg

SEQ ID NO: 100671 - DNA, 614 bp, Triticum aestivum
  unsure (1)..(614): unsure at all n locations
  Clone ID: PAT_TA_100671
gcacgaggccccaatccatccgctcccactcccaacctcgccggtcgcatccgaaccccgccgcgcgccgccggccccgcccgttcgtccgaggtcagaagccaaccgccggcgactgccggccgtcgcgaaccctcgacgacccccccggagatttcgcttcgattccaactcgaacccagctcgcgggaggcggtttcttcaagggtttggactccgagccggggatgtacggacagggagggggctttaatccacacttccgtcatgccgcaccaccgccgcctccgccgctgtcgcagcaaccgctgccgccaccaccgcctcgaccacaagctggggtgacggctggcttccctcagcagtcgctaccaccgccaccgccgttggcgcagtacccgcagcccccagcaatgcgtccaccgcctgggcagtaccaccagcatggcatgctgccacatcagaatcaggcctatccctatgcccatctcggtcagatgcaccacatgccaatgctcccacannnnnnggnnnttgggcatatgcaaatgcctgggccgccgcaagccatgtatcagccccctccgcagtatcccatgccagtgcctctccnn

SEQ ID NO: 100672 - DNA, 594 bp, Triticum aestivum
  unsure (1)..(594): unsure at all n locations
  Clone ID: PAT_TA_100672
gcacgagggtgatgttgcatcagaaccttttgtttcttctttggtcaagttacatatgtatcaagatgtgagttgctaaatgttcatgtacgtctcatggatggacactaccttgcaggcttaatggttttggttcacgtagaagagatccatccttaggcttaatggtttcttgatcttcactcctatttctcagcatttttgtttatcctcaaatagttcctgcttagctcgtttgtcacttgtgcttgttattattctggatgttaagtgggtgaaatagttggtgatgtttagtgtggaagccactcaaaaccgttgtatatagttgcatttgagatttttcgtccaacgatgtgttcaaatttatacaattggatttccaaaaaaaatcccgagtctttgttacacaaagacaagatcacaagaaagggacttttagtcattagtgaatcctacatttgttttagcccttctgttggcagtataccgatctgattacacatatgtgtgaaacaaaattgaaatactcaggtttggtattgttctcttctgtttttcattgggtttnnnatggcttaccgcccttacnat

SEQ ID NO: 100673 - DNA, 602 bp, Triticum aestivum
  unsure (1)..(602): unsure at all n locations
  Clone ID: PAT_TA_100673
cttcctcccacacccgctcccgctccgctccatccatcctcccgatcaccgccgaattcccccacctacccccgccggccggccatgggcgccgccaacagccgcgaggacctcgacctcacctcctcctccggcgaggaggaggaggaggacgccgacgaggagtacgaccccgggtccgcctccggggccaagcagcgtcaggacgacccgctccgggccaccacccccgcctccatcgagttcctcgacgccaagctccgggccctcgacctcaagtacaagcagcccgacaacgctgcccgcctctacctccacgtcggcggcgcctccgccgacgcccgctgggttcccgccgagcgccgcgccacctacgccttcctcgacaaggcggtcgccgtggacgacgacgactactacgacgacgagcgccgcggccgtcgctccttgtcctcggcctcctcgcgggggccccggtgggtcctcgaggtggacccgggccggcgggtctcggcgcccgtggggcaggagctgcagctcaaggcgctcccggggcagcgccgggcggacttcgcngcggcgggctccgtgtngggcgctgc

SEQ ID NO: 100674 - DNA, 616 bp, Triticum aestivum
  Clone ID: PAT_TA_100674
ctagctcgccaacagttttgtcctcttgtcgcgctctctctctctctcggccgacgaccgaagtcgcacggcagagcaccgccgcgccgcgccgaggagggggaaggggaggagatgacggtggggatgatcaacgcgaacccggtggtgcacgagcggccggagcgcgccgcccaccccgcgcacgcggcgctcgacgcgctcgacgtcttcgatacggtgcgggacatcaaggacccggagcacccctactcgctggagcagctcagcgtgctctcccaggagtccgtctccgtcgacgacaagctcggccacatccagtacgtatgcctgcaagaatgtgctgctcaagtttccttctgattgtcagggtaccaaattgccaaattagcaggggctgggactaggaggtggtagtacttggtgttaatttccgataatttccaatgttcattgctactcctgcagtgtcctgcacccgttcccccatcagccccttccagtattagaagccagaatcattgtggttttgtagtggaaatgtagaacccgtgcccggttcacgcagtccggctagccagatttggatttacgcccgtgacaagatgattattat

SEQ ID NO: 100675 - DNA, 409 bp, Triticum aestivum
  Clone ID: PAT_TA_100675
gcacgaggcaggagaggagaggagaggagcacaggagagccagggagctcgctcgctcgctcgctcggccccggcggacggagaaaccccaccccaccacagcagctcgccggccgccgccggaccttcctccgcttcccgccggtaatccgtgcccggctcgaccccgcgcgcggcctctcccgtgctcatgcttcggtcgattcccctccccttccccgggatgaatttcgtttttattctctcctccgctcgatttccccccaggtccgctcgaattcccgggccctcgccgccgcccgcgccggaggagaaggaggaggaagcgggaggagcgtcggggttttcgcttggcttgctccgtcggtacggtctgaggccgcgggttttgcttcgcttgctcgggttg

SEQ ID NO: 100676 - DNA, 594 bp, Triticum aestivum
  unsure (1)..(594): unsure at all n locations
  Clone ID: PAT_TA_100676
gcacgaggctctcttcctctcctcgcagagggaagaagaagaagaagcccgattggtcacccctctccccgaatgggaggtcggtcgatcccgcgccaataagcagcacctcggcgggtgggtgggtggccggggggattgcttcgctcgccccgctccttccttcgatccagccgatcgatcccagtcgaatccaatccaatccaataatttactctacttctcctcgccggccgccggccgccgtcttcgcttcgcttggacctcccacccggttggttggattttagaaagtttctcccgttctatccatccttctggtccattcagtactcagcatatccgtttgccttcgatcgagcaagaatatatacgcagccggctcgtgccagacatggagcacgcgatgccgacgatggccgcagagtccgagggcgcgaccaccgacgacgacgtgcacctttccccgaccagtgtcagcagcggtggcggcggaggaggaggaggcccccccagcgtccgcttcaagatactctgcagcttcggcggccgcatcatgccccgcccgtccgacggcgcgctcaagtacattnn

SEQ ID NO: 100677 - DNA, 614 bp, Triticum aestivum
  unsure (1)..(614): unsure at all n locations
  Clone ID: PAT_TA_100677
ctcccgcgtgccaagccaccgaccaacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaaaggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacnngntggaaggcccgctcgnnntcggcgccgacggcaccctcaagttcgnnnannaanacggcatcgactatgcgnnngtcaccgtgca

SEQ ID NO: 100678 - DNA, 611 bp, Triticum aestivum
  unsure (1)..(611): unsure at all n locations
  Clone ID: PAT_TA_100678
ctcttgagcttactccattttatgcgcccactatacttcccttaatccaagcgcaccactacaccggccggttcatctgcgatgccggcgccgacgccaccacggaaccagcccaagcgccggcggccgcttgctctccccgcggtctgcccgtgcgagggcatcgcgccggagccactcctcgcctccgtcgtctcgctcacggccgatgtggcgagccgcagggccggcgacgccagcgccttccccgtgctccgccgcggcacgcgccaagcagtacgcctcgcgggcctcctgctcgcgttcctcgaggagatccaggacgcgacggcgacgctgtcgtactccgccgtggtcggtctcacggagctgcacgtcgccatgcagaagatgaggttcctgctcacggattgcgcgcgtcgagggggccgcctgtgggtgctcgtcaacgctgaactcatagcgtctgagctcaagctgtgtcttggatccgtcgcggcgnnnntggacgtgctgccgaggtgcatcgtggatgcatctgtggagtcgggggagctcgnccggctggtatcggatcnnncgtggnncgtggtgggtgcggcctgacgccg

SEQ ID NO: 100679 - DNA, 430 bp, Triticum aestivum
  Clone ID: PAT_TA_100679
gcacgagggttcgaacttgtctaatcttaggtgtgacaacctaaagcaaccttagtcacagactaaacaacccctactactttaaataaaaggaagaaatccttccgcacatgcattcaacaatacactgctatggtaaaatatattcgcatgcattatgctatacgcacttattagtgatcagctccccctcaacagtgatcaatgttgttatgtaccaagggccctaggcaatcccacattttctttgtgttcggtctaggacacaatcatgaaatatgtataaattaggggaactgctaccttgcccgccatatgatctggctcttgctccagaacttccatctgaactagctagacgtggtgaaatggtcacaacagacaagtagcgcaggctagaaacatctcgatacgtgcacatgtataggcc

SEQ ID NO: 100680 - DNA, 495 bp, Triticum aestivum
  Clone ID: PAT_TA_100680
gcacgaggatctatactgaccatgagcttaaagcaatggtggaacgcatggaatcatcagaacttaagactgtgaaccttactgacaatgatctcgcaaaagaccacctaagatactttgtaagttacatttttctgccacagtgataggctcatatcccattaacacattattttggtacagttgacaaaataccccctctgtccaatattaattggcgctcaaacagatgtttctagcactaaaatacatctagatacatccgtttgagcgtccatttatatgggacggaagttgtaattactaccagtcacattatggtaatatcacggtttacttgatgaatattccatttgcaacatgctaggatgatttgcgaactgttctaaaacataaatgtaatgtttggatgaatttgagctgaatggatataatcaactctattgtctttccatcatagagcataatgttgcaaacttcattaaattcatttag

SEQ ID NO: 100681 - DNA, 465 bp, Triticum aestivum
  unsure (1)..(465): unsure at all n locations
  Clone ID: PAT_TA_100681
gcacgannnnaaaaagcagagcgaaggaggagagaagcttcggagctcgggatcggcgatggagaccggagcgaaggcgccgaagaaggccgggcgccgggccggcggcggcggccccaagaagaagtccgtctcgcgctccgtcaaggccggcctccagttccccgtgggccgcatcgggcgctacctcaagcacgggcgctacgccaagcgcgtcggctccggcgcccccgtctacctcgccgccgtcctcgagtacctcgccgccgagctcctcgagctggcggggaacgcggcgcgggacaacaagaagaaccggatcatcccgcggcacgtgctgctcgcgatccgcaacgacgaggagctcgggaagctgctggccggggtcaccatcgcctacggaggcgtcctgcccaacatcaaccctgtgctgctgcccaagaaggccgctgcggcggctaccnn

SEQ ID NO: 100682 - DNA, 493 bp, Triticum aestivum
  Clone ID: PAT_TA_100682
gcacgaggcaccagttcatctcactgagctcgcaggcagccccagccaccagcgaaatggccgcgtcggcgctgcaccagacgaccagcttcctcggcaccgcaccgcggcgcgatgacctcgtccgcagcgtcggcgacttcggcggccgcatcaccatgcgccggaccgtcaagagtgcgccccagagcatctggtacggccctgaccgtcccaagtacctgggcccgttctccgagcagactccatcgtacctgaccggcgagttccccggcgactacgggtgggacaccgcggggctgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggcgcccagatcttctccgagggcggcctcgactacctgggcaa

SEQ ID NO: 100683 - DNA, 511 bp, Triticum aestivum
  unsure (1)..(511): unsure at all n locations
  Clone ID: PAT_TA_100683
gcacgagggtcattcatcactgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggagncttctacatcgctcctgcnnncatggacaagcnnnnngtccatctctccaagaacttcatgaccctgcccaa

SEQ ID NO: 100684 - DNA, 638 bp, Triticum aestivum
  unsure (1)..(638): unsure at all n locations
  Clone ID: PAT_TA_100684
gcacgaggcctctctttcccagtgacagccggatttgaattgggcgaggatccatccccacccgagctcagagctccggcaaccatagccgccggtagacagagctcggagctcccgtagccatggctgcccgtagacagagctccgccgtctggatctcgcgtcaccagtctcctctgctgcctctcggtcttcccttgctctggatccagtccaccaagagcccagccttgctgccaagtccatcgccgccgcctgtgtcctatgtcccgacagcacacgccgccacatctgtccccctcctcgactgcatcggctctcctccagcacgtgacctagggttgcatgcatggtgggatgcaccagcctgccagcctaccccgcagcccccccgctgacatgggcccgaggcccatgaggtgaggcagctgcccctcctcgcctggcgaggcagctggagaagtagctgcgggaccagaggctgccgtaggatgagatactgtggtgctgcagtgtctagtggttgaagaaggggtgtgctgggaagnnnagttagtggtgagagtgctcgatctggaacaggacaagcttgggctgcaccggtgtgtttgctgctactgaatttttccagggcattg

SEQ ID NO: 100685 - DNA, 492 bp, Triticum aestivum
  unsure (1)..(492): unsure at all n locations
  Clone ID: PAT_TA_100685
gcacgagggtccgtcctccaagctgcgccgggccgagctcccggcggccgaccccgaccccgacctgcgtccccgccgcgccacgaccccccaccaccgagcttcgggccgcgtcagcgccaaatgcagcgactgccgtgcccgctcgccggccagcaccacgacaacgccaccgaccacgcctgcgagctctgcgtgctcttctcaacttctctcggtgatttatgcgatgtatgaagagaatcgggttgttgctgctgactttggtggtttgagagtcgatttcaggggcaggaagaggattcggaggcatagagattagttaccgcacaccacctgttcgatgaaatgcccgcaggcagcacgctgcagcgacgtcttcttctcctttctccgcgggcgctcgccagtccacgctgccacccatcaatgttgacaagtcaccgtcgaaaaggttgtcccagaagatgactgcaatgaaggctgccaatn

SEQ ID NO: 100686 - DNA, 624 bp, Triticum aestivum
  unsure (1)..(624): unsure at all n locations
  Clone ID: PAT_TA_100686
gacaccacaaacgccaaagcctcgcagcggctgcaagctccgccatggctcacccgtacccacatcgggcctgccgccaccatctcgccccgcgtcgccgctaagccgaagcagcgccccccgatctggcatcctgtgcccacgcttgggcaaccgtcgccgccagccgtaccgcacgtgccgccggacgacgcgcggttcagcacctacccgtcgtggttccgcgtccgcaagcaggccgccccaaaggcgagacgagcaggtcccgctgccaccggctccgtccggccgggcttcacccggaggagagcgccggcgacggcgaggcgaaggtcggagtggagggggccgagagtttgaccagggaatcttgcaaccttggctacccatcgaggaccttgatggagtggttatgaaccaaactatgaagagtccattctctaggtgtttccagttatttccacccaatgtttgtttttatttcaatttttttcaagccaaccgtaaggaatgcttacatgttagtgctaaatctgtgtatggtggtgaacaataaatttattcaatatttcgaatgtaaaaacaaatccaaatcagntcttcaatttcattttcaattcaaaa

SEQ ID NO: 100687 - DNA, 614 bp, Triticum aestivum
  unsure (1)..(614): unsure at all n locations
  Clone ID: PAT_TA_100687
cagcagccaaggccatagcgaagtggggccgtcaggccaccgacatcacccacctcgtcgtcggcaccaactctggtgcgcaagccccggccgtcgacctccgcctggcctctctgctcggcctgcgcgcgtccgtctgcaggacgatgctcaacctcaacggctgctccgccggtgccgcctcgctccgtctcgccaaggacctggccgagaacaaccgcggcgcgcgcgtgctggtggcctgcgtcgagctcaccgtcgtcgccttccacgggcccgaggaggcgtacccacacaagctcatcagccaggctgtctttggcgacggtgcgggcgcggtcattgtcggagctgacgccgtgcaccccatcgagcgcccgctcttcgagatggtgtcggcctcacagaccacgataccagcaaccgacggcgtgctcaccatgcagctcacggaagccggcctcgacggccacatcttcaccannnagctnnttcctctagcagcgcagcacatcgagcagtgtctcatggacgcgttccagcagcttggaataatgaacgnnngcacgaactggaacgatctcttctttgngnnncaccctggcatnnnnnnn

SEQ ID NO: 100688 - DNA, 634 bp, Triticum aestivum
  unsure (1)..(634): unsure at all n locations
  Clone ID: PAT_TA_100688
ttggtctgttgctcgatcggttgcggttgccttcaccattagtacatccagctcgaggctccgcctagttcttgtttcctatggccgcgcaatcttggaaccccttctcttgctgcgtccgcggcgcagccgtggacgacgacgaccaccgcgagtcgcggagggggaataagggcagcccgaggtcgccgctgaagagcctgagctcgtcggggacgctgtcaccggaggagctctcgctgacgctgtccggctcgaacctgcactccttcacatacgccgagctctgcgcggcgacggcgagcttctcgcgcgccaactacctcggctgcggcgggttcggcccggtctacaagggcgccgtcaacgacaagctccgccccgggctggccgcgcaggccgtcgccgtcaagtacctcgacctggagtgcggcacgcaggggcaccaagagtggctggcagaggttttctttcttgggcaactgnnncacaagaacctagtgaaactgatcggctactgctacgaggacgagcatcggatgctagtctacgagttcatgagcgccgggagcttggagaagcacctcttcaaaagtatcagtgggtctctcccatggatgacaaggatgaagaa

SEQ ID NO: 100689 - DNA, 456 bp, Triticum aestivum
  unsure (1)..(456): unsure at all n locations
  Clone ID: PAT_TA_100689
gcacgaggcaaacactccggctaagcacaagggccttgatcgcggggttggctttggggagcgtgagaccgacgcgctggtgcgtggtgaccgctgccgtacgtcggcgcgcgcgcttgcgtgccatgagccggggccgcgtccggcgggcagctggtagccccgtcgccgccgcgctggtgctcctgcaggcggccgtcctggcactgtcccccgggtgcgatgccgccgcggtgaccaccgacgcggagccggactaccgggaggcgctgtccaagagcctgctctacttcgaggcgcagcgctccgggcggctgccgtacaaccagcgcgtgagatggcgcgggcactcggggatcaccgacgggctgcagcagggcgtggacctggtgggcgggtactacgacgccggcgaccacgtcaagttcggcctgcccatggccttcaccgtcaccn

SEQ ID NO: 100690 - DNA, 426 bp, Triticum aestivum
  Clone ID: PAT_TA_100690
gcacgaggaaaaactctccccttttccgcctccccctttctttccaagtccaacctaaacctcagccccgctccacctccccccgcctctgccccgcacgccacaccacagcacccacctctccggacgggcgcccgtcgccgtcgccatcgccttttccccctccctccctccccgcgccggataagtagtacgcactcgcttgcaagggacgccggacctcgagctcccaccggccggcagattgattcctacaccaattcctgcgagccagagcgagggacaagcccgcccgcggccgtgggcgtcgagcggtccgtccgacgcgcattcggagggcgaggccgtgcgctaccaccggggggtggggatggatcagggggcggaggaggcgcggcggatggcgagcctgcaggcggcgcggac

SEQ ID NO: 100691 - DNA, 345 bp, Triticum aestivum
  unsure (1)..(345): unsure at all n locations
  Clone ID: PAT_TA_100691
cgggttttgatctgatcataattaatgcaaacttcatctcgctataactcgtagnatacataaaaaactgattcaacccctcccacagccttaaaaaacaacagctaaataaaaaaaggaaataccttaacaagcgggcccccgtaaaattgcccaacattaatcaaagggatctttccgggggtcatgcccacttgccattgccattcccgggcacaaacatgtggggcacataaccttcccagttcctgannaattggaacngcgttcatttgtaaaaaggaaaaagcgttgggggcccaacaacattttgctggcaannnaacgggcacatggcaggtttcc

SEQ ID NO: 100692 - DNA, 429 bp, Triticum aestivum
  unsure (1)..(429): unsure at all n locations
  Clone ID: PAT_TA_100692
gcacgaggcaaccaaccacccctagctaccacttcaacctgcactggtctcttcacactctcctcgcgaccatcggagttcagcggcgctcgcacatcaaagaaatcaagttcgtgccacggcgaggagcgtcgtcggtgagcgtgatcggtccggaaatggtgaagagcgcgcagcagcaggtggcgcttggcggcgacggcggcaatgcggcggcggcnnnnnnnnnncggcggcggcggcgggaggcagcagcagcagtacaagggcgtgcggatgcggagctgggggtcgtgggtgtcggagatccgggcgcccaaccagaagacgcgcatatggctcggctcctactccaccgccgaggccgccgcgcgcgcctacgacgccgcgctgctctgcctccggggctccgccgccgacctcaacttc

SEQ ID NO: 100693 - DNA, 429 bp, Triticum aestivum
  Clone ID: PAT_TA_100693
gcacgaggggaggacggcaaggggggagacgagggtgacaagagcaagaaagggggacggcgacggggaggacggcaaggggggagacgagggtgacaagagcaagaaagggtgagttggactgcattaatttctctccttgtgattttccgtgtcttgatctgaaatcttggggcgtcccttttggcgagttcttggtccttctgactgcctaatctggttaactgcctctggttcttttctgctgcgatattggatcaagatttggggcgggctagatttcgcttccttgaattgcttgctggccattcattcattcatgccttttctgttcttttttgttctttattccccttttaaggtagtttggccggctggccaaggtgtgaacccggctagggtttcacacccagcttgcatgcctcagcc

SEQ ID NO: 100694 - DNA, 399 bp, Triticum aestivum
  Clone ID: PAT_TA_100694
gccaataagaagttccaaaagatcttattacagtggaaggtttacatatattctgtgtctacaactaacaaacagtagtcttcttcatagttagtaataaattacatagagatgcaggaaaatgtggcgttatctagagttggtcccaatatggtccaatgtgcaagcggagactcagagcagaacggataaagatagagggcaacagaaggattaccttggatgaggattcccttttaccactttctgcccgtacttgcgccaccggtagccatcatccaaaagatcaatttcactggttgtttgcacgatgattctttgagctggggccggcacatgccttttgtttgcattcacaataccagcatctccattgtcatcacctgcttcatcattgtc

SEQ ID NO: 100695 - DNA, 448 bp, Triticum aestivum
  unsure (1)..(448): unsure at all n locations
  Clone ID: PAT_TA_100695
caggccaccacgcgcgcgccctccctccctcctctccaacccctctcctcctcccgttccctccccctcactcgcgccgcgcggaaggccaagcgggagaaggaggcttggagattttcgcggaacccccaccctcacccccctacctcccatcaaggtttcaccaccaccacccgtcctccaccagcctcccccgcatcgccgctccaacaatcccagtcgagtcatccgcccaccccaccccaccccaccgccgccgcattcgcaggcgtccgccccccgcgtccgccgcagagtcgccaatcccctcccgagagcccccgccccgtcggctcccgccggcgccggtgggnnnnggattccggtcccgtgtttattgctctgattcgggcccggattctccccggattgcgtttcctttgatggggccgccgccgccgctgctccn

SEQ ID NO: 100696 - DNA, 246 bp, Triticum aestivum
  unsure (1)..(246): unsure at all n locations
  Clone ID: PAT_TA_100696
catctcttaatttagccaaaccaatggggcttaaaatcaaattaattaaacaatggaactcgaggcaggaacaagatcgaccatcggacgcccgatggaaggcaggggaaccaaaatttgatcggaggcacccatcggttatggaggatggatgcctccggaccgagtaaaaactagggctaaactaagctaggggagcctcnnaacnctnactgctnnnatgacaacatnnnnctacnaccggcc

SEQ ID NO: 100697 - DNA, 425 bp, Triticum aestivum
  unsure (1)..(425): unsure at all n locations
  Clone ID: PAT_TA_100697
gcacgatgatctcacccaccatggatgccctccacaagctctttttttaactgattccagggtgctgcgaggggggcggttcggctgcgacggcgacctgatgctgccacgggattgctacggtgacccgatgctgcgacaagatctcgactgctccggtgatgctgcgactgcgccgccgcgccgtgctgctacggccgtcaacatttggacggcgtcatcgtgctgcgattcctgctgcgacgacatctcggcaacggcggctcaactgctgcaacagcgattcaaactgctccggcgatgtttgcgacgatgccggcgatgttgcgactacgccgtcctgcttcgagccagtgctgcgacaatcatcgacaagtaacgagagggtgctgcgacgccaccgccgatgctgcgangccgccgnn

SEQ ID NO: 100698 - DNA, 465 bp, Triticum aestivum
  unsure (1)..(465): unsure at all n locations
  Clone ID: PAT_TA_100698
nngaaaaccacatgccatgaagacactaccagtactgatggatcaagcacggatgaatacgatccatggaatcctccgtatcctcctccatgccctcctgctgttgaaaatagcttaagtgactctatccgtttagcagctaagtggttacgtgagaaagaagctgcagttggtgccgtcagagcatccagtataatcttcccagaacgcatccctaaggaggtgaatcatctcttccatgataaagtgcaccatttggcacctatcctggataaggatagcgtccggcgctttctcagctatatggagaggaatgggcagggcatgcgatggggttcgatcatcaccccagnngctttgaaccatatgatttcacaagatgcggtgaaatgtgtcaaaattgtcttggagggccaggcacctgagcttgatgggtgccgagccggtcccaactgcatgaaccaa

SEQ ID NO: 100699 - DNA, 501 bp, Triticum aestivum
  unsure (1)..(501): unsure at all n locations
  Clone ID: PAT_TA_100699
gtttttccctccctcccacccccccgccgacccaccccattcctcgctcgctgttcagcagcccaccccccaaaccggaacagccacaccacaccgccagcgcccattcccccgccccgccccacccccaccgccgcgatgcggtcgcggcggccaccgccggcggcgacccgcgccgtgctcttcctcctcgcgctcctcgcggcgtggggcgcggcgacggccgacctcgcgtcggacgcgcgggcgctcgtcgccttccgggccgcggtgggccagcgcgtggcctggaacgtggccgaccccaccaccgtctgcgcctggacgggggtcacctgcgagggcggccgcgtggcggcgctgcgcctcccgggggccgcgctggcggggcccgtcccggcgggctcgctcgggaacctcaccgcgctgcacacgctcnnnnnnngncnnaacgcgctccgcggggccctaccgtccgacctcgcccccatggccgcgcta

SEQ ID NO: 100700 - DNA, 492 bp, Triticum aestivum
  unsure (1)..(492): unsure at all n locations
  Clone ID: PAT_TA_100700
gaaagatctcgtccccgtccccgtcccccgcgtcgcccccgtctggcgacacgggggaaagacctcgccgctgctcgaagccgtgccgcgcccgaggatggtgacggcggggcggcctcgtcctcctcccccccgccagatccccgccaatcctcgatctggccggggcctcctccaccatcgcccccctcccgcgcccctaccggtgggccagccggcgaggctgcggcgcgcccggagctggtaccggtgaggtctcgccccgccccccgtcatgccagagcgccaccaccaccacctcttggatctgatctggcgctctgtggtcgtgcacctcctccaactgctgcggttcgtctgcccgtctgatgcggcggcgcggccacgcccgtgatcctcctccccgacctgtctcttctccccgttttggtggagaaggacgttgcttttgggcgtnnnnggctgggctggctgggatttggtcctgccccn

SEQ ID NO: 100701 - DNA, 484 bp, Triticum aestivum
  unsure (1)..(484): unsure at all n locations
  Clone ID: PAT_TA_100701
gcacgaggcatctttgagagcttagatcaggtttttctaactgacattgacactagcagacctggttacgttcttggtaccacttggtccttatgctaatttattattcctgaaatcttaatctttcaagctgctttttgcactgctaaagataatgctcttgatactgcttgatccttatgccaactttgctaactttattatcccttccaggcagagggttcaaaagatgccattaaactcctctctgtatcgcaactgttggattttggaacttcagataacatgctaacactctaactcactaatccggcaccgtatgtcagaagtctaaccagtatgctacttaattgacatgctaacgtcagtctgctagttggtcacgatgctacttattactacacattttccttgctaccttaagatgagttgggatgattatcacacaatatttgagactatctgaactgttaaatagtgttgn

SEQ ID NO: 100702 - DNA, 484 bp, Triticum aestivum
  Clone ID: PAT_TA_100702
gcacgagggtgggcgccctcctggttctggcgccccggctgcgcctgggcctcgctctgggtctgcagcgtcggacccggacctctcgccagcggccacggcgccctcgactcccgttgagtccgcaacccggtcagcgagcgcatcccctgcgcctgacccgggctcctcgacggcttccgccggcacggctgcttcctctccggcggccatggcgccaccgactcctgttgagtccgtagcctgggcagggagcgcttctccagcggctggccccggctcctcaacggtctctttgccggccccgccgactccgccgaccccaccagccccgcgggccgccccggacacccgcatggtcacgcgtgctcgcgccggtattcaccggcccagcaaccattatcctgtggatgagtaccttctcgctgcctcgacgtctgcgccgtcacctctcccgtcgtccgctcgagcgcccttcacgact

SEQ ID NO: 100703 - DNA, 491 bp, Triticum aestivum
  unsure (1)..(491): unsure at all n locations
  Clone ID: PAT_TA_100703
gcacgaggcatacacctgcccacttctagctagcttgctttcagaatccagatacacatacaccagccggcgtccagctagctcacttgcgagctgtagtacgtcgctgcatattccaatggagtgcgagaatgggcaagtcgccgccaacggcgatggcttgtgcgtggcgcagccggcgcgggccgacccactgaactgggggaaggcagcggaggagctctcagggcgccacctctcaccggaggaccaaggagggcggcgctctgcagagagagctcatccgattccttaacgctggagccttcggcaccggcaccgacggccacgttctgcctgccgcggcgacgagggcggcgatgctcgtccgagtcaataccttgctccagggatattcaggcatccgcttcgagatcctggagacgatcgccacacttctcaacgccaacgtgacaccatgcctaccgcttcggggcacgatcaccgcgtnn

SEQ ID NO: 100704 - DNA, 639 bp, Triticum aestivum
  unsure (1)..(639): unsure at all n locations
  Clone ID: PAT_TA_100704
ctctcctccagttaatagaataccatggcccccgccgtgatggcttcgtcggctaccaccgttgcacccttccaggggctcaagtccacagccggtctccccgtcagccgccgctccagcgccagcctcggcagcgtcagcaatggcggaaggatcaggtgcatgcaggtgtggccaattgagggcatcaagaagttcgagaccttgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcccatgtttgggtgcaccgacgccacacaggtgctcaacgaggtggaggaggtcaagaaggagtaccctgacgcctatgtccgtgtcatcggcttcgacaacctgcgccaggtgcagtgcgtcagcttcatcgccttcaggccaccgggttgcgaggagtccggcaaggcctaaactacgagttgaaacaatggcctatctcgtatgannntcttttgtgaacttcacttttgtccacaactctgctgcacgactctgctttnn

SEQ ID NO: 100705 - DNA, 630 bp, Triticum aestivum
  Clone ID: PAT_TA_100705
gcacgagggaatcgttgaggtggacgtcgaacgcgacggctctgctttcggctttagcttccccgaaaagcgccgcatagttaccacttagccggaggcgtcgcttgcttctccgatcactcgatcaggagggtgcgcctgccgacgtgcccacatggaaaccatatcttccttctagatggcttcgttactagacggtgacatgtaacattaatctactggtagttatcggttgcctgcatgacggatagggactgcaacgaggctccgcgatagctgcctggaagctggctgattctcatcgacatgatcaatctttttgtgttttataaaagtctgcagttatggcctggttgctgtcgtgataccgccgaaggctccatcgtcgctgttgacaatttggacagagagtgagtagtcgccgtcgtattacagtacactattattggcgcgtgtgtcaagcaggcgaaccatgctagtatttgagtatggttatcgcgtgacgtcgatcagagattttatacagtagaaaagttcagagctgggcggctgcacggtgtttgagcagaggaacaaagagatcgatgacgtgaatgggaacaaggatatcaatgatcgtgccatgtcttc

SEQ ID NO: 100706 - DNA, 609 bp, Triticum aestivum
  unsure (1)..(609): unsure at all n locations
  Clone ID: PAT_TA_100706
ggaaggctctctcctcagatccatggaatggcttcactcttccttccttccttccaacagcctgcggccgccggcgcacccttcttccatggcgatggcgagagggatgggatctagccccgcccagccccgccggcagcagcgtgcgtcccacaactactccagatgggaaacagcacggtccgctcccggccggagactctcgcagcggccggagcgccaacgtttgccgaccttcatcgccttttctcttggtctgatgggtaattaaggaccttggattcctttgttcaggcatcttgggtttgctagtgccaggcagagatgctacatttgttgtcttgtgatgtgaataaggtgtccacgtccacaagacatcaactcattgggataaagcagcgtgatactggattggctccaccaagccagtgggatctcgtgcctgataaacagatgatgctagnnnagcaaccattgcagatgcacggagataacaagtccaaatactgatgatgccaaatgccataaaaaacaaatcgcaannntctgtcatcattgtactatctnnnnnnaatcacatcttctgnnnnnncnnacnnanntcccccc

SEQ ID NO: 100707 - DNA, 650 bp, Triticum aestivum
  unsure (1)..(650): unsure at all n locations
  Clone ID: PAT_TA_100707
caagagctcttctcgatccccgtcctcctcgttccacatctccctcgcaccgccacccacaggaaccgcacgagctacaccctcgtcccgatcccctcctacccatgctcttcgtctggccccgccctcctgctgcagtcactcttcctgcgcgctgccggagctccccgctgccgacaccatcgcctcccttccatagcaccaccacgaaggacccagccgctggctcaatcgctcgtctgctcccgtttcccctctgctgctccacaagttcctcctctccatcatctctgccccgcgcctcaactctgcgccgtccccgtcgccctccttgccttgctttggcctcctcttctgcatgacccgagggcgcccctgctcgtcgtgcttgcccgcccaatgaccaccttggaccaccagcgacctctctggctttgcctccgtgcctgcttgctgcagctgccatgaccctcgtccacctattgcaccaccgtcaccacgnnnnncctcgcannccgctccatgcttctcctggatgcccttgtttcctnnnnngntcgnnnacaagtgcatcgaccgtcatccagagcaccggggcactggnnnnntctatttgcnnnnncnnngnnnnnngcttcatggaaanntnn

SEQ ID NO: 100708 - DNA, 465 bp, Triticum aestivum
  unsure (1)..(465): unsure at all n locations
  Clone ID: PAT_TA_100708
gcacgaggcttcttcttccccacccccttccccaggcgggcacattcctcctcccccaaatcttggtgctgatctagcgccgctgccccccacattaattgtccttcccccatcttgctccatccgcattgattcacgggcaagcagacagggcggcttctagctctcgtcacccccgcagagtccaatccttcggtctttgggcctcgttggttcttgatctgggaggggaggcgaggtgatctgtggcgggccgtgatttgatctgaaagttgtgattttttggggggaggggtcggaggatttgtgtgtcgggccgtcatggggacgggggcggtggcgccggagcggccgaagcagcggcggggggggcacctgtggaagcgcgcggtgctccacttctcgctctgcnncgtcatgggcnnnnnnnccggcttcacgccctgctnntnnnnntactnnnnn

SEQ ID NO: 100709 - DNA, 619 bp, Triticum aestivum
  unsure (1)..(619): unsure at all n locations
  Clone ID: PAT_TA_100709
ttcaaggcggttgagcctctcgtctttggatccgcctcccggggaagaacatggctctcgtcgttggatcgaggaggcccgccgcctgtatatcccgcggtgcgccggggttttcacccggccgggagcaacaagcaagatgcatgacaacaagcagggcctgtggagggggttttgcgcggatctgccatttggttaccaacagctgtctccatggaactgcgccgtgatccactgatgtgagagacttagggctgtatacttctgtccatcctggcttttcttttttagacagttttcacctcttttttcattcttatgcagcccgaggaacctctctcgtgattgcccgcccaggaaccgcctcactaggcttgcagataacaccgatgaatccttttctgaggtatagaaacaacactcaagtggtcatcgagaaatccaccttgacgtaccctggcttcaaattttgtcacttgggcaatttttttaactcagnccaagcggattgatnnnncnnngtgacgtgcgtgttataaacagcaaactgaaacctcttcctctctgaacacnnncnttcaactcctcannntcaccttatcnnnnnannnaaangatc

SEQ ID NO: 100710 - DNA, 547 bp, Triticum aestivum
  unsure (1)..(547): unsure at all n locations
  Clone ID: PAT_TA_100710
cccccacaccacaccacaccatcaccaagcacgcacacccacggccctcccatccgcgacccacgacccacgacccagacaccccacttccccggcgaggctgagcgatctttccccaaacccaaacacagcaaacacgacggagcacccacgccaccccggcgaccgcaggtaagatttctctcccgatctctcctcctccggggcctctcttggttgctattagatcaggcaagaaggggttcctggacaccattttttcatcttcttcttccgcttccgctttgctcgcatgcaaagttctttttcttgttcttgctaggacgagcagagatccggagaacctttttactcctctggatccttggtccgtcttcttctttttagcctttcttttctagcctttcttgcgagccggcataggggctgtttttacagagccccttcnnnntgctcgcaccagcaattggtctctgtcctctnnncttcttcgcttttattgannnaancagggctttagttttnnntttttcgatttctacatttt

SEQ ID NO: 100711 - DNA, 619 bp, Triticum aestivum
  unsure (1)..(619): unsure at all n locations
  Clone ID: PAT_TA_100711
cgacctccagcacagtccagagagactccctttatacacgcgcctcgctcgttcccccgccagcagccatagcccatagctcgatcagtcgtttcatggtctccggcaccgttcatgggacatgcctccatcactctcctccctccgctccctcttcaccaggacgctgggcctgggctcgggcggcgccgagcacagcggggatgaggagtctcaggccggcggcgggcccgtgccgtcgggtggcagccggccggtggcggggcctccgggggagtgctacgcgtgcacgcagcccggggtgccggcgttccactccacgacgtgcgaccaggtgcactcgccgggctgggacgccgacgccggctcctcgctagtgcccgtgcaggcgcagcagctgcgggcgcagccgctcccgggggcggccgccgtcgccgccgcgcggtggctgttcgggccggtgctggacccgcggagcaagcgcgtgcagcgctggaaccgctggatcctgctgggccgcgcggcggcgctggccgtngacncgctcttcttctacgcgctctccatcggccgcgcnnnncgnnnnngcatgtacanggncgnnnnnctcgccnnnnnn

SEQ ID NO: 100712 - DNA, 494 bp, Triticum aestivum
  unsure (1)..(494): unsure at all n locations
  Clone ID: PAT_TA_100712
gcacgaggctcagatctcctcctctttcctccctcccccgcttctgtcgcggccatggttgacgagcccctcgacccgccgccgccgacgccggcggcggcggcgcctcccacgccgctcctccgcccgcggcgcgaggcgttcgagcacggcctcctgcccatccccaagctcatcttcccggagggcacgctggcgcagaccctctcccagctcaaggagaagctcgcgcccgcggccgccgccgcgggagacgggcgcgtgggcgccgcgtccctcgcggaggcgctgcagatcccgcccgaccaggcggcgctcgcgatcggcatgctcgcggcggnnntccccgcggannaccccgcgctagnnnccggcgggagtggtggaggcgccgacctccgcgacgttctgctcttcctctacatccagtcgtnnnagcgcctcgtgccnnncccgcacaaagactcgcccgccgtcgccgacgtntggcnann

SEQ ID NO: 100713 - DNA, 605 bp, Triticum aestivum
  unsure (1)..(605): unsure at all n locations
  Clone ID: PAT_TA_100713
gcacgannnnaaaaatttccccacccgaaaccctcgccgcctccacccacccaccatcaccatgccgccgccgacccccgttccatctctgccggaagagctcctcgaggaggtcttcctccacctcccgccggacgagccggatcacctcgtgcgcgcctccatcgccagcaagctctggctcggcctcctcaccggcgctcgcttccgcggccgctaccgcgatttccatggagctccccccatgctcggcttcctatataccctgcccttcttatgttccagtccgctgtcgacagacccccgcccacacttcgtctccaccacgaaattcgccgcacgcattcccgacgacctccgggagtacgatgcgcaggactgccaccatggccgcgttctcctcaggtataagatgctcttcatttggaaccccatgacgggctgctccacagagctgcccccgtccacagaatacatggaggccgaaagcagtggggctgcggtgctctgcgccgtcacctgctgtgaccaccgcgcgtgtcatgagggccccttctgggtcgtctttgtctacctggaccnnnatgnnngcgagggtgtttgtg

SEQ ID NO: 100714 - DNA, 580 bp, Triticum aestivum
  unsure (1)..(580): unsure at all n locations
  Clone ID: PAT_TA_100714
gcacgaggcttcctttctttcttcttccccaaaccagaacggcagagcacgccgcccgcacattcgcggctgctcgtccaaaccctagngtcgcaccgcccaaccgcccgaatccctcatgctgcgcgcggcggcggctgccgccgctgccttcccggcgcggttcgccgccgtgccggccgtgccggcggcggaggagatgcggtcgccgctgctcagggttttcgggtcgctgaggggcggccggagctcggtgatggggaggcgggcgcgcttctgctccagctcctgcgggagcgactccgnnnccgccgcggcggccgcagcggannggaannccgaagatgcggttgccggcgagggtgaggcggaaggcaagccgtgctccganannntgtccaccaacccccgnnntgnnnacttcctctcggtcattgcacnnnntcttgcacagcgaccactctttcnnnnattttatatgccgatctatgtaaaggaccaaaagctnntgcaagccttgattgaaaatcgcaaaagntcnnncccatatgcnnnnncctttcttgtganggatgaagnn

SEQ ID NO: 100715 - DNA, 636 bp, Triticum aestivum
  unsure (1)..(636): unsure at all n locations
  Clone ID: PAT_TA_100715
gcacgaggagccattcatcactgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccangatnggcatcaacccaatcatgatgagtgccggnnnnctggnn

SEQ ID NO: 100716 - DNA, 631 bp, Triticum aestivum
  unsure (1)..(631): unsure at all n locations
  Clone ID: PAT_TA_100716
taattgccaagaacattttatgtagactagtagtacttttttgacctatattaaaaacctggactggaccgcctgttcgaccaaaaaagaacacaaccagcaaccttctcagcttagagatcatccatgcagatgtgaaaaatgggcaggaggctggctttttacctgaaccgctgacctgatctgtctgatagtgaattatttggatgaaggccgcagtcgcttaccacgtgtttcttgtcaaactcttacatggtgccttcttcccttgctgaggtgcaggcgcgcagtggtgcacggtgcaccgccagccgtgcaaggtctgcacaattgccttggcccatctgatgtagtctactaacagatatggagcccacaggcccaagggcacacaccagccagccagtgcttgtattgcatggcatcttgcttgacatttccgtgcccgagcttgaactccatagttagcaaatttgtctcacttagaaaaatggaagttagcaaatctatcacttttctcaaccaactctctgtattttctgaactaactaatgctatatgagtataatatcaaaaattcaaaaactggtgactgaattatttaaccgatatcctgactgttcatttgnnn

SEQ ID NO: 100717 - DNA, 619 bp, Triticum aestivum
  unsure (1)..(619): unsure at all n locations
  Clone ID: PAT_TA_100717
tttcaactccatatatattgcaagtctgcaacttgcattttagaaaactcaaatttagattgctctgttccaggatttaaatcttcttgagttttccaatcacaaatatcttgcatgcatggaaagaaaattggatgttcttaatcacagaaaggtgttttttacacgtaggtgccttctttaaatctatgcattttgttgaccattctatgattttataattagaaaatggatgttagctacactattagaaggtgatcccactcagccaatagcagatctgcataaattaatttctttatgcaacaaattacttttatgcacagatgtattttagcttacactaacctgacctttatgctgatgcttctgttatttatgaatacctcctttactcttggccatgatgggaagagttttaagacatctaaaagggtcagattattgattgttcttttcctttgaccctcctacaagaacttatgtgctggaatgttgggagtgttaactccacgggtctcaaatctgaaaatatttacagngnnncttcgttgccacgatcattactgtgtagaactttcttactctagagtggcatccaaattatgaataagaaatg

SEQ ID NO: 100718 - DNA, 600 bp, Triticum aestivum
  unsure (1)..(600): unsure at all n locations
  Clone ID: PAT_TA_100718
gcacgagggccaccttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaactacgagttgaaacaatggcctatgtatgannntcttttg

SEQ ID NO: 100719 - DNA, 602 bp, Triticum aestivum
  unsure (1)..(602): unsure at all n locations
  Clone ID: PAT_TA_100719
gacgagggtaaactgtgaaaaggagacggggagggaggcgaccggcgaccgaccgtgagagggaagaaaaaataataataaccagccgcccgccgggaatggccgccgtcgccgccggcgaactggacgggcagtagagggcgtccgtcctatctctttttttttctctctgtgtgtgtggttggggcggtggttgcagtcgggactggtggtggtgtgtaactgcgctggtgtggttggttggagttcgggattggggatggcgtggttgcggtagtggttaggattcacgcgatcgatgccgttccagctcaagcccggtcaccaccacggcgccatggacgggaagccgccgccgccgccgccgacgctcgcgcccgccccgacgccgcccgcgccgcccagggtctcccgcctccgcaggctgctcgtgagggtctccgcctcggagcgcctcgcggtcgccggggacgggaaggagcgggagaaggaggagaggcccgcggccggcgggganncggaggtcggctcggtggggctcgaccgcatggtgctcagcttcatggaggactccgcnnnngtnnnnnnnnnngncgcgcggc

SEQ ID NO: 100720 - DNA, 578 bp, Triticum aestivum
  unsure (1)..(578): unsure at all n locations
  Clone ID: PAT_TA_100720
gcacgaggaaattgtctttagtatatgtccatataaataaaagggaaaaaatatttcccctccctcaatttttttagaagtacaaaaatggtctctcgacttcaaaaccagcaaagcttagtccctgaacttttaaaaccggataagtttaatccctcataccgttttcaagtggtttcctaccgacatggacacgattttgcctaaaaccaaacacgtcatacatgtttgaccggtctttggtccatgtggcaatatttctctttcctttcatctatctaaagtgtgtacatttcatcgagcacatagcatgcaatgtctgcatgtacacagtcgtgcttgctgcagcttgccacgaccgattatcaccaacgactgacaagtcacgccccattttgggctgccctgcgcgcctcgccgcaccacacctccccggccacctcagcgacgtgtacatgnnnccgcgcatgcatggtacatttttttttttttttgacgagtacatgcatggtacattggtacaagctccagntgttgaagntgctcctgatagcagcccaggcatgattgnnngaacg

SEQ ID NO: 100721 - DNA, 605 bp, Triticum aestivum
  unsure (1)..(605): unsure at all n locations
  Clone ID: PAT_TA_100721
gcacgaggcggctactcatctgtagccaccatctcagctccactaccgcatcgcatcgcctctgctccaccaccaccaccaccaccacgccgcccactcgacggcaatggccgctgctcagtgacggcccccaccggcccggctatgccggaagacgacgcgtccttcctcctgtgcgccgaggacgccttcttctttgtcgacgccgccaccgccagcacctgcaccaccgccgagcagatcggtggctggtgctccggcgccgaggaggagtcggcggcggcctccttcgtggccgagctcatcggcggcgaggccgactactcgccccggtccgactactccgaccggctccggtcgcggtccgtcgaccccgccgcccgggccgactctgttgcatggactctcaaggtgcaagagtactacggattccttcccttgacggcctacctcgccgtgaactacatggaccggttcctctccctccaccggctgccggtaagctcgccgcccggcgcccgccgtcctcgccccgccacgtcaccaaccctcaacacacacatctcaccatgtcagacaaccatgtcacgcgcgtatcagatnnn

SEQ ID NO: 100722 - DNA, 460 bp, Triticum aestivum
  unsure (1)..(460): unsure at all n locations
  Clone ID: PAT_TA_100722
gcacgaggcacacgtcctccgaattgaacccaaccgaagcgcagccagcagccctccctctctggtagagtggtggtagcctccgtccggtccatcgatcccctagaaaagagcaaaccgagccccaaacaggcaaaggaaacgccacgctaggggcgcggagcggctaagcgcccagcaccaaacggaaaggaaggaatcctccgctctctttcctccatttgcactctctctctctctccctctctgccctcgccaccaactcctcttcttccctaccacgctgacgcggcggcactggtttctttccgccgtcccgtcctcgctcgctcgccctctctcggcccccctctctctctgtacatcgcaggcgtaccgaaaataactctggtactctggcagtggagtggtaaaatctactaaagcgagcgagtgagtgaacagtggnnncgncannnnn

SEQ ID NO: 100723 - DNA, 616 bp, Triticum aestivum
  Clone ID: PAT_TA_100723
gcacgagggtgccatctccctccttttttagggtttcgcgcctcactcctctgcccctctttccgccccgaccccgtccgctcgttcgtttatagggttagggttccggcgagcagctctgcctcccgccgccggcggcgatgggtgtcccggcgttctaccgctggctggctgagaagtacccgatggtggtggtggacgtggtggaggaggagcccgtggagatcgagggcgtccaggtccccgtcgacacctccaagcccaaccccaacggcctcgagttcgacaacctctacctcgacatgaacgggattattcacccctgctttcacccggaggacaggccttcgccgacaacattcgctgaggttttccagtgcatgtttgattacatagataggctctttatcatggttcgccctcggaagcttttgtacatggccattgatggtgtggctcctcgtgctaagatgaaccagcagcgctctagacgattcagagctgcaaaagatgctgctgatgcggctgaagaagaagaaaaactgcgtgaagagtttgagagggaaggaagaaagcttcctccaaaattgcaatcacaaacatgtgattctaatgt

SEQ ID NO: 100724 - DNA, 623 bp, Triticum aestivum
  unsure (1)..(623): unsure at all n locations
  Clone ID: PAT_TA_100724
ctggaaacaaagaaacaaaaccatttgttaactgaagtatagatcattcttgtccagtttttttgttctaaaggctgtccagcgttgttaagggtttaactatggctatgttggcataattaatcgttctccacatgctaaaatgacaattccctcttgaccaggttgttcccatgtgttgacataattaactatggtcgttcccatgtgtttggccaatctgaatagcagcacaaaaacataacgctctaaacctttaggttcagtatgtggatccatgcaagtttggtcactggcatacagtaatatgatgataagctttgttgttttattttcagcttgtgctagaggcatgccgctggcaccggtggcccctcactgatcttatacaagccatttaaggatatgtcgtggtaagtgagcaaatcgaatggatggatccatcattttgccatcctaatgcttctcaagggtttcctttttgttgaccagttcaaccaatccatcatcttgcagtgctggtgctttctgatttccactttttttctatgagaagttttagtgggaatactaatacgttttggtcatcaaattatcttaactacgcctgggaaatgnagnnn

SEQ ID NO: 100725 - DNA, 618 bp, Triticum aestivum
  unsure (1)..(618): unsure at all n locations
  Clone ID: PAT_TA_100725
gcacgaggcggccgaggccgccgccgcggtggacttcgacggcatgctcgccgtctacgaggggttctgcaatctcaagcagatcaatctcaaggtgaagatttgcaagggctcgtcggtccgcaaggcgctggttcgcgaggccaccctgttcggggcctccaagcttgtcctgggcatcaccaagaggaagcgcaccattgggtcctccctgtcagttgccaagtactgcgcgaagaagctgccggcaaagtgcgcggtgctcgccgtcaatggcggcaagatcgtctaccggagagaatcgaatgctcactccggcaaggtgtcggccgaggttcctgcctgtggtgatgatgagatgtactgtgtgctgccgttcggagcccgtcagaagggtgaagaagagagcgagttgccttgtgatgaaccgagcaaagatggcagccccgatgacgaagaacagcatgatgttggtgcaaagggcagtcagccagaggacgtcgtcgctgaagaacagcaaccatcgagtgtggaacctgctgagttgtcgacggtncnnnnncagactgaagcagcagatcctgctgacagggacaaagagccaacaatgagccnnan

SEQ ID NO: 100726 - DNA, 370 bp, Triticum aestivum
  unsure (1)..(370): unsure at all n locations
  Clone ID: PAT_TA_100726
ttttttntnnnnannnnattgattgtgcttcctccatgcctctgttgtttctttctccaaacggnnnnaaaaacatcnnncatctgcatacagtcattgtatcgttttcaacattcaatgtaagcacacaatggccacaaaaggcaaaaaaagcataggggctaagcacaaccgaaaacaaacaagatacaagagagactcatgtttctacaattttattactgaacccccatccaaaatggttgaacatagcctaagcgaccacaacttcctgggcgnnntctgctccctcatcaagttcatatacgacattgtcctcttctgacaanncgcctgcggctcnnnnncgacgagatcctggnnnnnnnnn

SEQ ID NO: 100727 - DNA, 194 bp, Triticum aestivum
  unsure (1)..(194): unsure at all n locations
  Clone ID: PAT_TA_100727
gggcaccataaaactttgacaactaaaaaggactgggggcccccaaaccacattgcacaacatcttaccaaactgaaaacggttccccaggttcaacaattcccccaaaaataaaccccataaaacttttaaataaaaaaattataaccaaataccggctcatttgaggctaaggttaatcnnnccctaaaata

SEQ ID NO: 100728 - DNA, 427 bp, Triticum aestivum
  unsure (1)..(427): unsure at all n locations
  Clone ID: PAT_TA_100728
gggcccagatgaacgttttccaacaccccaatgataattacaaagtagtaatactctcacgggggcctgggacaacaaaaactaaaagggatggggggacctnnaagggattcaaaaagatgccttatcactattttgctagccggatactaccccacttattttaaaatctaaaaacaacacaccgggggtccggacgggggcgaactcctcctttaactggcatatgtgagtatcacattaattggcagtcattggggggttgcccttcggaggggggtcccggtttggttcggggtcaaggttgggctcccggttaagcataaggtcaaggttgggctctgggttaagcattggttcgggcttaagctctgggttaagcaaagggtcnggcttaaggtctgnntttggnatcnnnnntgggttg

SEQ ID NO: 100729 - DNA, 599 bp, Triticum aestivum
  unsure (1)..(599): unsure at all n locations
  Clone ID: PAT_TA_100729
gcacgagggtcgttctcccgtgtgcacaacggagaaagggcagcgaaacgaagaaattgatggcgggagccgagagcgcgcggccggcgcctccggtgctgccgtggacggtgcggctccaggtgctcgcgctcggggccttctgcgacctctcgcagcgccgcgacggcacagtgaaccgctccctcttctcgctcgccgaccggcagacctcggcgaggccgcgcccggacgcgctcggcgtccgctccgtcgacgtcgtcgtcgaccccgcaaggagcctctgggcgcgcgtcttctccccgtccgcggataacgctgaggccactccgctccctgtcctcgtgtacttccacggcggcggcttcgcgctgctctccgcggcgtccgcgcccctggacgccatgtgccgccgcttctgccgcgagctgggcgccgtggtcgtctccgtcaactaccgccgcgcgcccgagcaccgttaccccgccgcctacgatgannngngcggacgtgctcagctaccttgccaccaccggcctacctgccgacatcggcgtcccggtcgacctctcccggtgctnnnnnnncgggnnnngcgc

SEQ ID NO: 100730 - DNA, 435 bp, Triticum aestivum
  unsure (1)..(435): unsure at all n locations
  Clone ID: PAT_TA_100730
ccccccctcgccccgccccgcccctccccacctcaaccctacttcctccctccatccaaatccaacccggcacccgcacaaaagcggcgaaacacccgagccagcggcggaaagagagaaaaacaactaaaacgaaacacagcgcgggcgggcgggcgggcggcggcgggagatcgccccgggggattggccgattcccancgggtgggggccgatccccgcgcccgccccnnntccccgcgcgattccggcgccggcgcccgcggggatgaccgcccccgccccgtgctccccccggcnnnagtgagcccgccgcagcgggaggaggggaggaggaggaggaggaggtctgtttgggggattgaggcggaggnnnnctctggtcttggcnnnnngctgatccggcgggcggggcccnnngcnnnncggccatgt

SEQ ID NO: 100731 - DNA, 588 bp, Triticum aestivum
  unsure (1)..(588): unsure at all n locations
  Clone ID: PAT_TA_100731
aanacagaggcataaatgtgtaaccctcaagttcagggaccaaattggcattgcattgcaaatataggcggcatgcgatataatgcatttcacttccacaggcacaaaaagggctttaaaatagcagcagtgtaacgtatgacgggtgtcaaaacctctaaacaattttcaggaagggctgtcataggctccatacaagctcaggtagcaacttcgaggtccggcgatattaaaaaaaaaacttcccccataaggcaaaacatgtttcggcaatactgtaaaatctgtcttcgcgtaagttaactgctgcaannnacagctgcggggaccctgagcttcgaccgcccgatgtatagnnaactggatataatatagcaaaaagtactgggtttcaaagccacccaggttttcctccattcaatgtttcaatctaactccttacagctgacatctgccacccaccacccgagtctacaagtcnacaggatcatcctcctcgttgccattgtacctgtctgtaaaatcattgccnnnnnnaatgacatttatttcgtcattattnnnatcctcccctaattttttcnnnaa

SEQ ID NO: 100732 - DNA, 381 bp, Triticum aestivum
  unsure (1)..(381): unsure at all n locations
  Clone ID: PAT_TA_100732
aacaaagaaaaaccgggggaaaggtccctccctctggaacccacaattttttttccgactccataaatcacccgggggccccatgaatcacccaaaacccccggggggaacccccttgctaaccccctctcccaaaaaaaaaaaaacccccccccggccaacggaacctcccctttgccgtcagcccccccttcccttgttttgaattaccggggccaaaatcttgacccccacccccccccctttccaactangtcaccccccccctggtttaaaataccccccctaacccccccctttccccagggggggcccccccttttggtgccaaccccagaggcccccccctttctctcatcccgtggccaaaaaaaaaaaacc

SEQ ID NO: 100733 - DNA, 515 bp, Triticum aestivum
  unsure (1)..(515): unsure at all n locations
  Clone ID: PAT_TA_100733
cgccggtgcacgtgctggtgttcccctggccgctgcagggccacatcaactccatgctccccttcgccgagggcctcctcggcgccggcgtccacgtcaccttcctgcacacggagcacaacctccgccgggtcgaccgcgccgcttcgccacgcctccgcttcgcgtccgtgccggacggcctccccgacgaccacccgcgctcggtcgcccacctcagcgagatcggcaggtccctgaggccgagcgccagtgccgcagcgagacgtgctgcggcaccgcgccgtggggtgcttcctgacgcacgccgggtggaactccacgttggagggcatcgcggagggcgtgccgctggcgtgctggccgttcttcgcggaccagcagatcaacagccggttcacggccgccgtgtgggggacgnnnctggacatgaaggacgtgtgcgagagggccgtcgtggagcggatggtgagngnnnccatggagtccggcgagctnnnnnnnncggctcnnnn

SEQ ID NO: 100734 - DNA, 306 bp, Triticum aestivum
  unsure (1)..(306): unsure at all n locations
  Clone ID: PAT_TA_100734
gcacgaggaaccccttccgattttaaatgccaccgaggcccacgccggcgccggggcagctgccacgcccgcgcccgcccccgctgatgccggtggcgaagaggccgcccgctccgtgggcgctggccctcccggccggccgccgcgcgcgcgcccgcctctgcctccgcctcgcnnngcnnntctccttcctgctcctcctcacggcgttcctccgcacccaacccccggnngcancnnncgacgcgctgccgccctccgctgggccggggaaggtggacttacnntttctcgaccgcgccggac

SEQ ID NO: 100735 - DNA, 332 bp, Triticum aestivum
  unsure (1)..(332): unsure at all n locations
  Clone ID: PAT_TA_100735
attgaaaaaaaacaaatttttaaatcttttcaaaatacattatccgtgccgcgtacattttaccataccatttccaggaaaaatgaaactttacaggaataatttcctatttacaggaaaccttaaactcctaatctaaacaaaaaaatngntcatgtccaggatctcgaggcatttaaaaatgaaaacactgaaggccccccttacttttataacttaaaaggacttgaaaaccttttatttggttaaaaacaaccattcctaccacatggacgtacggcaaacaaaccttaaaatnnatccataaccccttcnncgggcttcacttttgg

SEQ ID NO: 100736 - DNA, 532 bp, Triticum aestivum
  Clone ID: PAT_TA_100736
gcacgaggctggctgggagcgccgcctccaccggccgccgttgccaacgtcgaccaccacctccttgtctgcacctgcacgcggtgaaaggaggagtggaggagccaaggagggagcttcgtgtctgcacggctgcacctgctcgccgtcgtcgaccgtcgccgtctctacctgcccgtcttcgaccacctcctcaccggttagccgccgtcgagcacaaagctggaggacgcggggacggagctggaggacgcgggggatggagctgctgcacgtgcacctgaagtcccgcatgtcgtggctgtcaatttgtaattgtttcttctctctgaaatttcttcagttggtaattgttcactccctctgaactttcttcagtttcagttggtatttgttcactccctctgaactttcttcagttagacaccgtcctgtgctgtttttcttgcaaccttgcttatttttcttccatttgaacctcttttgcaacctaataatctatatgttcgaatttgctgtcaaaaaaaaaaaa

SEQ ID NO: 100737 - DNA, 624 bp, Triticum aestivum
  unsure (1)..(624): unsure at all n locations
  Clone ID: PAT_TA_100737
catcgctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaaaggtcttgcctacgatatctccgacgaccagcaggacatcaccagagggaaaggcatcgtggactccctcttccaggcgcccacgggcgacggcacccacgaagccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccantcatgatgagtgccggagagctggnnngt

SEQ ID NO: 100738 - DNA, 263 bp, Triticum aestivum
  Clone ID: PAT_TA_100738
gcacgagggctccctgaagatgttttcttccacttcagcaagttcagtactcttggtctcttctagttctggctcttgtgcttctggtatatcaactgttgcctcagttgctattacatgctcttcaagagctgcttcatctgcaagaacaacattgcttgtcacatcctcagatagcttgctggtgtttgcaacagtgctcccgtttattgcttcagtttccttcacgtcttctgctggcaagtcacttgctgatctagttt

SEQ ID NO: 100739 - DNA, 559 bp, Triticum aestivum
  unsure (1)..(559): unsure at all n locations
  Clone ID: PAT_TA_100739
gcacgaggatttttagttaagtccatttctatccatttctgcgacaagtaattcgggacggcgggagtatttgtcaatggagggagtatgtcgagctgagctgatccttaatcagactaattattatgtactccctctgtccggaattactcgtcacgtaaaatggatgtatctagacatatttttagttatagatacatccatttctatccatttatgcgacaagtaattcgggacggagggagtaggttgttacatttttgttcttctaaagcaatacatggccacggccactaccgttacccattgatcgcgagcttgaggctttgatcagtggtgcatgtgactgggttcatggcctatggcagcgctactttatgtgttttagatgatgttgatcattctttattgggattggaaaaagcaagtctgtttagtttgacnnnctgatgcttannncnacgtgctgctgcggttgagntctcctgaagctgctacattttaaaataaatgagtaaaatgctnnnactcttttctctnnncctaattnnntgacnnt

SEQ ID NO: 100740 - DNA, 490 bp, Triticum aestivum
  unsure (1)..(490): unsure at all n locations
  Clone ID: PAT_TA_100740
ccccgacccacccgctgcccagctcctatcccacgagcttctcctgatcccgtggtcttccccacctcctcccgatcccgccgccacccccgcctcctccggcgcgccgccgtccccgcctccgcccacacctccctccggcgcgccgccgtccccgcctcctccaggctcgcctccgcccacgcctccctccggcgcgccgccgtccccgcctcctcccggctcatctccgtccctgcctcctttcaccgccgcactaaggttccccggccccctccacccgccgtcgccacctctcctctccctcccagcacgtcaccgccggcccgcacctcctcccccttccagcggaccaccggcagccgcacccttccacttcccaacatcctccggcgatgcgccggcccttcccgtcccgaaccccgccnnctacgctgcgccnnnacgcaaccgcagcccgagccccgcctnnnnnaccnngccnnnatgc

SEQ ID NO: 100741 - DNA, 488 bp, Triticum aestivum
  unsure (1)..(488): unsure at all n locations
  Clone ID: PAT_TA_100741
gcacgaggggcgagtcactgacgcacaaattaaagcggcgagagctcagctcactcactcactcacccgcaccgctagctagctccaatggactactccacctccctcctccgcctcaccttcctcgccctcggcgccgccttggtcctcatcgtcgcccgctccgccttccgcctgccgctcgccatcgacgccccggccgcctccttcttgcacggcgccggcggctgcacccgcttctcgccgtgggcctgccgctcaccacgaaccgagaagagcacgccacgtcgcccgtcgcacgagtccgacgtgccgcgccacccgctcgacccgctcacggtgacggaggtcagccgcgcgcgtgacctcctccgcgcgcacccgccgttcgcgtcggcgccgtcggccctggccgtgcacgcgctcgcgctcgacgagccagacnagcccgnngtccggcgctggcggaagnnngcccacgggcnnnc

SEQ ID NO: 100742 - DNA, 459 bp, Triticum aestivum
  unsure (1)..(459): unsure at all n locations
  Clone ID: PAT_TA_100742
ctggtctctctgccggtcttcccactcctcggccatcccgtccaccgcaaatccatcgcagctaccgccggcggggagcatctctccttcgccgcccgccgtccggcgccgtagtgacggccggccgccgccagatctggggtcaggcgagagaaggagacccaccaatctcgaatccaccatttccctctctgcgtaacagagggattcgggcggcgcgcgcatcgccattgctcgggactcgggagctctaagccagccagccagccagccagccatggcggacctggcggtcgggctgtccaagacngtggtggcggaggcgctgaccaaggtgcagtcggccatcgacgaggacaacaagctccggcacaaggcgcagcgggacctggtgaccatcaccctcgagttcgagatgatgcagtccttcctgaacgtcgnnnncggcgggannnnnnn

SEQ ID NO: 100743 - DNA, 175 bp, Triticum aestivum
  Clone ID: PAT_TA_100743
tatatgtatacacagcaaaagaaacgaatggatctcgtttctttcttgcagatctcgtttctttcttgctgcatgagaggtgtttgcttgtccccaagatcttgctcgctcattagttttgacagataaaaacagatagaaaaaattggcttgttgtgtacataaaaaaaaaaaa

SEQ ID NO: 100744 - DNA, 267 bp, Triticum aestivum
  unsure (1)..(267): unsure at all n locations
  Clone ID: PAT_TA_100744
tggaaatgcacgacgtgaccagcgcctaaaccccacaatttttccgcttctaaaatctccggcgagctctgccttccgctgcttcttcctccgcaagccaccgcgcaaccgcctgccatgatggggagcagggtggccgcgtcgctgctccgccggggcagggaccaggcctccgccctgatgacgatccctcgcctcccgaggagcgctccagctccgccccccgctcctcctagggttggatccggcnnnncggnnnnnngnnnn

SEQ ID NO: 100745 - DNA, 597 bp, Triticum aestivum
  unsure (1)..(597): unsure at all n locations
  Clone ID: PAT_TA_100745
gcacgagggccgccccctccttccccgctcccaccccgccggcgctctcacccacccatcggcggcctcgctcccaaaatccgctcgtcgatgccccaccaccatgccccctcccctcacccgccccaccttctctccctacctaaccagatcgagccggccaggcggcagcggccatggttttggcttctctccgggcggattcctccctcccctcgtcgtcttcatacgaggatggacgccctacctgccgatgctcccccatatataccccgctcctccagccccacaccacctgccgtcgccgtcgccgccgacaagcccctcctccgcgtcgccgaccaccacccgagatccgcccttccccgatgaccatgccggtggcgcaggaccccgtcggcgcgggcgcggacgccgcctcgtcccgccgcaaccgccgccgccacaagaagtcctcctccgccaacgccaacgccgctgcttccgcggtccctgtccccgccccggccccggcgccgcncacgccgatgcagcgcctcttcgacaccagccgcgnnntcttcaccggatccgcccccggcttcgttcccccgnngn

SEQ ID NO: 100746 - DNA, 387 bp, Triticum aestivum
  unsure (1)..(387): unsure at all n locations
  Clone ID: PAT_TA_100746
atcttccaaatccctgccattttttttaaataactgccaccaccggtacactgacccaaatagtaatacaaattactcgtcccgcccatgtttaattacagtcttttacacgtttgtacaaaggccaatccagttgcctccttaatgctacaactttgcaccacacaacgccttggggggcgcaanncaaaaaaaaaaaatccggcgagccgtcaggcnacgtcccaattgacatcctcgggctcccccacgttgtaataaaggggggactgccggccgtcaaacttggaaannannttgtgccccgtgaggcnccaataanacttcctcaaccgctggatgcaaatgtccatgatcttttggaacatgtgnncctcctggnnnnag

SEQ ID NO: 100747 - DNA, 615 bp, Triticum aestivum
  unsure (1)..(615): unsure at all n locations
  Clone ID: PAT_TA_100747
gcacgaggagcacccgagaatttgagctagagaaacatgtcctctctgcgacatgccatgcccgtcgtcttggtcctggcgcatgccgtcctggcgctggcactccagggcgtcgccgctggttcaggcgaggtcccggcggtgattgtgttcggcgactccaccgctgacaccggcaacaacaacttcatccagaccgtagccaggggcaactacgctccgtacgggcgggactacgccggcggcgtcgccaccggccggttctccaatggccgcctccccgccgacttggtctccgaggcgctgggcctgccgccctccgtgccggcgtacctcgacccgtcccacaccatccaccatctcgcctcgggcgtcagcttcgcctccgcannctccgggctggacaacataaccgcgcaaatcccgtcggcgatgaccctgggcgagcagatcgaccacttcaggcagtacacggagcggctgnnncgggcgnnnnncgnnncggcggcgcgccgcatcatcgccggcgccctctacatcttcagcatcggcgccagcgacttcctgcagaactacctggtgttccccgtgnnnggctacagcttcaccccgcnn

SEQ ID NO: 100748 - DNA, 597 bp, Triticum aestivum
  unsure (1)..(597): unsure at all n locations
  Clone ID: PAT_TA_100748
cacttgttgaaaactctagaaagacaaatatttaggaacggagggagtaattatcactataatctctgccatgctattgtgccttttagtaatatacacacagattctagctaggttgttgatccacccacaagggtgtacttctaaattaggtgcagtacccaccagattattcaatggccccatttaattgtttgttgtcactgagcattgccgttgtgatgatcattaacctggtttgccaatgctttgttcgctcattggtggtaactgaatttgtgctgctcttgcaaaactgagatttcgaaagcaagaataaagcttcgcctgctcttnnntttagttactttggtggctgttgactctagttatctgcaagtcattgaagtactggtgctggatggaagttgtccaattgtcgcttggctctttggctgtaagaactgaatttgtgattcttcttgtaaaccgagacntcgaaagtaatgaaattatttctactatgatgtatagttgttactaatctctgccatacagttgtgctccttatagtagtagtaataaataatgtacagtannnnnnnnnnnngatgattc

SEQ ID NO: 100749 - DNA, 598 bp, Triticum aestivum
  unsure (1)..(598): unsure at all n locations
  Clone ID: PAT_TA_100749
ggcaggctgcaggtgtccgatgtgggagtgggacgccacctccctcgccggcgccctcaaatccgccgccacttgccgttccactccccatgtcaaacccctccacgctgtcctcctcaagctcggcctgtcggcgtccgccatcctagctacctcgctcgcgcacctggcactccggtgcgggctccctggttacgcccgcgctctgttcgacgaaatgcccagacgggacgtggtctcctggacgtccctcatcaccggccacgctcaccagggtctgcacggagactctctcgcacttctgcggcgcatggtcgaatccggtgttgctcccaacgggtacacactgtccggtgggttgctcgcgtgtgccggggttggccagggcgcccttgctgccgggaaggaaatccatgccagggttgtgaagatgagtatgtatggcccggtcgattcggttgtggagaacgnnnttcttgacatgtacgcgaggtgcaggaatgttgactatgcgaggagagtgtttggggtgatggtggcnnnggacattgttgcgtggaactcgatgatggctgggtatcnnnnnagtggtcaagct

SEQ ID NO: 100750 - DNA, 375 bp, Triticum aestivum
  unsure (1)..(375): unsure at all n locations
  Clone ID: PAT_TA_100750
gcacgaggcatgtccctcgcgcctcctccgtgcccgcctcctctgctccgcctccgcggcccccgccgcgacgccgccctctccgccgccgtcccatcccgccctctctccggatgcctcgccaccgggcggggccccggctccggccgcccctactgccttttctccggcgccggccgccggaagcaggaggaagctaggggagggctggagggtgccgtagaccagaacaagacggggttcgggacatggggcgtggaaactgatacaaggcagcgaagagacccgcgtggtggtccgggtcctgctgccggtggcggtggcaggggaaggcctgcaggaggaggaggaggaggaggtggaggtggnnnnngt

SEQ ID NO: 100751 - DNA, 584 bp, Triticum aestivum
  unsure (1)..(584): unsure at all n locations
  Clone ID: PAT_TA_100751
gcacgaggcttcccccaacgaatccaaaccccggagccaagacaagagatggcggcggccctggtgcgagccctacgcggacggcgcgggccggcggcggcggccatggcgctcggccgccgcggcgggctgggcggtgccgacgcttccccttcacctctgctgccgatgaggcgttccctcgccagcggcaacggcgccggggggacgggtgctggcggccacggcgcgggcacgggggcggtctcctcggggtgcaccggcatgggtgccgaagcacaatggcattgcaagggggcgggcggaggcgtcgtggccaactccggcggggacgcaggggaagaattactaacctctccttccacttcctcttctccaggcactttgccctcccgctccggcaaagcattggccttttttgtttttctcgcgccttgccgctggattgaccttctttgtcgcnnnncgacggagatccaccgtctacgcaaggacctgtttgaagaaaccangcgtctctgggacggctaccacaagnnntgtgatgcagatagaaaacttttcgannnnctcgcccatttann

SEQ ID NO: 100752 - DNA, 223 bp, Triticum aestivum
  Clone ID: PAT_TA_100752
atgaacgactcgggttgcagtggctcctgcgaaaagcaaggatttgctagcggcaaatgtgatggagtacgtcgtcgtcgtacgtgttacaagaagtgttgagcatatatatgctctttattaaaactatgtaaactagtcacgtggtgactttctcctgtaccatctttggtatctgacggtatattaaataaagtttgacgtttgtagcaaaaaaaaaaaa

SEQ ID NO: 100753 - DNA, 580 bp, Triticum aestivum
  unsure (1)..(580): unsure at all n locations
  Clone ID: PAT_TA_100753
gcacgagggttcatctcactgagctcgcaggcagccccagccaccagcgaaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctcngngggcnnnntcgactacctgggcaaccccaacctggtgcacgcgcagagcatcctcgccatctgggcggtgcnnnnngtgctcatgggcttcatcgagngctcngnnnnnnngnnnn

SEQ ID NO: 100754 - DNA, 268 bp, Triticum aestivum
  Clone ID: PAT_TA_100754
ggaaacaaacaaccccaccctcactttttatttaccttccttaaacaaacaaaaattaaaacaatgattccccccgaaaaaccaacaatccattcttttggaagcaaatcaaaaccaaccacactacatcctaccttaaacaaaccaccttttaaactaaccccactaacaataattcccccacgaccgccttccaatcgaaggaaagaatctgccttaaaaaaaaaccggccggcagctcctcctgggtggggtttcctcggaagga

SEQ ID NO: 100755 - DNA, 621 bp, Triticum aestivum
  unsure (1)..(621): unsure at all n locations
  Clone ID: PAT_TA_100755
gcacgaggcgcccatagtcaagccccggtgatgtagccatctcagtgaacctcgttaacaaatctcggggtcatactcgtgtgattgcttggtcggttggtcctcggatgatcgacggtacttggttgctccatcaaaacaataactgtaacaaaatgtatcatcaagaagtagctgtgtagttgttccaggaccattacgaagtttagctaccctccacaacattggagttccggaatgaagtttgagtgggaaagcttgatgggacagaaagagaaagcacttcagctcctcaccttcaaagattgcagtttgcatgtagcagctgcttgcattgcatggtaaagtttggagacacattgaccttgaagtctcgcatcggaagatgtcttttcattggttcctaagagtatcgtccaattcacttgtgtgcgttagctaacctcctagtgactgggcagctttcgtttcatgagattaacctgtttggatggaagagcaatttatcctctgtgtggcatgatagatgattcaagtgttggacttgttttgtgcatcatgtgacaacatcgtccttcagttgtttacctttgcatctactgacgaaccgacacaacnnnn

SEQ ID NO: 100756 - DNA, 611 bp, Triticum aestivum
  unsure (1)..(611): unsure at all n locations
  Clone ID: PAT_TA_100756
gcacgaggcagagaccggcgtcttcgtactcgcctctctctcgcgcttccgagctttggcctccgtcctcccctcctcccccgatctctccaccagcgcagcgtagcgccggcttccgccgctccgacccgccgccatgagggagtgcatctcgatccacatcggccaggccggtatccaggtcgggaacgcgtgctgggagctctactgcctcgagcatggcattcagcctgatggacagatgcccggtgacaagaccgttgggggaggtgatgatgctttcaacaccttcttcagtgagactggtgctgggaagcatgtcccccgcgcggtctttgttgatcttgagcccactgtgattgatgaggtgaggactggcacttaccgccagctcttccaccctgagcagcttatcagtggcaaggaggatgcagccaacaactttgcccgtggtcactacaccattggcaaggagattgttgacctatgccttgaccgtatcnnnaagcttgcagacaactgcactggtctccaggggttccttgtcttcaacgctgttggaggtggaactggctctnnnnttggttctcttctccttgnncgtctctcnn

SEQ ID NO: 100757 - DNA, 563 bp, Triticum aestivum
  unsure (1)..(563): unsure at all n locations
  Clone ID: PAT_TA_100757
gcacgagggaaatctgcggcgaatgcgaccgggagaagcgatttcaaggatcagctcgctgctttagggggaatcgccttttggcccgtatctgctttgctgcctgcggaaagggtcgctgcggcctgcgggcgattccggatttgtctgcaaagcgtcatcctgacctgatacccgtgcgtcgattctccttactgctgctgttcgagctgccgggcaaatatggccaatgtacttgcacatgcttttcaggcagctcaagagaaccatgcggttgcagaggaaacattcagattatgtgacgaggatcgtctgtctgaagttttcagaaaagtgcgccggtccattgagcagcacccccactcaaagcaggcagacacgacgtgctgtgtctcagctgaaaggataagccatgacagttatccatcatctgatgatggtgatgttccagagtggcaccttcatttttccaaccaggcnnatccccttgatggaactggcaagccgcagcttcattatccagcgcatatgtatatggaaatgnnngntcttgaannngaatg

SEQ ID NO: 100758 - DNA, 618 bp, Triticum aestivum
  unsure (1)..(618): unsure at all n locations
  Clone ID: PAT_TA_100758
gcacgagggcgtccggcgccgagcgctcgtgcagacgatgccggccggccggcggtgatgccgatgtccacggaagccgtaaaactcgattcaatgtcctcaaagtccccgttgatctctctattgcatccattccacttcctaagtcctaacatctacgcactctatcccactcctcgccggccggccatggcgacgatgccgatgcccactccccgatctattctcctgctcctcctcctcgccacctccttcttcctcctcctccccaacccctcctccgcctctgtctcccacccggacctcatcctgcccaaggcggtcaacgacaacgaggcccacgtggtcgtcctcaccgccgccaacttctcctccttcctcgccgtccgccgccacgtcgtggtcgacttctacgcgccctggtgctactggtcccgcaagctcgccccggagtacgcggcggcggcggcgcacctggccgacaaggggctcgacgtcgcactcgccaaagtcgacgccacccaggaccgtgacctcgcgcgcgcgcacggcgtcgacnnataccccaccgtcctcttcttcgtggannncgtgcccaggcacttcccctactannnn

SEQ ID NO: 100759 - DNA, 621 bp, Triticum aestivum
  unsure (1)..(621): unsure at all n locations
  Clone ID: PAT_TA_100759
gcacgagggagaattcttaattcaagagttatagggagggacttatgtcaccacaaacagaaactaaagcaagtgttggatttaaagctggtgttaaagattataaattgacttactacaccccagagtatgaaactaaagatactgatatcttggcagcattccgagtaagtcctcagcctggggttccgcccgaagaagcaagggctgcagtagctgccgaatcttctactggtacatggacaactgtttggactgatggacttaccagtcttgatcgttacaaaagacgatgctatcacatcgagcctgttgctggggaagacagccaatggatctgttatgtagcttatccattagacctatttgaagagggttccgttactaacatgtttacttccattgtaagtaacgtatttggtttcaaagccctacgtgctctacgtttggaagatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgnn

SEQ ID NO: 100760 - DNA, 384 bp, Triticum aestivum
  unsure (1)..(384): unsure at all n locations
  Clone ID: PAT_TA_100760
gcacgaggtctcctccgtctcctcctccgcgccatccgtccaatccgcccaaaattacccctccaatcgccccgcaaatgctccgcgatcgcccgcgcgtcgcccagtccgccgcgccattagcgcccgccatttttgttgttgggggaggattgattggttaatcgattgatttccaaaggaggcagctttttgcttgttgttgtagggtaattagggatagcggtaggaggaggccatggtggacgagtaccaccaccggatgggcgccgcggcggccgacttccggcgcgacctggaggacctcgtctgcgaccacctcggcggctgctactcgccgccgccctcctcgtcctcgtcgctctgnnnnngcggcggnnnnnc

SEQ ID NO: 100761 - DNA, 354 bp, Triticum aestivum
  unsure (1)..(354): unsure at all n locations
  Clone ID: PAT_TA_100761
gcacgaggggtagatacacaccactgctgatacggttgcgtacacgcgagagtggctcgattacgttagcatagcactagccactattttgttcatttcgtctcatcggggatctgtcacttgcaccacgctactagcagtagttgctgcggcgactccccgagaaaggaaaaagaggttgctgcggtgattccaaccatggaggtgtgctgctgctccacctcgtcctccctcctcgccagcggccgcttcgccgcgccggtggcgtccgcgcgggcgcggcagtggggcgcggcggggggcgggagggcggacgtgctggcacacccactgcacccgnnngccgancnnnnn

SEQ ID NO: 100762 - DNA, 539 bp, Triticum aestivum
  unsure (1)..(539): unsure at all n locations
  Clone ID: PAT_TA_100762
ccggcacgagctacggcgggttcgtggcctactccctggcgcgcgcggcggggcccgcgagggtcggccccgtggtgatatccaactccgacctgctcaagacggcggaggacgacagggcgttcctcgagcgcacggcgcggcggctcatggagctctcgttctaccggaagcagagacttttcagcgataagagggaggagaagatcgagcttatgaaggccatcactgtagggacagatgagttccaacttacacccttggagcaggatgttttgctcgtctggggagaccatgaccagatattccctgtggacaaggcattcgctgtcaagaggtaatccatagctatcccagcgcaagaactgacagtgacttgaaatggtcgatcttacttctgctccactgcacaccatggtccatgtatacagtatactgtaaattttctacgtatactgtgatgcaaatttacaaatcgcagcataacctcttgcgtgattactagtgtgcttatgatggtttcaggtgcttnnnagaga

SEQ ID NO: 100763 - DNA, 615 bp, Triticum aestivum
  unsure (1)..(615): unsure at all n locations
  Clone ID: PAT_TA_100763
gcacgaggcacttggcctccccccctcgagtcctccggcgagtctctgcggcggcggcggcgatggcttccttctccgaggctccccccggcaaccccgacgcgggcgccaagatcttcaagaccaagtgcgcccagtgccacaccgtcgacgccggcgccggccacaagcaaggtatggcgcctccaccgccggtctccgcccaacgcctcagcgtgtttatctattctcgcctgtccctcgccgtgttgggcgcgggagatccgaatggctccttcgatctgcgcgtgtggggcggtggttgagatcagatcggatgctgcgcggatagatctgtgtgtgtgccctttctgctgtcggaagtagcgcttagatctgtcgcggtttgtgatggggcggtcgattgagcactggattcgtagctctgcttatgcttagcagtcgatggcgagatgtttcttcccgatttctggtgcttgctgtattgtaaaactatatttgctagagattacatattgctcgaatcgtgatctgttgcagcagggcttgcctccgcgattgtttgttgctttgaatcgcctgcttagtgcgattaggctgctgctgctgtgctcn

SEQ ID NO: 100764 - DNA, 361 bp, Triticum aestivum
  unsure (1)..(361): unsure at all n locations
  Clone ID: PAT_TA_100764
aaaaatatttaaatttattccccaaatggggggaatttccccccaaaaaccaaaggggtttccccatacatttttaaacatggaaaggtttgctttttttttgccacctaggatctgccctaaataaatcccgtttttacaaagggtggaaggggtaaaatctacttaaaaaatttttgtccttcggggggggaaaaaaacttttttactccatttgtaaaaaaaaacctttaaaataaatcccccgccttggttttgcaacccccggaaacacataactgcaatttgagggctttgtgggggttataaacccttggggaaatggaaacccccccgagggnnttttgaaactcgtaaaaaa

SEQ ID NO: 100765 - DNA, 615 bp, Triticum aestivum
  unsure (1)..(615): unsure at all n locations
  Clone ID: PAT_TA_100765
cacccccagatgccggccacggcgagcggcggcgcgcgggcggaggaggcagcgtccgcgccttcggtgtgttcctccgcgcctttctgcatggggacgcggccggaggagctcgcggccaggctggcggccgggggccccggcggcgtcggcggaccatgagcaggacgcggagagggaggggagggggagcacgagcgggtgctcgcgctgcgcgagatcaagaaccagatcatcgggaaccggaccaagaagctcctctacctccgcctgggcgccgtgccggcggtcgtcgcggcgctggccgagcccggcgcgtctccggccgcgctcgtccaggcggcggccgcggcggggagcttcgcttgcggcgtatncgacggcgcgcgggccgtgcttgctgctggcgccgtggggcaccttacgcggctcctcgcccaccccgacgacaaggttgtcgatgcatgtgcccgtgctctcagaatgatatatcaatcaaaacaagctccaacatttgatgtcaataatgagaaaaatatggactttcttctttcccttttggacagcgagaacgaaaatgttactgagctggctgctaatattatatcatactct

SEQ ID NO: 100766 - DNA, 612 bp, Triticum aestivum
  unsure (1)..(612): unsure at all n locations
  Clone ID: PAT_TA_100766
gcacgaggctgccccctccctccctccctccgagctagcagcagcagaagccttcgctcttccaccactccatccatccattccagcaggagcacgagctctctccccacttctccccgtccgtccgtcgctgctgccttttccctccccctcctctgcgctcctaggttaggagtaggggcttttcaaaggagagagcaaaagagaaagtccttgcataccccaacaaggcaacccgctgctgcctttttctccctcccctcccctcccctccccccttctctctctccaccctctctgctttcttgttatcttcagcccagccaacgagagcagagcagagcagaccagagagaggctagaggtggaccgaaacatcggacaccaagcagggaggaaggaaagacggcgggcatgtgggatctcaatgactcgccggccnnngaggcgccgccgctgtccccctccgtcgacgactccggcgcctcctcctcgtccnnnnnnnnggtcgtcgagatacccgacgacgccgacgacgactccgcngaggccgtcgtcacgcgccagttcttccccccggccgccccgggcgagnnnnnnnnnnggaacggc

SEQ ID NO: 100767 - DNA, 426 bp, Triticum aestivum
  unsure (1)..(426): unsure at all n locations
  Clone ID: PAT_TA_100767
gcacgagggcgtggcgtgcgcgggctctccggcggcgagcgcaagcgggtgagcatcgggctggagatgctggtggacccgagcctgctgctcctggacgagcccacctcagggctcgactccaccacggccgcgaggatcgtcggcacgctccgccgcatggccgccggaggcggccgcacggtcgtggtgaccatccaccagccgtcgtcgcgcctctaccacatgttcgacaaggtgctgctgctgtccgccgaggggcggcccatctactacgggcgcgccgccgacgcgctctcctacttcgcctccgtcggcttcgcgtcgccgctgtccgtcaacccggccgacctcatgctcgacctcgccaacnntatcttgccggagnccaacggcgacnnnnttcctggcggcgggagcgnnngt

SEQ ID NO: 100768 - DNA, 585 bp, Triticum aestivum
  unsure (1)..(585): unsure at all n locations
  Clone ID: PAT_TA_100768
gcacgaggcttgctacaagtgttcactcagtgcagctcatccagtccagaaacccaaaagagctgctttaaacattctcatagctgagcactgggcgtcggcgccaccatgggtactgctctgtgcctggcactggcggtgctgctactgctgcttgtcaatgatccggtgttggtggccgccgacgacggcgtcgacgagcagctgctggagcggttcaaggcggcggtacggaaccacggggagctgggggggtggacccgtggcgacggcgcgtgcagtttccctggtgccgcgtgcgtcaggggagggaagaggctcgtgtcgctgtccctctcgggtgtcccacttgacgtcgatttccataccgtcgccggcacactgctgcggctgggtggtctcgaggtcctcagattgcgaggcgccaacatcagcggctcgctcgcaagtggcagcggccccggagngnnnntggtgcagnnnnnnnctggcacagctggacctgtccgggaacggcatgctgggtggatccgtcgccgacgtccgcgcgctcgctggcgcgtgcgacgggctnnnnnagctgaa

SEQ ID NO: 100769 - DNA, 552 bp, Triticum aestivum
  unsure (1)..(552): unsure at all n locations
  Clone ID: PAT_TA_100769
gcacgaggccgttcctctccctctccctcggccgccgccggcggtgacctcccccatggctgacgcccccacccccttctctctgccccttgccttctcctcatcatcagcaacctccttccctcctctcgccccagatcgaggacaggtctggatccggcacgcccacagcgctgcttcggctaaagcaaggtgctcttgccctggtgctacagccatggacaaggtgccctcccatctcttctctctgtatgtgttggatggtgggaaacaataactgcatcaagagctacctcgatgccatcctcgacaccggcaatcagatcgcggcgatcgcccctccctgcttctcctcaatcttgtccacttctccctgctactccgtcgaggaggtcatcactgtctacgaagataccgacctctacaagtcattgctccggggggtgaacgtggtgtacaggacaacgaacttgnnnngcagcgggccnnnnnnnctgaccctccctacgtccccatggcnagttttcttttggnnnnntcccctttattctt

SEQ ID NO: 100770 - DNA, 545 bp, Triticum aestivum
  unsure (1)..(545): unsure at all n locations
  Clone ID: PAT_TA_100770
gcacgagggtgcatctcacgccctcttagctagctcgtgccagcgcgcgatggccgcgccgtttctgctccttcttctgctcgtcgtctctgggggcgctgcagcgggcggcgacgacgaggcgtggctttcccggctcgagctccgaggcatcgatgacccgggccgtgggcacgcgtccgtcgcgccggaggaggaggtgttcatggacgttattatcgccactgacgacgacgaggcgggcgaaacgccccgactcgagttccgtggcatcgacgattcgggccgtgggcacgcgtccgtcgcgccggaggagccggtgttcacggcccgtgtctccacggacgacgacgaagcgcctcggctccagttccgaggcatcgacggctcgggccatgggcacgcgtccgacgcgccgaagcagcaggcgttcgtggacgttatgtccgcnaacggatgcgcgaggttcgcgggcctcctcgccgcgacggcgaacgcgggcgagatcttccagcagcgccnnntcgnnnnnngcnnnngcgggc

SEQ ID NO: 100771 - DNA, 581 bp, Triticum aestivum
  unsure (1)..(581): unsure at all n locations
  Clone ID: PAT_TA_100771
gcacgaggctttctcctcccatccccgtctcacatcccgtcgcttccgccgtcggccgattgagtgtttcccgaattgttcgtccgccgtccctccccgcactcaggcacgcgtacacccatcttcctcgctcgcctggttccgtggttcgtgtacgattcagagcggagtaggggatcaattgatgtcaggttcggcttccatccaaaccggccgccggccagtccaccgaggggagagcccagattgtccacgcgaaaccctagaccccgcgcgcgtaccatctccgccgcctcgcccagttcttgctcgcctcagctcgcggggatggagcaggacgcgccgcccgtcccctcgcaccaggcccaggacggcggcgccgtggacggctgggcgcggaatgacagcgagccccctcccgtacggcgctcaggcggagtgccccgaggtcgtagatcctcctccttgccggcgcttccgcggccacgtctccactgccnnctccgcgtgtgcgaccctcaacgacgacttggggaggagccctgcgacgacctcgnnnacgcctgctcccccgnccacaa

SEQ ID NO: 100772 - DNA, 277 bp, Triticum aestivum
  unsure (1)..(277): unsure at all n locations
  Clone ID: PAT_TA_100772
caccgcccggccgcagcgggtagtacccgagcggcgggacaggtgtccccgcgctcctctcgtcagccgtccgatcgacggccacctccgctccgctttgagctcctggtgatcttgtcgcctacctctcgcccacatccttatacggtgccagcgcttgtcgggctgtggggctttggctctgacacatcggnnnggcgggagcgcaagcgcgatggcggtggtggccggaaccgggagggcgaggggggcaaacctggnnnnngcggannnnggc

SEQ ID NO: 100773 - DNA, 612 bp, Triticum aestivum
  unsure (1)..(612): unsure at all n locations
  Clone ID: PAT_TA_100773
ctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagncgttaacattgtctcaaatgctagctgcaccactaactgccttgctcccctagctaagatcattaatgacaacttcggtattatngnnnnnttgatgaccactg

SEQ ID NO: 100774 - DNA, 599 bp, Triticum aestivum
  unsure (1)..(599): unsure at all n locations
  Clone ID: PAT_TA_100774
gcacgaggctcttcgggaacgtcaggccgggggccgatctctcgcacttccaggtaaaaacaaacaagcaccactactgttcactctcgtgtgtgatgtgagactcccatctcgagagccaaatttgaattcacttgctactttacttactccgaggttaggagcaccacaggtactaccctgaatccggcataattcagggggctggtactgtactataataatcacttaatcagggcaggttgatttgcttatgggagattggagtaggtggggttcagctaggcagcaaaaacaagttcaatgaattcccgcggatttgaaacaaaccaaatggggccccaaagcttggactgtactctatatgattaaacatggaagcttctctcatggtttaagaattagagtgattgagtcatgtcactttatgtgccaagataagcttattaggggttagttagtggtgtggagatcacacctacttatgatttggttagtccttttccagggacactaaattgtcggttagctcccagnnnaaattcatgaaagtctaatanntgcacttcacaatcttaattttgtannnnnnatatcnn

SEQ ID NO: 100775 - DNA, 624 bp, Triticum aestivum
  unsure (1)..(624): unsure at all n locations
  Clone ID: PAT_TA_100775
tggattaccaccagctgtgtgatggatcggtggagagggagtacagaaggctcgaagccaccaagccaagcacgttttcgatcctcaactatctcaaaatccatctcccagagttcttcccggagctcctgagggtgatactgctcgacgacgacgtcttggtgcgcaaggatctggccgggctatgggagcaggacctggaagggaacatcatgggcgcggtcggcgcgcaccggcccggcgcggacggtggcatctgcatcgagaggacgctcaccgagcacctcaacttctctgaccctgcagtgtcgtcgctaggcctcgacggctcgcactgcgcgtggtcttggggcgccaccatcgtcgacctcgacgcttggcgaggagcgaacgttaccgagacgtatcagctatggctgcaaaagaaccgcgaatcggggttcatgctgtggaagatggggtcgctgccgccggccctgatagcgttcgacggtcgggtgcgggcgatcgagccgctgtggcacctgccggacctcggccgccgcatgcctgacgccgagctgctgcagctctccgccgtcctgcatttcagcgggccgcggaagccgtggctnnnnnnngcgt

SEQ ID NO: 100776 - DNA, 634 bp, Triticum aestivum
  unsure (1)..(634): unsure at all n locations
  Clone ID: PAT_TA_100776
gcacgaggccggcacactatcacatcctggacggacgcataatctacccacgacctttctccaacctcgattcctcgcatcaccggaacccagcgccgccattggcctcctccagcagacccgccgcccgccgccgcgggcctcctcccgcagaccccgccgctgccgcgtgcctcctcccgcagaacccgccgccaccacgggcctcctaccgcagaccccgccgctgccacgtgcctcctccagcagaacccgctgccgccgcgggcctcctcccgcagaccccaccgtcgccgcgaggttcatcccgcagacctgacgccaccgcgagcttcctgccgcaaccctgccagcggcctcctcccgcaaccccgtcggcgacctcctcccgcatccccgttgccggccacgccaatgcgcgtccctactggatccacccgatccagtgccgcgccagccgccattaaccccaccagccgccggcaccgccgccatccaccccgctagccactgtccccgccttccgcccgtgattccgcgctctgttcctcgtttgcacacctctgactcaccatggacggcttccccnnntctgctcgaacttcttctccaaccancntcgtncnatcctgat

SEQ ID NO: 100777 - DNA, 525 bp, Triticum aestivum
  unsure (1)..(525): unsure at all n locations
  Clone ID: PAT_TA_100777
gctgctgctcctcctcgccttcgtcggcaccttattgctcgccgcctcatcccatgtgccggccgcctgcacaccgcaggtgcgggacgcgctgctggccttcaagcgaggcatcaccggcgagattggcaccgctggcctcctcgcctcatggcgcaaagacgacgtcgactgctgccagtggagaggtgtccggtgcagcaaccggactggccatacccatgtcgtcgcgctgaaccttcgaggccagggactggccggtgagataagtccttctttgctttccctgccgcatctggagcatcttgatctcagcaacaacagcattactggccgtatccccggctttctgggttctttggcaaacttgagatatcttaacctatcccatgtagtatacgtttcctcggtggaagtgcctccccaccttggcaacctctcaaagctgcactatcttgacctgtcagcctatgagccatataaagtttcctccanggatctctcatgnnnancacgtctacgntt

SEQ ID NO: 100778 - DNA, 657 bp, Triticum aestivum
  unsure (1)..(657): unsure at all n locations
  Clone ID: PAT_TA_100778
tgattattcactaaaaacatattccatatcagatttagtaatataaatttcatgtaaccaatgttggtaaaaaaacagtgctggttaaacttaagaatgtttgactgatctcttaaaaaccttttgcaagcagtgggtgtaggatctaaattaaagaataatgagaacaagatgcaggaaacccatgggaggacagggagcaattttttgtatttagcaacaaaggggtcatattatttacaaaatcaaagttccatgtctacattgatgcctgaaaccttttgtttgtgcttgcatgatactagtgccgacctaatttctaccttattgtttttactttatatctagttttcactttaagattgcatgttgtagttccctattcatacttcttgaccgttgaaaacaccaattgttcactgaacacttcccatcatgttgaaaatattcaatcctctcttgatgcaaaagttctgtatgataggaggcaactgttgaagtgtatatgtcgatttcctagccctttccatcagtttggacctttggttgcattggctnntgcatgaagcttaacagcaacaacacaaaatagacctagcataaattaaattgccactgcttatttactnnacttgctactgnnnnnnaannnnacgt

SEQ ID NO: 100779 - DNA, 639 bp, Triticum aestivum
  unsure (1)..(639): unsure at all n locations
  Clone ID: PAT_TA_100779
gcacgaggcacaatcctaatactatccattgtatatatactgatatcatgtgctctatcacttcattaaaagacaaatgtggtcctcatatgctacttatcctgtgtgaagttggaaatataatcatatgaaattgtaaacctagtgcaaatagttgtttttgactttttggtatgtagccaaaatatcttcaaccagatgtgtttacattccaaaaaagaaacagatgtgctttaataatttgctcacaaataatcactaaaatatacatgcatgcgagcaacattttcttgaagttatcactttaactgactgcactttgtttcatttcaagtttctatcctccaccatctttcattatctttgaatgcaaccaaaattctaccatggctgcaagtaaaatttatttgtggaactttgacatggattgtagatgtaatattatatgtaagatggatagtctgcagctggagcagcattatcagcatcatatggatatactgcaaattagttctaaaaacatgccaatcattcagatgctattaatataaagttcaaaaaatgaaacttcagnnngttttaaccagtcacgagtcatgtagtctgttgtgatnnncttgcccctggtgctgcnannnn

SEQ ID NO: 100780 - DNA, 525 bp, Triticum aestivum
  unsure (1)..(525): unsure at all n locations
  Clone ID: PAT_TA_100780
ctttaaacataaattccaatatatatattcctcttgtcttgcagttctacaaagcacggacgatcgatgctgctaggggctcagggatctctgtgaagatccgccgccatctccgcgtcgagtcgtgacatgcacatatgcaacaaacaaaacctaacaaattaagcttggattcatatacgtactatatagtccagagaatcaatttgtaaacgacagcatcaacgagcactgtaagatataaaggcccacccgggtgaaggcttgccggagatggccgaaaccccgcggcaaaaaacgggacggccggctcgcaggcagtcgggtcttgggagggccgcgtacnnnntgtacctggccgaaggcttcctcgactgcaccgtagtggcggcgaagcagaggagcagcagcgcgaggacnntggcccgggtggcggaggtggngnnncagccggttgccatgggggtcgatctgtgggtgcaagtggaatggatgccgtggatgtnnnnnnnnngcctctnnttg

SEQ ID NO: 100781 - DNA, 276 bp, Triticum aestivum
  unsure (1)..(276): unsure at all n locations
  Clone ID: PAT_TA_100781
cgcaagcggagagattgctcttgcttgcactgaccatcgtcgacgcaagcaacccacggacgacgcaagcaacccacggaccatcgtcgacgcgtagccggacaggcggccatgaggggcgaggcgaggatgctgtgcgcgctgggcctgctgctgctctgcgtggcggcgcacctccagggcgcgcactgccgcggcggcggcggcggcgggggccacggcggaggtggaggtggaggccacggtgggggcgggggcnnnnnnnncnnnnnnnnn

SEQ ID NO: 100782 - DNA, 360 bp, Triticum aestivum
  unsure (1)..(360): unsure at all n locations
  Clone ID: PAT_TA_100782
actgaaaaatgccancattttaatctttaatgaacaattgtcaaaattaatacaaaccaagccataacaacaacaaacaaaacttaatgctcgcttttaaaaaaaaaaaaaaaggtgaatgccaatacacctacaaaactcaactactactaataccattactttaccctaaaataaaatatcaaaacccatacaaattaaataactgaaatggatagggcaacaccccccacctgactgttaatataatcatcaaaaacaaacaacaaggcaaatgaaaattttccacctctaaaagccgggcaaaagaaggattgccnccctcaattattaaaaaaaaaacaacacacctacattact

SEQ ID NO: 100783 - DNA, 614 bp, Triticum aestivum
  unsure (1)..(614): unsure at all n locations
  Clone ID: PAT_TA_100783
gcacgagggaacatccgcactcagtttgccagagagctcaaggttctcaagcaacgcgttctggaagcatttgggcggagagacaggtacatcggcagcaacaccctatctgcaccggtggagctgggcgcctcctcaaaattcacctcctacaccccggagtctgagctcgtgggcatcaccaagccaaaagcagagcttcttgaattgcttggggaggaagagaaaccaaggagggtggtctccatcttgggacctcgcggcatcgggaagacaactcttgctagggtggtctatgatgacacttgtgtgaagagccaatttccttgccgtgcttgggttgtggcctcgcagcacagaggagacaaagagattctgaaggagatactccgacaagtcaaggtctcctcctcttctgatgcggatctcggtgaagatctcaatatgcacctgcagactaatacgaggtacttaattgtaattgatgacatgcagacttctctactggatacgatcgggtcttacttctccagtaatggcagaatcattgtgaccacaaatatgcagtccatagnnnntagctgcagcacgaatngnnnnntatatatacagaa

SEQ ID NO: 100784 - DNA, 575 bp, Triticum aestivum
  unsure (1)..(575): unsure at all n locations
  Clone ID: PAT_TA_100784
caccaccacagccccactctcagagagcacggacgccggacacgcacgagtcttcttgaagcaatggcgaccaccgcgatggcgctctccccctcgtccttcgccgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggacaccgcggggctgtcggccgaccccgagaccttcgccaagaaccgggagctggaggtgatccactgccggtgggccatgctgggcgcgctcggctgcgtcttccccgagctgctcgcccgcaacggcgtcaagttcggcgaggccgtgtggttcaaggccggctcccagatcttcagcgagggcnnnntcgactacctcggcaaccccagcctggtccacgcgcagagcatcctcgccatctgggcctgnnnnntcgtgctcatgggcgn

SEQ ID NO: 100785 - DNA, 494 bp, Triticum aestivum
  unsure (1)..(494): unsure at all n locations
  Clone ID: PAT_TA_100785
gcacgaggattatcacatccgaacatcctcgtcctcccgctcccgtgcggctccacagccgcaccggagcgcctcaaatccggccggctagggccctcccgcctcctcctctcccctcaccgccgccggagggcgccaccgggcaaagcccgggaggcgtcggcggcggtggggccgtttgacggtgcggcggcggcggatctggtggccttgggcgccggcagtgggatgtgctccaggggctgcgcgcaccggnnngttgaggggctcgaggttgcggccgtggctggcggagttgtgccagcggcgaggaggcacaaaggggctgcatcaggagggcgcgaagaagttgcatctggtgggcgcggacgagntgcatcgcggcgcggcctggtgtggatctggaggtccgtgtggaggagcagtgcgggagtnnnntcttggcagccgnggcggatctgcctccgcgtgtgcgannnnntcttgctgcctgg

SEQ ID NO: 100786 - DNA, 556 bp, Triticum aestivum
  unsure (1)..(556): unsure at all n locations
  Clone ID: PAT_TA_100786
cgatctccggggactgaattctgaaaccaccgcccgcctctgctcctggaccgctccgcccccgtcctcccgccgccggcgccgatggagcgcctccgggtcgccgtctcgcaccgcccgcctctgctcgtcggcgccccgaaccatctccgccgacgccagctccacctccccctcccgctcgcatcccgccccctctcttcgcggcatcgcctgctctcccccgcccctcgccgccacgcgcggcacctcctcgcctcccaaacgcccggccccgaatccggccctgaccccgacgcggaggccagcgctgaaccggccggcgccaagctcgtcccgctcgtcgtctccctggcggccggcctcgccgtgcgcttcctcgcgccgcggcccgccgaggtgaccctgcaggcgtggcagctgctctccatcttcctctccaccatcgcggggctcgtgctgggcccgctccccgtgggcgcctgggccttcctcggcctcaccaccgccgtggccacgcggacgctccccttcgagnnnnnnttcnnngncttca

SEQ ID NO: 100787 - DNA, 366 bp, Triticum aestivum
  unsure (1)..(366): unsure at all n locations
  Clone ID: PAT_TA_100787
nanncaactaaaaataataaacatcctttaggcaaccaaatgtcccatacattttttgttacaacttacaaaaaacaactgccccaatggaaaaataataatttttttgttcaagttccaattttgcaccatataattaaaactgcaagtcaaaaccaaactgccctgctaaaatttatccctggggaaacaaaaaaaatatttaaaccacccaaaccaccctgtttcatttggaaaaccattttcataacttatgtgtcggcaaaattaaaggccgttacaaccaatcctgncgggccaaaagcaaccctgacatcnncataatctttcaggctcttgctcatttttacaaatgggtncnnncag

SEQ ID NO: 100788 - DNA, 614 bp, Triticum aestivum
  unsure (1)..(614): unsure at all n locations
  Clone ID: PAT_TA_100788
gcgtccatagggaagcagcaatggacgccgacagtggtagtccttgggcatcagttcaaagaaaccgactgctcccgatccgcacgtccagagaacctgccgacactgagtggacgccgcccgcccgttctccggcggaggagcccgtgagccctacagcaagagtcatggaagatataggtatttatatcgtcatcacgttcggcctcgacacgccgataaacctgaccaccttccaagccggcatcgaagctatgcttgcccgatgcccacgctatagatgcattcaagtggtggatggatcaaacaatggcgaggcgcgatgggcgcgcacgacggtgaatgtccaagatcacatgatcgtgccgagcctggaccacgcagccatggcgaccgacccagacaaggtcgtggaggactacgtggcctctctgtccacgctcccaatagaccgctcccgcccgccgtgggagttccacttcctcgacttccccacatccgnnnnnnnnnnnacggnngnnnanccgcgtgcaccacgcctacggcgacggcatgtctagtatggcgcttctcatgatgtcnacgcacagcgccnnnnnngacnnnagaagtca

SEQ ID NO: 100789 - DNA, 594 bp, Triticum aestivum
  unsure (1)..(594): unsure at all n locations
  Clone ID: PAT_TA_100789
gcacgaggatccagtccctgccgtgccaatccgcagccccatcgctctctagattctagccccacagcaagcataggatcaaacctctagtattaattcaagagggctctgctcgccggcgccggagttgaaagacagagacatatatagccgccacataggcagccagatgttggggggcgggaagatgaagggggacgcggttagcggcggcagcagcaacattagccccatggtgtccttcctgctgggcgccgccgtggccaccgtctgcgtcctcttcttcatgtccgccagccccggccgcagcctcgtcgacgtcgccgcctggagccacaacaacggcaccgccgcccagcaccaccacctgcgctccgtcgccgacgacctcgacgcagcccgcaannnacnnntcgtcgccgctccggcgcccgcccccgtccaggctgcgtcgccgtacggggacctggnnnaggtgctggcgcgggcggcgacggcggaccggacggtgatcatgacgcagatcaacgcggcgtggacnngccggggtcgctgctggacctcttcttcagagctncnnnnnngnnnnnnnng

SEQ ID NO: 100790 - DNA, 603 bp, Triticum aestivum
  unsure (1)..(603): unsure at all n locations
  Clone ID: PAT_TA_100790
gcacgaggcagtcattcatcactgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccangnnnggcat

SEQ ID NO: 100791 - DNA, 479 bp, Triticum aestivum
  unsure (1)..(479): unsure at all n locations
  Clone ID: PAT_TA_100791
gaaaataacgtcaaataattaatatatacatctagatatcacttgtcacatgcatacagtagatgccaagacatccaccagccatcatgagccatcacagtttgataaaaaataggcttgctagctagagtttgctacatctaattgattaagcatctcaattagcacgtacagactgatgtaggtcaactacagtttcctacatcacagaacatgtaccagcatgttaactatacatgcaccaaaatgcactccacgcactatacatccaagaacatcaaggaaccaactggctgctcaatagtgataagctgagtgcaccagctccagattgactgaaaaatcccccaaacatcccttcatcgtctacatcagnaacacttgcagcaggaacacttgaggcaacaccatgttcatgaaaagagctgggatttgtttcttnntgggcacacaaagctgnnnnnncttcgcnnntttct

SEQ ID NO: 100792 - DNA, 661 bp, Triticum aestivum
  unsure (1)..(661): unsure at all n locations
  Clone ID: PAT_TA_100792
ctatttcagttatttgtattatttgtgtcacaatgccttttcttcatatgcataacattttgcataatttccttcattatgtctgtaatgcaagtgtttgcgctcttttattcattttgtattaggcaatgcgcattgtagcagaattgatctatcccaatgtttgcgctcttttgcaagtattgtttctgcactaaagaaagaaatatttgctcataaacttgggtctttggtactattctgtaaaagtagataactgattttaggggctacgcacatttagtgttcttgctcctttccgagtccaaaaaagctcattttccacatgtctaaattttcgataaacatgcgaaaattggtttgctccctttcctcactagaagcatatggtatggtttgttgtgtatcgtcgaaataattttggttgatgacgatatcctgtcactcactcagccggtctgattgtttgcactgatactctcttgggtttcacccattttgttaatatttgagccatgatacatccctcttgatcttctctagaaaggaattcagtctgtgaagattttaataggtgttcnnnncgttatcgnnnntaattagaaatggataccatcnannnnntatagtncagtaattactttaaaattttatttatgnn

SEQ ID NO: 100793 - DNA, 492 bp, Triticum aestivum
  Clone ID: PAT_TA_100793
gcacgagggtggcttgccccttagtccggctgcctcagcaccagctccggcggccccgcttcctgaccgcctggtgctgcgtccccttgctctctcccgcaagcggcaggccggctggttaaagaaagtgggccggctagaagaaagaaaagtcagcgtctgaaggaaagaagaaaggggccgggtgcccatccggttagagaaaagaaagaagaggtcggatgctgcgctccactacggccacctgctgcgatcgtgtgcccaaaaagaaaagcagaggccggctgcccacgctggctaaaagaaaaaagtcaagggagtcggctgctcagcaaaaaaaaaaggagaaacatgcgcgcccgcctgccgacggccggcggaagaaagaacaaaaagggcgctgccagatgcctcatcgcctggccgttgtccagccggctcgcccgcgtcacgctcatctcctggccagtcaagctcgaccggctggaccct

SEQ ID NO: 100794 - DNA, 533 bp, Triticum aestivum
  unsure (1)..(533): unsure at all n locations
  Clone ID: PAT_TA_100794
attccatagtttcctttatttcctaaaatactaactatatgtgttcgtttcaagagtattacacttggtagcagtgtgttccgatgcatccaggagaaattagagtagtgaatgcattaggaccctgcaaaataatataagcgtagatgaaattcttacacatacacaacatctggctctatatcctagctcccgcgttcttctcaccaggactcgtgttgaagtcatcatgccgctgccgccctgtgttgaagttgcatcaactcctcgtgttgatgcccacgcagtggcaccactgtgccgtaacaatctggggtggcttagtgtccttttgtgcccccatctccagctcattgcgcgcaaatggatcacaagttccctttttcagaaggtaaatcatgagcacattaatcttctcggaannnnataatttggtgtgcacccatatagaaacaacaaaagtggctctcaaatatttcaaatataggcctgctaaaatacaacacccactcaaganngnnagtcacacaact

SEQ ID NO: 100795 - DNA, 470 bp, Triticum aestivum
  unsure (1)..(470): unsure at all n locations
  Clone ID: PAT_TA_100795
cggaaacatctgcccgctcgctcgcttaccgagcaagctttccccaccttcccccgccccgtccccctcctcctggcggtggcgacgcgatcacgacacggagactttctgctacccctccccgccgatcaccgtcgctccacgcgccccgcggccagccagataaaaacctggggtggggagactcggagcccctggccgagcaggggattgcgagtcgcggagatgaagaacctgttcaagagcaagatcaagtggcagcaccgttccaacgacgcctcctcgtcgcagccgcagtcgtcgtcgacctcgccggcgagctccccgtcggggacggcgcccgcgcccgcgctgtccgcggcgacgccgacggcctccgccccgtccccttccgccccggtggcgacgacgcccacggcgggggttggtgggggagggggaggcgcnnngggcnnnnncgactacatgta

SEQ ID NO: 100796 - DNA, 618 bp, Triticum aestivum
  unsure (1)..(618): unsure at all n locations
  Clone ID: PAT_TA_100796
gcacgagggatctctccaatctcctatcgcttggccatgtctcttctagggttcccatttccgccgcctcccgccttcctcctccgccgccgcacctcgccctggctgcctcgtgacccaaacccgccacccctctgcctctccctcttcctctccctcgtactctcgtcgccttctccacctggacatggacgcacccgccccattgcgcacgtctgtgcgtatttccctggaacgtccccatgtcgggatccgccgccggcagtcactcgagcgggttgggggcatggatgcagcagccgccccattccccgcgtcagtgcatcctcgcgtaaccctagagcatcttcaatgtgagatccgccgctgcccgccgtcttcactgctcgcacgagctgagccggcgagccctcggttgtctgctccctcgatcccgccgctctccgtggtgccatctgttgtgaaggccgctgtccaccatagannnnnnntttcttaagctacctaaaggagctctctattgacatcaatttnnnnnnncnngcagtatccttgattgagtacaggtgtgtgcctcggcctccagtctgaatgaacaacccttgtattnnntgnnan

SEQ ID NO: 100797 - DNA, 570 bp, Triticum aestivum
  unsure (1)..(570): unsure at all n locations
  Clone ID: PAT_TA_100797
gtcgagcactcaggagaaggaggtagccatgccgacggatgcaggcaagaaggcgtatgttgttgccctggtgatccaggtgatctacaccggcatgtacgtcgtctccaaggcggccttcgatggcggcatgaacaccttcgtcttcatcttctaccgccaggcagccgccactctcctcttgctacccctcgccatcctcctcgagaggagaaacgcgccacccatgtcactgtggttgtttaccaagatcttcatgtacgcgctactcgggaacacggtgagcatgaacctgcacaacatcagcctcaagtacacgtcggcgaccgtggcatcagccacgagcaactccatccccgtcatcaccttcctcttcgccgtcctgctccatctcgaagccatcaagctccgcgccgcctcgggcacggcgaagctcgccggcgtcgcgctctgcgtggccggcatcctcgtcatcgccctctacgccggtccnnngctcagccccctcaaccaccaccgcgccttccacgcgcacgccgccgcaacggccnnnnnnnnnncnnngggnnn

SEQ ID NO: 100798 - DNA, 620 bp, Triticum aestivum
  unsure (1)..(620): unsure at all n locations
  Clone ID: PAT_TA_100798
gcacgagggacagagcagagcattgcacggcatcgctcgcgcgccactcgagagcattgtgctagctagtgagggaagaagctagtggtggtggcaatggcgggggcacctttggtgttggtgatgctcgtggtggcggttggtgtcgcggcggcggagcgtggcggaaagctgcagcaggggttctacgagcagagctgcccgcgggcagagcagatcgtgaaggactacgtagagcagcaaataccccgggagccatccgtcgccgccaccctcatccgcacccacttccacgactgcttcgtcagggggtgtgacgcgtcggtgctgctgaacgcgacgaccggcggcggggaggcggagaaggacgcggcccccaacctgacgctgcgcggcttcgacttcctggaccgcgtcaaggccctcgtcgagcaggagtgtccaggcgtcgtctcctgcgccgacatcctcgcgctcgcctcccgcgacgccgtcggaatcatcggcgggccgttctggcgcgtgccgannnngcggcgcgacggcagggtgtcgatcaagcannnnnngctggaccagctcccggcgcccaccatgaacttcncngannnnctcgccnn

SEQ ID NO: 100799 - DNA, 630 bp, Triticum aestivum
  unsure (1)..(630): unsure at all n locations
  Clone ID: PAT_TA_100799
gaaaaaatacaaacacacatcatcatcaaggaagggtgcaatgactacaggacaaaacatctggatcttgacatgtggtcacaattcccagtagagaagcagacatacaagacatacactagagatctttactgcaagttccgtgatgagtttttgatgattggccactacaatgcattccaaattggtgtggaaacgtttgagctgagaccaaatacagaatgggttgtgaagtatggtttcaggaactacttagtggtggcaaaaatacccgagggatactattcatatgagtgttgcaaaatggagagggatggcatcctttgttgccacatacttaaagtgttcacgcatattgggcttgatgtcatcccggagcagtacatgctgcagcattggacgccaattactgtcccaagtgtgccaagtgccactagccagcagtctgatgtaatgcctcccacctctctaaaggaaattaggcatgcaaacatgactgcagatttctagaaactnncaaagtnnnnnnngtngnnnctgatgcagcaaaagacattgttgataagcacatgcatgcactcacagagattgtgcagctgaacaagtctatnnnnncnannnnnnnnnnnc

SEQ ID NO: 100800 - DNA, 608 bp, Triticum aestivum
  unsure (1)..(608): unsure at all n locations
  Clone ID: PAT_TA_100800
gcacgaggggttcgcagcacggacgtcagtcgggccgacgaaaacacgcaaccgcgataagcaaaacaggttctgcgtggtcagagctagctagctagcgtggttggtggcctggtgcaaataaacgggccagcgtctctcatcaccttctcccgttcaaccactttgctgccgcgccggcatgtgcagcagaacactagctaggagctccagccctggagcgatacatagttgcacgccctcgggcctgcccttgggttggcccgtacgtggcagcatatatacacctgtcaccggcagcccatgtcaccagacaacagcgaacaagcctagctaagccctctctctctctccctatcgacggccggccacgtgctcccttcctcctcgccgccggtcgtttagcttagctacgcaccacggcgtacgtgcagtggagcaaggagcttggatcatggcgtcggcgaagcacggcaacactggggggcgcaaaccctcggtgtggaacgacttcgaccgcgtcatcgtgttcgtgcccggcggcaccggcgcggnnnnncatggcggtgtgcaagnnntgcggcaccaccctccaagccagcgcnnng

SEQ ID NO: 100801 - DNA, 234 bp, Triticum aestivum
  unsure (1)..(234): unsure at all n locations
  Clone ID: PAT_TA_100801
gcacgagggcgcaggcgagaggaaggttcggcgcgagccgtcgctggggcaggacgagctgaaccggcgtgtggaggccttcatcaacaagttcaacatggagatgcggctgcagcggcaggagtcgctgaagcactacagcgagatggtcggcagcggcggcggccgttactgaacagagttctcccatgaactgaactcgggatgggagnnncnnngcaagttacttcnnnn

SEQ ID NO: 100802 - DNA, 527 bp, Triticum aestivum
  unsure (1)..(527): unsure at all n locations
  Clone ID: PAT_TA_100802
gcacgaggcacacttgctctgtcactcccggcctacaagcctcgcgttcccagtcacgacacgccgtgaagccaattatctccgacctccaagaccgaaaaccaagagcgatcccgcttgcagatggcgactcccgcgatcgcgctccttgatcagaccctgccgttcggcatcggcggcggcggtggctcggaccggctcagcaaggagatcttctccatcctcgagtccaacttcctcttcggcgcgcaggcgctggagccggccggggcgtgctcggcgggccacgtgcgcgtgctctccatcgacgggggcgccgacggcggcgcgctcgccgcggccgcgctggtcaggctcgagcgccggctgcaggagctgtcgggcaaccccgaggcgcgcgtcgcggactacttcgacgtggcnnncnggtccggcgccggcgggttcctcgcggccgcgctgttcgcgcgccggatgccggcggnnncggcgcgcgacatcgtgncnnnnnaccgnnnntgtnctcc

SEQ ID NO: 100803 - DNA, 594 bp, Triticum aestivum
  unsure (1)..(594): unsure at all n locations
  Clone ID: PAT_TA_100803
cggcagccgccgcctcccctccggccgcgcctccccgtagtccacctccggccgcatatcgatccggtgcggctactcacctcccggttccaaccacggcgcccggcctaccggcaccacgaccagccaccgtctccagtctccacctcctgagtaccgcctcgactggccgctcgacgtcgccgctggctgctccggcaaatcgccgtcctctacaccgcctccttccgaattgccgccccgctcacttgcagcacgcgtagctgctgggccagccgaaaccgacaggaggctcgggtcgagatgacgtcatcgccaaccgtgagcgcgacgatgggggtaatgaatccgctcctcggcaagctcgccacgctgatgggggacgagtacaggaagctcaagggggtgaggaagcaggcgtcgttcctcatgcgtgagctcggcgccatgaaagctgccctcgagaagctggaggtcatggaggtactcgatccgctggcnnngaactggagagatcatgtcagnnngatgtcctacgacatggagaattgtatcgacgacttcatgcgtcaatttgggggtgccgatgctnnn

SEQ ID NO: 100804 - DNA, 622 bp, Triticum aestivum
  unsure (1)..(622): unsure at all n locations
  Clone ID: PAT_TA_100804
gcacgaggaagagtcgccatttcgcgcggcgcaggaaccaaacctgcagaaaaccaatggaaggagcaggcgaggagaagccgcacgccgtgtgcctgccgttcccggcgcaggggcacatcaccccgatgctcagcgtggccaacctcctccacgcccatggctttcacgtcaccttcgtcaactccgagtacaaccacgctcgcctcgttcgcacacggggtgccgctgtgctcgctggctccccgggctttcgcttcgccaccatccccgatggcatgccgcagccgtccggcgacgtggatgatgatgtcacgcaggacatcccgtcgctttgcaagtccaccttggagacttgcctcggccccttccgccgccttctcaccgagctcaatgatgcggcctccacaggggaccacccagtcgtgacttgcatcgtctcggacctcaccatgtgtttcgccatggatgccnnnaaagagctagacgtcccatatgtccagcnnnggacnnnnagcaccgttagctatctcggattccgttatttccgtctcctcattganngtggcattgtcccacttcaagatgtgaaacagctgacagatggataccttgacacccc

SEQ ID NO: 100805 - DNA, 517 bp, Triticum aestivum
  unsure (1)..(517): unsure at all n locations
  Clone ID: PAT_TA_100805
gcacgaggcttcgtttctttagaagtgaaaacatgcctcatgttataccgcacattattctagtgtttagtcatgtctacaatggctgctgtatttgctttgccatttgatggaaataattaaaagagaaatttaattggtgtgctccgattctccacctcatggcactgacggtcagtctatcatgaactaggagtcgtgaaattgtttannttcttattgtttaatctaatcttacaggcaattcattgaatctgggtcgaaccactatattgtctttgttgcttaaaaataattagatgcaggaaatggaagtatcatttctgcatgaattgtttgtcctagtagtgtttattttatcataacatgcgtttcttgacctatatggcattatgccttaatcacatgttgctttaatccaactttggtcactgcttgnnnnntaagcattataaaggttgctgctcaccaaattgaacctgaaattgtatttttattannnnataatcgatnnnnt

SEQ ID NO: 100806 - DNA, 638 bp, Triticum aestivum
  unsure (1)..(638): unsure at all n locations
  Clone ID: PAT_TA_100806
ctctccctcccgcgccccttcctgccccgccgtcgccgtcgccgctccccgcactcgctcctcctccccccgcatctccctccctcccacgcagccgcctctctccctcgggcacactggggcagggggtctcgccggggacgatagggctgccggccggagttggatcgagatcccggcccgcatcgcgccttgacaaagcagcaggccaaggcggcgctgcccttctccgccctgtgcgtgcggatatccagcaactactaccccaacctcggcgccctccgcaacgcctcccacgtcagcctcaccgacgccgcatacgtcgagatctccgagggcgacttctgatacgtccttgacgacgtgcgccacctcgcccccgacgtcccgataaatgatgatgtagtaatggatgccttctgaacgctacatgtgtggttcctgaattggaccatatatttccgcgaagatcttcaaggtgaatgcttcttttgtcatgttcgctcggtcatcgaacaaaccctnnnntnnttcgactgatttccttctatgcttggnnnnntgatgnnntcgtgctcgtcggcgggatgnnncaaggcgcaactcctacgcgnnncctcgccggtnggannnnntnc

SEQ ID NO: 100807 - DNA, 283 bp, Triticum aestivum
  unsure (1)..(283): unsure at all n locations
  Clone ID: PAT_TA_100807
cnncaacaatttgggggaaaatccaccccacccccccccgttgggcgaaaaccaccaccattttgtttagaacaaagncacctttccaagccccaccccccaatttccaaccaaaaaaagggcggctttccaccggaaccggctacctaaacccccttctggcctaaaggccaaaaagggtacccaaccctcccccaacaactttggcaacccatccctcccttggcccccctgcttcccagggcccaccccagggnntannccctgggatgggcccctgttt

SEQ ID NO: 100808 - DNA, 196 bp, Triticum aestivum
  unsure (1)..(196): unsure at all n locations
  Clone ID: PAT_TA_100808
nnngctataaactcatgttactctttctttatnncatggaacctccccttgaacgtggacaaaggtaattaacatgcatgcataatcggaaagaacggaatacatccccacaaaaagaaaggcggataattaaaagacaacatgtggcgcaacaatgctccacnnncacaggtncaccannaaacaaaaactnnnn

SEQ ID NO: 100809 - DNA, 268 bp, Triticum aestivum
  Clone ID: PAT_TA_100809
ggaccattggtttattattaataataatcaagaaaaccgtaccaaaccacttgggaaacaaaaaattgggggaccccggattacattattatcccccccccccccaaaaaaaaaggcccgaaaagggaaaacattattccccgcctataccaccattaaatattcccctgaaccccacccaaaaaaaaaaggcgggcaaagggcccactgggtacccaattggaactggaactcaaaatcccaagaaaactcccgccattttaaaagc

SEQ ID NO: 100810 - DNA, 630 bp, Triticum aestivum
  unsure (1)..(630): unsure at all n locations
  Clone ID: PAT_TA_100810
gcacgaggctttgaagatacaccggactatcagtggcgatttaattccacttatttcttagctacaatattccatagaaaaaacatgaactttaatatctgagtgattagtgtgctttgtatatctgatgtatcggggaactctaatatctgagttatatatatggttgtctggcaagattggttttcacctatctagctcctcagctcaaggtttttaagatgatacatttcttgatacatcaactacccataaacgtacctcatgttttcttaaaggacaactgatatctcaatcagctcacccttttctgccaaaaacctatcatcatgttccttacaataagttatgcttctgtttgtacatttgcagcttatggtgctgcatctttggttctttttattcaattcagagcaggtgacaatgccttatattgattgttctggataggtatttagtcgtaagagatatcacctatgtgtctccagaaaagcaaaaacaacaattcactgtngatttactttgctatgattgctcccattaganngtccttaaatcatgtgcaaaactgaagtattgtgttggctgactgtcagcctgacaatgagatgggatgatgatgcagagnnn

SEQ ID NO: 100811 - DNA, 177 bp, Triticum aestivum
  unsure (1)..(177): unsure at all n locations
  Clone ID: PAT_TA_100811
gcacgaggcaggaacagaacaaactcaacctccgannnagaactgaaaacatctactacacagtaagatttccccccataacattactcaaggtttagtaaaatcttgcaccccccaggccctaagaacaaggcaagcagcgcatggttttgcaaatatacaattctcgagannnng

SEQ ID NO: 100812 - DNA, 618 bp, Triticum aestivum
  unsure (1)..(618): unsure at all n locations
  Clone ID: PAT_TA_100812
gcacgaggctctcatcttgctcttcctctccacatggaaacagatccgagtctctctcaaattgcaacaagggaagttgaggcatggatctcctgctatgacggagctcatctagatcaggtttttggacatgcatgtgtgaacattgctccacaattaattacactgtaatacattagcaggtaaggcgaatcacttcttaagattccccatcatgagtaactacagaaacaggtgcatgaccatgtctgctcacgaacaagcgaagctatgctatctgatgctaaatctagcatattcggctagatctgctagggatttactcgaataattatctgttatattttaacttcttcttcgcaatttgtatttgatgaatcatgctttctcaaagtttaacataaannncgattttggacatttactgagaaactggagctaggtgttatgagcatgattcttcaatgcagagaataattggaggaccagtaagaaaattttcatgattttgcnaagtgcgccgcnatgctcnacccacacttgcaagccctccaattagntnnnngtataaccacgagtatcatccatttaccccaggatacgagagctttctctcat

SEQ ID NO: 100813 - DNA, 609 bp, Triticum aestivum
  unsure (1)..(609): unsure at all n locations
  Clone ID: PAT_TA_100813
gcacgaggccacgccgcaagcacacgcaaacgcctcctctactcctttctctccgcctgatctgcggcggctccctcccatggtcccccgccgcaccgagggggcacggcgctgcagagatgcggggcgacgtgccgccgcctaccgcgcccttggcttcctcctcatctccggcccctcgatcctcttcgccggcggcgagctcttcgggtcggggccctcgccgctcgtcttcctgaccctgttcctgatcgaaggcggcggcatggacctctcccgcgtgggcgagaagctcctcagctccatccgctccgcccgctccctcagtctcctccccccgaccccagccccttctcgcgccgaagtaccgtgttgctccctccctccccgccatccaccattcatgctgtgttagatccagcgattgggcaaggtgcccttttgctcggcactggcgacgatgacgacataccagagtggaagtggttcgatgacttggatgacgannagagctacgagcggttcctgcagcgtgagcgacgaagagtgacggcgtgcgactacactgaagtgtacgcctccattcaagcaactgcggccgtcgcgtnn

SEQ ID NO: 100814 - DNA, 529 bp, Triticum aestivum
  unsure (1)..(529): unsure at all n locations
  Clone ID: PAT_TA_100814
gcacgaggattttactgtccagggtttagcttgtagtgtcgtttttgaaagacagtaacacaagaaggtcttatccgactccataattttactgtatgagacagccggtataattttcagtttgtagagctctgtggttccctgtttttctgttgttctatttttctattgctgctcagatccatgttgtcttgaattgtaaagtacaactacaagttcaaacctggacatttttagagcctgaacattttcagttagtggctcaaaactgctccactagagtagacatttaacttaatcaatttaccatctagacaaatactcctattaattccatctgaggagtagacatttaacataaggtagccccattttaatttaaatgtagtctatttttgttgcaatagcccattagagtgacttatcgttcatgagcggatccttgttttaatgtgtttgattcgaggcgccacctcnctatgnnnacggcgccttctcccgggctctctcnnnnntgaactatagcgac

SEQ ID NO: 100815 - DNA, 236 bp, Triticum aestivum
  unsure (1)..(236): unsure at all n locations
  Clone ID: PAT_TA_100815
gcacgatggatcaaggagccgccagcatctanntacttgagagacagatcaagattacggagatatgaacggcggagggggcgtgggcgcgggcaagatcagcctgcggctgcagtactacgtgctgctggcgggggtgggggccgtgctgctcgtcggctgcctcaagtacatgccggcggcggcggtggtggcggccgggtacgggtcctgggggannnngctggcctgatnnn

SEQ ID NO: 100816 - DNA, 607 bp, Triticum aestivum
  unsure (1)..(607): unsure at all n locations
  Clone ID: PAT_TA_100816
gcacgagggttagtttgaattatgatacatattgttcatgggcataggctatatatgtattaacttacttgattcgtaacgattttacatagtattcagaggcaaatattgtgtgataactatcaacagttttaagttacgatttagcttaactcccccccccccccccctacttgatcgagattataagcatgatggcacatactgttaacttttccccttaattggttgagattataagcatgacacatattgcttttgctttggttctactttccccacttatttggttgagatgataaacatggcatgtactataatttttaggtgccttggtttcaaaattagaacattttaatctgttttgagcttacttaaaaatttattcgtccctgatccattgtgctgtcatttttccctcttcgatagagaaggtcacaattagaaaggtgaaaaaggcatgtagtttttacataagtttatgacctgatgttgtttatgtgtgcttggatacgggcttctgtttgtctactatttctcatcaattcatttgttaactanttgactcatatcctctaaccactcttaaatttctnnntnnnnncnt

SEQ ID NO: 100817 - DNA, 546 bp, Triticum aestivum
  unsure (1)..(546): unsure at all n locations
  Clone ID: PAT_TA_100817
tccagacctcctcactcccgcaccgcacgctctccctctctctctctctcgcaacaaaacccacgccaattccgcccaaaccccaccggagtctcgccgccgccgcagatgcagacactcacagcctccacctcggtctcctccatacagcggcacacgccgcgccgcacgggccggtccggctcgctcagcttctccgcccgcgccgtcagctccccgccgcgcgcgccggccccgtcccggttcgtgcgcggcgccgacgccgcgccggccaagcccctcattgccgtccccaaggcgcccgccgtggagaggcaggagaagaagctcaacttcttccagcgcgccgcggccacggcgctcgacgccttcgaggagggcttcgtggccaacgtgctggagcgcccccacggcctctccaggacggtcgaccccgcggtgcagatcgccggcaacttcgcgcccgtcggggagaccccgcccgtgcaggctctgcnggtcaccggccgcatcccccctttcatcaacggnnnnntacgnnngggn

SEQ ID NO: 100818 - DNA, 612 bp, Triticum aestivum
  unsure (1)..(612): unsure at all n locations
  Clone ID: PAT_TA_100818
gcacgagggatctaatttccatcataagaaaatctccaaaacacttgcatgcactttcattttcagttgctatttatactgaaaatagaaaaacacttgcatgccacattatctcctaattacttgttgaggcacaaaataagcatttaattgtattgcaatgctgctggactaaagctaaaggtgttatctctaaggattgatacattggtttatcaactgaagaaagagaacatgccaccattataaacccttgcgcttggatttggagcaaacaacgctgcctgttgtggaagtagaaacgccaaatcacaagcctgctgtcccatactctggtatgtgttcttcatgtgcattgtctaataccaagtgcttccatctaatgtgagcaagcttcatcttgttctcctgtgattcacaccacttccttaatgtagagcagccatcaatggccagatattcaannttggtcagttttcgtatgctatctggcaatgatctgatccctttgcagtacttgatctgaaatctcttgagagaggtaagttctcctaaccattccggtagtgatgccatgctttcacaatgagacagacttagtgactgtagtnn

SEQ ID NO: 100819 - DNA, 539 bp, Triticum aestivum
  unsure (1)..(539): unsure at all n locations
  Clone ID: PAT_TA_100819
gcacgaggccgcgtcctccccctccgacctcctcggcgccacgctctccgcgctccgcgcccgcctcccgccggccgtctccaccgcgcgctccgtcctcgcctcctccaagaacgtcaacctcacgaccgccgccaccaactgcctcaccgccctctccctctcctcgcaccgcctcgagccgccgccctcgccgtcggcgctcatgcccgcctccgcctcgctcctccacctctacgactgctggtccgcctacaagtacgtcaacttctcccggaccatctacgatgccatggcgtacctcaacgacaccatcaccgtcaacagcaactacatctccatgctcgccgcgctgaagcggtacggcgacgacacgtccgtctgggcgccgccgcagacggagcgcgacgggtactggccttcgcccgcggcgtcgggggccgacgtggacgcgctcggcgtgcccaaggggctccccgcggacgcgacngtgtgcggcgccgggtgcgactacaggacagtgcgggnnncggtggcgn

SEQ ID NO: 100820 - DNA, 549 bp, Triticum aestivum
  unsure (1)..(549): unsure at all n locations
  Clone ID: PAT_TA_100820
ctgagctccacgccactacccttcgcccccagccatgatcatcaccaccgccgccttcccgtccgtctcctccttccaccgcccgcgcctcaagccctgcccgcgccgcgccgtcctccacctcgtccggtcggccgcctcctcctccccctcgtcgtcgtcctcgtgggaggagcgcgaggaagcgcggtggctccgcgaggagcagcgctggctgcgggaggagcagcggtggctccgcgaggagtcgcgctggcgcaccgagcgcgaggccctcctctccgagatcacggcgctccgcctgcgcctccgcgcgctcgagcctgccgccgcgcccgtgcctcctcccgcaccggcggctgcgcgcgtcgctccgcctccgcctccgcctccccccgcaccggctgcgcgcgtctctccgcctccgcctccccccgcaccggctgcgcgcgttgctccacctccgcctcctcccgcgcctgcggcacgcgtggcgccacctccgccgcccgtgccggcgccggtgannnnnntnnnggtgnnnanaga

SEQ ID NO: 100821 - DNA, 556 bp, Triticum aestivum
  unsure (1)..(556): unsure at all n locations
  Clone ID: PAT_TA_100821
cgacgctcaagcccccagacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccaagccgcaacgtcggcaagaccctcgtgtccaaggacacagggtaccaagattgcctcagagggtctgaagcacagggtgtttgaagtatctctagctgatcttcagaacgacgaagaccaagcctacaagaagattaagactcccgtgctgaggattttcaagggatnaatttcctcaacaacttnctgggggaatggcntcaacactgacaagctcaagtcccctgtgaagnaattggnaaacactcaattganggtcaatgtttggattnaaaaanaattganaaatanaatgcntccnaatgttcnccaattgggttcaaccaaaaaaaacccccgaaccaaagttgnanccccantttttttgccccaaacnaaattta

SEQ ID NO: 100822 - DNA, 541 bp, Triticum aestivum
  unsure (1)..(541): unsure at all n locations
  Clone ID: PAT_TA_100822
gatcatttaagccaagcaagcagtgctcaatacaaatccaccatgaagacctttctcatccttgccctccttgctattgnggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcagccgcaaccatttcgaccacaacaaccatatccacagccgcaaccacaagtattcgcaaccacaacaaccaatttcacagcagcaacaaccaccatttttgcagcaacaacgaccaccatttttacgggaacaacaaaataccaagtttattccatcccatcctggttttgcaacangctaaaacccatgccangggtttcctccaaacanncagtggcatcccctgggg

SEQ ID NO: 100823 - DNA, 433 bp, Triticum aestivum
  unsure (1)..(433): unsure at all n locations
  Clone ID: PAT_TA_100823
gcaaacattatctaacacaaatcaaccatgaagaaattcctcgtccttgccctcattgttgtcgcggcgaccaccanggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcaagcaactaaaaagcgatncccaaagcantcaagatcgaaggcatccacaacgnttgtgcaacgccaanttatttttgcaacaaacaaacaaaaaatttggtannaanggttaatttccaaccaaa

SEQ ID NO: 100824 - DNA, 571 bp, Triticum aestivum
  unsure (1)..(571): unsure at all n locations
  Clone ID: PAT_TA_100824
gccaagcaacactatttaacaccaatccaccatgaagaccttcctcatctttgccctcctcgccgttgcggcgacangtgccattgcacaaatggagactagccacatccctagcttggagaaaccattgcaacaacaaccattaccactacaacaaatattatggtaccaacaacaacaacccatccaacaacaaccacaaccatttccacaacagccaccatgttcacagcaacaacaaccaccattatcgcagcaacaacaaccaccattttcacaacaacaaccaccatttttgcaagcaacaacaaaccgttctaccgcaacaaacaaccaattttcggcagcaacaaacaaacaattttccggcaggcaaacaacaaaccaacctttttaaccggcancaaaccaaccatttttcgcaggnaaacaaaccaccaatttttctaggncacnangcaacaaaccacccatttttccnccngcaancaaacaaacaanccnattttcnaccggcaacaaagccaacaatttttcnaaaaacaaccaangaancccagtttccanccgg

SEQ ID NO: 100825 - DNA, 458 bp, Triticum aestivum
  unsure (1)..(458): unsure at all n locations
  Clone ID: PAT_TA_100825
gagagcacaagcagaaaatcaaagtacgtagtagttaacgcaaatccaccatgaagaccttactcatcctgacantccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccaagcctcagcaaccacaacaaccatttctccaagccccaacaaccattcccccaacaaccaaaaacaaccattcccccaggttcaacaaacaacaacaaacaatttcccccangaaaccacaaacaaccaattttcccaagacttcaaaaaaccccaaaaancaattttcccnacaaaccnacaaaaaaacccattccccaag

SEQ ID NO: 100826 - DNA, 537 bp, Triticum aestivum
  unsure (1)..(537): unsure at all n locations
  Clone ID: PAT_TA_100826
gttcagttccacctatcttggcttcaagacagttcgaggtttctaggtagcattgcaccaatgacaacaacaatgatgaccaccatcagcttctctgccattctattcatcttgctttctgtggcaatcactgctgagaccaatgactctggtagtggcatggcgagggtgaccaacgtcatggtggaagcatgcaagaatgcctcaggctatcatcgtgagcttaaaactatgacacaatgaattttgcttgtcgaccctccggtcaaacaataggagtgtggagggaaagggancaacttgaactggtgctaattgccaacnacatccttaaagggcgcctcaacactggcaatcanaacantnagaaaattgctaaaaaaaacaaaagaatnggacngtggcaaatgcgcgattntantaattncnaagggttctatgatacaacnatgggaatcctccaatattatgtnttttaaatngncaaaananttcccccgggngaaaaangggaagggtaaaantccctttntggct

SEQ ID NO: 100827 - DNA, 577 bp, Triticum aestivum
  unsure (1)..(577): unsure at all n locations
  Clone ID: PAT_TA_100827
atttcgagttccaccgcccgcgcccgcacccgcacagcaaaggcaaccggagccatggcccgtaccaagcagaccgcccgcaagtccaccggcggcaaggcgccccgcaagcagctcgccaccaaggccgccaggaagtcggccccgaccaccggcggcgtgaagaagccgcaccgctacaggcccgggaccgtggcgctccgcgagatccgcaagtaccagaagagcacggagctgctcatccgcaagctgcccttccagcgcctggtccgcgaagatcgcgcaaggacttcaagacggggcctnccgcttcnagtccacgccgttgctcgccctcaaaggaggcgggccgaaggcctancctcgtccggcctccttcgaagganaacaaanctcttgcgccaatcccaaggccaaagcgcgtcaacaatcaatgcccnaaggganatccaagctccgccccggccggcatnccgcngggggaagcgccncccnaangcngggangcggaanaaccaaatcaaaaaaccccaaggccncccccaatgccaacggtttcnccnaacnaattnatttt

SEQ ID NO: 100828 - DNA, 551 bp, Triticum aestivum
  unsure (1)..(551): unsure at all n locations
  Clone ID: PAT_TA_100828
gcaaacttgaggctagccaccatgaaggtcttcatcctggctctcctcgccctcacagcaaccaccgccattgcccagttggaaaccacatgtagccagggcttcggacaataccaacaacagcaacaacctgggcaacgacagttgctggagcagatgaagccgtgtgtggcattcctgcaacaacagtgtaggccactgagaatgccattcctccaagacacaggtggagcagcttagcaactgccaaatcgtgcaacaccaatgctgccaacagctagcgcaaattccaaaagcgaatccggttgccatgccatccacaacgtggtaaagggtatcatgcaacaaaaatnccaacaaaaattgggaaggagcgnccaacaacaaagcacaaaattanancaatgngggtttttncnttgnaaaactttcaattgttttgcnaanattctattttccccgggtacaattgccaancaagcaaacaaacaaattgggggnaancaaccaacaaacaaacnaccantttgcaagggagcaanttnaaancc

SEQ ID NO: 100829 - DNA, 590 bp, Triticum aestivum
  unsure (1)..(590): unsure at all n locations
  Clone ID: PAT_TA_100829
cgccgccgcctcctctcggctccttcttccttcgagtttcagccatgggtaaggagaagactcacatcaacatcgtggncattggncatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtgggaagttcgagaacaacaaagtactactgcancgtcaatttgatgccccctgggtcaancgttgaacttcaatcaaagaacaatgaatttactgggtaacctccccaaggcttgaactggttgctgttgctcaatcaattggaactccaaccanctggggggggntttttgagggntngggtatccccccaaanggaatngggccaaaaanccccgtngaagcnaaancccccccccttggcnttttaanncccttggggggtgnaancaaaattnannttgcctgctgncaaanaaanattgggttggccaa

SEQ ID NO: 100830 - DNA, 339 bp, Triticum aestivum
  unsure (1)..(339): unsure at all n locations
  Clone ID: PAT_TA_100830
gttttttttttttttttttttttttttttttttttggaatgcccagtatactcaactagcgacggncgtccttgtaaacccaccaatacagggtgtatgaaaacaaccaaaatcaacacaatactagtcgcgagagcaacaggcacactttttttaccggaagacaaatactatcattctacgattataggtcatacaacacatntgatagtgaaccaagtcntcttccattatatcttttctacgcatacatgtnnaaatcanaattccccgacanagtntagggagaacgaacatatgttttattagcaaaccngacgatnatnaaagncaagctca

SEQ ID NO: 100831 - DNA, 609 bp, Triticum aestivum
  unsure (1)..(609): unsure at all n locations
  Clone ID: PAT_TA_100831
gctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggtttggtgggattccccaagaaggaangaatggaaaggaaggatgttatgacgaaaaatgtttcaatctacaaaagctcaaagcatctgctcttgaagctcaagcaaccccccaatttgcaaaggttttgggttgttgccaanccaanaaacaccaatgctnccaacctgaaaggantttgctccatctatccctgaanaanaanaatcaatttgtttgacccgncctaaaaacaaaaacaaggcaactccggtcaanatttcctgaaaaaaacttggtgtccaaantttcctgaactttaaaaaatgccaattatnctgggggtaancaacnccgtcc

SEQ ID NO: 100832 - DNA, 595 bp, Triticum aestivum
  unsure (1)..(595): unsure at all n locations
  Clone ID: PAT_TA_100832
ccaatccaccatgaagaccttcctcatctttgctctccttgccattgcggcgacaagtgccattgcacaaatggagactagccgcgncnctggtttggagaaaccatggcagcaacaaccattaccaccacaacaacaaccaccatgttcacagcaacaacaaccatttccacagcaacaacaaccanttattatactgcaacaatcaccattttcgcagcaacaacaaccagttctgccgcaacagcaaccaagttattatactggcaacaaccaccattttcgcagcaacaacanccagttctaccacaacaaccaccatttttcacancaacaaacaacatcaacaatcancancaagcaacccaccattttcgcaagcaacaacanccatttctancacaacaaccaacatttttcaacaacaacaacaaaccancaattttcggcaagcangcaaacaaccaatctttcaanaanaaacaanctttttccaanaacnaacaaccaancnagttttccnacaacaacnaaatccccnggtngttcaaccaacccgtttttgcaagcanctnaaaccantgnaaggtggtcc

SEQ ID NO: 100833 - DNA, 608 bp, Triticum aestivum
  unsure (1)..(608): unsure at all n locations
  Clone ID: PAT_TA_100833
gcaatccaccatgaagaccttcctcatctttgccctcctcgccgttgcggcgacaagtgccattgcacaaatggagactatccacatccctagcttggagaaaccattgcaacaacaaccattaccactacaacaaatattatggtaccaacaacaacaacccatccaacaacaaccacaaccatttccacaacagccaccatgttcacagcaacaacaaccaccattatcgcagcaacaacaaccaccattttcacaacaccaacaaccagttctaccgcaacaacaaatancatctgttcaaccatctatctttgcancaagctaaacccatgcaangtattcctccaacaagcaaatgnaagccctgtgggcaatgccacaaaagtcctgctaaggtcncaaatgttgtggcaagagtanttgccatgtgatgcaacaacaatgtttgccgggaancttgccncaaaatccccggaacaatcaccctnacgaatgcaatccgngccaacaatctaatccgattcgtcctaanaagaacaacaacatggncaagggttttgaacaaacctcaacaagcaaaaaaccccaaaaagttccggtccaag

SEQ ID NO: 100834 - DNA, 593 bp, Triticum aestivum
  unsure (1)..(593): unsure at all n locations
  Clone ID: PAT_TA_100834
aataggtgctttgctctatagcttttccgttcccccacgggcgaacggccgcgcatcgggcctcctccctccaggctccccccttccttcttccttctcgccgccgtcgccggcgcccgcggccggcttggccctggggctgctggtggcggcggcctcctggccctttccctcccggtcgctctccggcgcgagcggagcggctccaggggggtgcatctaagcggcggcggtctggcgtggcggcggggctccgtggcgcatgcaggcgaactactgggtggcggcgggatctagcgtcgtccgctcggcccagatctgggccctgcaagccccatctgggccaaggcgggctggcggcggggatggatccgatgtggcttctgggaagctgcgganatgcnacccttggcttgggtgcccgcggttaacaaaactggtctgctgcaaccccgggccgaaggaantttaaagggncctcctcgggcctgggctggggcaaagggtgggcccnggaatgccccgctgccgcttccgggngggtaacaaaaatgtgctggangnaacgggccncccncanaaaagggggngng

SEQ ID NO: 100835 - DNA, 573 bp, Triticum aestivum
  unsure (1)..(573): unsure at all n locations
  Clone ID: PAT_TA_100835
ccggtttcgcagccggagccgcccgtgtacggtactccgtgccgcgatgtggtccggcatatcgaggttgagttcgagccccgcgagaccgagtctgctgacgaagccggaaatcaacagtgtcgagagcagtgctgcgaacagcaggaacagcagattattcgccgaagcaaacgcagcgagccccaccaggccgaccacgccagtaaacacgaagcccgtcttcgtgatctgctgccgcatgtcgggatcgagcgcgttgcggagttttcgccaccattcgcgcacgaagctcataaaaacatcgtgggaacgccaaacgctcaaccccgggtgacgcacttaacaaccggcttcggtctgccgctccaaaagcgggcgacttttgcgcaaactccctgcggccgcaacaatcccgcctggcccaaatgcccgttcgaaccctggccgcccctgaanaagtcgttgggggccaaacccgctccngggggccccggggaaaaacccgggtaagnccccgtttnnaatcctccgaaacccgccccaaaacggttcccgttcctccgccctggg

SEQ ID NO: 100836 - DNA, 524 bp, Triticum aestivum
  unsure (1)..(524): unsure at all n locations
  Clone ID: PAT_TA_100836
cctggtttggagagaccatggcagcaacaaccattacaacaaaaagagacatttccacaacaaccaccatcttcacaacaacancaaccatttcctcaacaaccaccatttttgcagcaacaaccttcattttcgcagcaaccactattttcacagaaacaacaaccagttctaccacaacaaccagcattttcgcagcaacaacaaacagttctaccacaacaaccagcattttcgcagcaacaacaccaacagcttctgcaacaacaaatccctattgttcatccatccattttgcagcaagctaaacccgtgcanngnattcctcccagcaagcagtgttacccctggtgggaatggcaacaacatncttgctaaggtccgcaagatgtnggaagcaagagcaatttggcaatngtgaatgccaagcaaanatggttgccaaacaatttgccancgnaatnccccgaaanaatnccccnctttngangggaatcccggtggcnatcaatcctnccccaaca

SEQ ID NO: 100837 - DNA, 535 bp, Triticum aestivum
  unsure (1)..(535): unsure at all n locations
  Clone ID: PAT_TA_100837
gtagagcgcatcatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcaagccgcaaccatttccatcacaacaaccatatctgcagctgcaaccatttccacaagccgcaactatcatatccgcaagccgcaaccaattttcgaccacaaacaaccatttccacaagccgcaaaccacaagtttttcgcaaaccacaaacaaaccaaattttcgcaagcaagcaagcaancaagcaagcaagncaacaacaaccaacaaacaaacaaacnantccctancaaacaaantttttgcaaacaaacaaactnganttccatgcaaggggattntttnttttt

SEQ ID NO: 100838 - DNA, 274 bp, Triticum aestivum
  unsure (1)..(274): unsure at all n locations
  Clone ID: PAT_TA_100838
tccaagtaagtattanttaacgcaaatccaccatgaagaccttactcatcctaacaatccttgcgatggcaacaaccancgccacggnnaatatgcaagtcnaccccagcggccaantanaatggccacaanaacaaccattcccccagccccaacaaccattctgccagcaaccacaacaaactattccccanccccatcaaacattccnccatcaaccnnantttgatttccccaaccccaacaanaaatnacccccatcannccacaattt

SEQ ID NO: 100839 - DNA, 606 bp, Triticum aestivum
  unsure (1)..(606): unsure at all n locations
  Clone ID: PAT_TA_100839
gatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcaagcaacaaccatttccaccacaacaagccatatccggcaagccgcaaccaatttccatcacaacaaccatatctgcaagctgcaaccatttccaaaagccgcaactatcatatccgcaagccgcaaccatttcgancacaacaaccatatccacagccgcaaccaaaagtattccgcaancaaaacaaacaatttcgcaagcaacaaggaagcaacancaagcaacaacaacaacnacnaccaccaattcctacaacaaaattttgcaacaaaaactnantccaatgcanggatgntgttttgcaacaacaaaaaattgcgcaanggaagcncanaaanttttgnaaagaaaantacttacangcgggggggaanaaattgtgntttcaaaaanntgtnggaaatttcc

SEQ ID NO: 100840 - DNA, 558 bp, Triticum aestivum
  unsure (1)..(558): unsure at all n locations
  Clone ID: PAT_TA_100840
gccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccggaagccgcaaccattttcaatcacaacaaacatatctggcagctggcaaacatttccacaagccgcaactatcatatccgcaagccgcaaccatttcgaccacaacaaccatntccacagccgcaaccacagtattcgcaancacaacaancaatttcgcagcagcaagcagcaagcaagcaggcaacaacaacaacaacaacaaccaaattccttacaacaaaanttttggcaaaaaacaaactggattccantgcaaggggatgtttgtnttgcaaacaaacaaaaanattagcggcatggggaagctccanaaagttttttgcaaaaaaaa

SEQ ID NO: 100841 - DNA, 603 bp, Triticum aestivum
  unsure (1)..(603): unsure at all n locations
  Clone ID: PAT_TA_100841
ggttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgcccgcaacagcaaccaagttattatactgcaacaaccaccattttcgcagcaacaacaancagttctancacaacaaccaccattttcacaacaacaacaacaacaacaacaacaacaacaaccaacattttcgcaagcaacaacaaccaagttctaccacaacaaacaccattttcacaacaacaacaaccaccattttcgcaagcaagcaacaaccatcttcanaacaatcaacctttttcacaacaacaccaacaagttccacaaacaacaaaatcccctggttggttaaacaatccggttttgnaagcaagcttaaacccaatgcaangggggttccnccaaacaagaattgg

SEQ ID NO: 100842 - DNA, 507 bp, Triticum aestivum
  unsure (1)..(507): unsure at all n locations
  Clone ID: PAT_TA_100842
cctgcttccaacaaactcacacaacccaccaccgaagatcccaactccacccgaagcggcagccatggcccccaaggcagacaagaagcccgcggccgagaacaaggtcgagaaggcggcggagaagacccccgcgggcaagaagcccaaggccgagaagcggctgccggcgggcaagacggcgtccaaggaggccggcggcgaggcgaanacccggggcaggaagaagggcagcaaggccaagaagggcgtggagacgtacaagatctacatcttcaaggtgcttaaagcaagtgcaaccccgacattcggcatctcctccaaagggcatgttcaatcattaaactcccttcatcaaacgaacatccttcganaaaaccccncccgggggaattcnggccaaaacctcnccgaanggttaaaacaaagaaaagccccancaatcaacctccccggggaaaatttaaaaaacttccgttcggcctncgttcttcccccggggggaag

SEQ ID NO: 100843 - DNA, 583 bp, Triticum aestivum
  unsure (1)..(583): unsure at all n locations
  Clone ID: PAT_TA_100843
cgcatgactcccagcctctatcccctccaccttcgcccgacacgccccaacctagctcactacctcccacggccggcgtgcccacaaccccctcccaccggccgccgtcgtgcccccacccctctacctttcccgaccaccacccctggtgctgcaccttcccccaactccacgccccaccttctacgccggncgccatcctccccctctttctcccatgccaacccaaacaatggcgaaatncgccgccaacgggccccggngcgggctcaaacaacggatncgggcaacaacgcccccccggggcgggctcaaacgccgggattcgggcggcaacgggccccgaagcgggttgaaaacaacaaaatcgaacgcgaagggcatnggtgggggaaacaagccccatcttaanttgggggtgtggagntcgtcccataacgaagaacctcccctcncctctnggcggnntccaaaaattccgttggctgttcnccccggattcggcggccgggggaaanggttcgtgggaaatggttccgtgggtgcaaattcgggnggggggggcccnncaaacaaanaattt

SEQ ID NO: 100844 - DNA, 604 bp, Triticum aestivum
  unsure (1)..(604): unsure at all n locations
  Clone ID: PAT_TA_100844
caagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcaagccgcaaccatttcgaccacaacaaccatatccacagccgcaaccacagtattcgcaaccacaacaaccaantttcgcagcagcagcaagcagcaagcaagcaacaacaacaacaacaacaacaaatcctacaacaaattttgcaacaacaactggattccatggcaagggatgttgtattgcaacaacacaacataagcgcatgggaagctcaacaaagttttgcaaagaaaagtacttacaaagctnggtgcaaacaattgtgttgtcaagcaagctngtggnaaaattcccgagnaagccgcggg

SEQ ID NO: 100845 - DNA, 620 bp, Triticum aestivum
  unsure (1)..(620): unsure at all n locations
  Clone ID: PAT_TA_100845
gccgcgctgcacatccttgttgccaacgccggcgtgatcgacgacaagtacccgtcccgcgccgacannaccacggnggacatcgaccgtgccttcgtcgtgaagacacgcggcacgttcctctgcctccgcgaggccgccaaccgcatgccccacggcggaggcggccggatcgtggctctgacgacgtccgtggttgggtcgctccggacggggtactctgcttacacggcgtccaangcggccgttngatgccatggttcggacgatggccaagggagctcaanggcacgcgggatcacgggcaactgcntggcgccngggccaacggccacgggacatgttcttcgccgggaaagaagcgactaanaccgttaggggaaaccgtngggagaccaacccctaatggatcggctccgggangtccgncgacatcnccgccggtgggccgggttcctcctgcaaccgnacncccgctgaantnggatnaaacngggcaaaggtcaattttgggtcaaatggagcgggttacctttttaattttaaactggtttggngggaancttccttnggtngnctaaaaaaaaataaantcttaaaaatttccaatgnnttctttc

SEQ ID NO: 100846 - DNA, 613 bp, Triticum aestivum
  unsure (1)..(613): unsure at all n locations
  Clone ID: PAT_TA_100846
gcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcaagcaacaaccaattctaccacaagcaaccaccattttcgcagcaacaacaactaagttctaccgcaacaaccaccattttcacagcaacaacaaccaagttttacctccacaacaatcaccttttccacaacaacaacaacaccaacagctggtgcaacaacaaatccctgttgttcaancatccaattttgcagcaagctaaanccaagcaaagctattcctccaacaagcaagtgcaacccctggtgggaatggccacaaacgtccttgctaagggcccaaaatggntggaacaaaaacaanttgccaatggggatgcaaanaacaaatggttgccaagnaanttgcng

SEQ ID NO: 100847 - DNA, 600 bp, Triticum aestivum
  unsure (1)..(600): unsure at all n locations
  Clone ID: PAT_TA_100847
gcaatactagttaacaccaatccaccatgaagaccttcctcatctttgctctccttgccattgcggcgacaagtgccattgcacaantggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaacaacaacaacaacaacaacaaccaccattttcgcagcaacaacanccaagttctaccanaacaaacaaccattttcacaacaacaacaaccaccattttcgcagcaagcaacaaccatcttcacaacaaccancttttccacaacaacaccaacagtttccacaacaacaaatccctngtggttcaaacatccggttttgcangaagctaaacccatgcaaaggngttccnccaaanangaagtgtt

SEQ ID NO: 100848 - DNA, 582 bp, Triticum aestivum
  unsure (1)..(582): unsure at all n locations
  Clone ID: PAT_TA_100848
aagtagagcgcatcatttaagccaagcaagcagtgctcaatacaaatccaccatgaagacctttctcatccttgccctccttgctattgtggcgaccaccgccacaactgcagttagagttccagtgccacaattgcagctacaaaatccatctcaagcaacaagccacaagagcaagttccattggtacaagaacaacaatttccagggcaagcaacaaccatttccaccacaacagccatatccgcagccgcaaccatttcatcacaacaaccatatctgcagctgcaaccatttccacaagccgcaactatcatatccgcagccgcaaccatttcgaccacaacaaccatatccacagccgcaaccacaagtattcngcaaccacaacaaccaatttccgcagcaagcangcaagcagcaagcaagcaacaacaacaacaacaacaacaaatcctacaacaaanttttgcaacaaacaactggattccatgcaagggatgttgtatttgcaacaacacaaacatnancggcatnggaaagctcaacaaagtttttgcaaagaaagttactttacaagct

SEQ ID NO: 100849 - DNA, 494 bp, Triticum aestivum
  unsure (1)..(494): unsure at all n locations
  Clone ID: PAT_TA_100849
agcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacaaactattccccanccccatcaaacattccaccatcaaccacaacaaacatttccccaaccccaacaaacatacccccatcaaccacaacaacaatttccccagacccancaaccacaacaaccatttccccaanccccaacaaanattcccccaacaancccaanctaccatttccccaattccccancaannattcccccaagcctcatgcatncccangaaccatttccccagtcacaacaaccacancancccttttccccagccccaagancaattttcngcagccccaacaacncaaca

SEQ ID NO: 100850 - DNA, 483 bp, Triticum aestivum
  unsure (1)..(483): unsure at all n locations
  Clone ID: PAT_TA_100850
gcctcctttgacccgccgccactttctcctaccccggaagaagaaaaaaacacacacagtanagagcctcagcctcccctgagcgcgagagatggcggcgaagggcgatgggccggcgatcggcatcgacctcggcacgacctactcgtgcgtcggcgtgtggcagcacgaccgggtcgagatcatcgccaatgaccaagggcaaccgcaccacgccgtcgtacgtcgccttcaaccgactcggagcgcctcatcggcgacgccgccaagaaccaagtgggcatgaaccccatcaacaacgtcttcgaatgcaaacgtctcaatggccgtanattcaccgantctactgtccaaagtgatattnaactgttggcccntcaaaggttgnttgctggancttggtgaacaaanccaatgatcaaatgtccaaantanaaggggggagganaaacaanttttgcaaacttgaagaaaanatccttc

SEQ ID NO: 100851 - DNA, 599 bp, Triticum aestivum
  unsure (1)..(599): unsure at all n locations
  Clone ID: PAT_TA_100851
gccaaaccctagcaaaatttcagcggcgacaagctgggggganaccctcnanaataaagaaaacctcngggaaggagaagaaaccatggcaggcaggcaggagaattggagaccaagaccagggagaggagccaatccaggaggaagagacaaatcccgtaagaagtaagatgatggaggctggagtgaaacaagtgggtgaggtggctggagaagtgttcaaagcagctcatggatggcacctgaagactaggagaattctggggtgaccaatgtcaacctactttcggganaaaattctaatgctgcgaagaacaactgcttcaactgcgaagcttgctctccttgttttccaatccgcctttaatcctttgatcctaaaacattaataattgatatatgcccttaaaaaacattttccctaacaaaggctgggtcctgccnttnaancccaagcctttggatccccctggtaaggntgccaacccnaaggatnaaatgggggggggaaaaggaatgggntttccccccccccncaantgggggtggnngaaaaaccccgnttaggggaaagagntttatntttcaactttattttt

SEQ ID NO: 100852 - DNA, 612 bp, Triticum aestivum
  unsure (1)..(612): unsure at all n locations
  Clone ID: PAT_TA_100852
gcatcatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacaagccgcaactatcatatccgcaagccgcaaccatttcgaccacaacaaccatatccacaagccgcaaccacaagtattcgcaaccacaacaaccaatttcgcaagcaagcaagcagcaagcancaagcaacaacaacaacaacaacaacaaaatcctacaacaaaattttgcaacaacaaactggattccatgcaagggatgttgttttgcaacaacaacaaacatagcncaangggaagctcaaaaagtttttgcaaagaaaagtaanttacaaantnggnggaaaaaanttgtgnttgtcaacaactgttggnaaattc

SEQ ID NO: 100853 - DNA, 331 bp, Triticum aestivum
  unsure (1)..(331): unsure at all n locations
  Clone ID: PAT_TA_100853
ctcgtccctcccctcgcctccctcctctggccgctagctagctagatactgcagtggttgctgcttggctttggctttggttgcttgctggtgctctccccactccagcttgctcccctctccacacccccctcgggggcttctgcggtgaaggtgcgaactccgggcatgcccccccgagcttgattgcggtcgacgggggtgaaggtggaaacttgctgccggatcnattgggccgcttgctttccgggcggtgccgcttttcggcaataaaaggnggggggattttgcgcccaactggcccccgattnaaaaaatcccccgcggggaa

SEQ ID NO: 100854 - DNA, 563 bp, Triticum aestivum
  unsure (1)..(563): unsure at all n locations
  Clone ID: PAT_TA_100854
caaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgattcccaagcagtcaagatgtgaggccatccacaacgtcgtgcacgccatcgttttgcaacaacaacaacaatttggtacaaaggtatttccaaccaacctcaacaagcaacaaacaaacaaaggtcaacaacaaacaanggtcaagggnttctaacccagccaacaacaaacaaacaacaaactgggatttaagggnttgggnttgccggtgataanggaacatnggttgattcaaaaccat

SEQ ID NO: 100855 - DNA, 572 bp, Triticum aestivum
  unsure (1)..(572): unsure at all n locations
  Clone ID: PAT_TA_100855
gatttaagccaagcaagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcaaccatttccgcaagcgcaactaccatattcgcagccacaaccattttcgaccacaacaancaatatccacaaccgcaaaccacaaatatttcgcaancaacaaacaatccaaattttcacaagcagcaagcaagcaagcaaacaacaaacaaacaaacaaacaaggaacaacaaattaccttcaaacaaaatttttgcaacaaacaaactgganttccatgcatnggatgnttgtntttggcangcaacacaaacatangcgccaangggaagattnacaaagntttttgcaacaaa

SEQ ID NO: 100856 - DNA, 378 bp, Triticum aestivum
  unsure (1)..(378): unsure at all n locations
  Clone ID: PAT_TA_100856
gcattaaagccaagcaagcagtggtcaatacaaatccatcatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttccaggggcagcaacaacaatttccaccacaacagncatatccgcagcgcaaaccattttcatcaanaacaaacatatctggcagctgnaaacaatttccggaagccggcaaaccaantttcggccaacaaacnatcatatcccgcaagccgcaaatcantttccaaccacnaacaaaccaatattcca

SEQ ID NO: 100857 - DNA, 542 bp, Triticum aestivum
  unsure (1)..(542): unsure at all n locations
  Clone ID: PAT_TA_100857
caagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacaatattcgcaaccacaacatccaatttcacagcagcaagcaagcagcaacaacaacaacaacaacaagaacaacaaatactcaacaaattttgcaaaaacaactgantccatgcatnggtgtttgttattgcancaaacacaacatngcgcaatgggaagatttacaagnttttgcaacaaaantcnttaccaanttgtt

SEQ ID NO: 100858 - DNA, 327 bp, Triticum aestivum
  unsure (1)..(327): unsure at all n locations
  Clone ID: PAT_TA_100858
ngcaagcatcaaatccaagtaagtattanttaacgcaaatccaccatgaagaccttactcatccgnagacantcnttgcgatggcaacaaccatcgccaccgccaatatgcaagtcgaccccagcggccaagtacaatggccacaanaacaaccattcccccagccccannanccattctgccagcaaccacaacaaactanttccccaaccccattcaaacattccaccatcaaccagaatcaaatacatttccccnanccccaacaaancatancccccatcaaccataacatacantttcccccannacccaatcaaacccaca

SEQ ID NO: 100859 - DNA, 561 bp, Triticum aestivum
  unsure (1)..(561): unsure at all n locations
  Clone ID: PAT_TA_100859
caactagagcacaagcatcaaatccaagtaagtattagttaacgcaaatccaccatgaagaccttactcatcctaacantccttgcgatggcaacaaccatcgccaccgccaatatgcaagtcgaccccagcggccaagtacaatggccacaacaacaaccattcccccagccccaacaaccattctgccagcaaccacaacaaactattccccaaccccatcaaacattccaccatcaaccacaacaaacatttccccaaccccaacaaacataccccccatcaaccacaaacaacaatttccccaagacccaacaaccacaaagaaaccatttccccaggcccaacaaacattcccccaacaaccccaacttaccatttcccaacaacccccaacaaccaantcccccaagctcangaaaccccaacaaacnattttcccaagttcacaanaaacaacaannaacttttttccccagccccnataaaaaatttccgncagnccccaaaaatncaaaaanaatcnttccccccaaaaaaaaaacaaccggggnttttant

SEQ ID NO: 100860 - DNA, 542 bp, Triticum aestivum
  unsure (1)..(542): unsure at all n locations
  Clone ID: PAT_TA_100860
agacctttctcatccttgccctccttgctatcgtggcgaccaccgccacaactgcagttagagttccagtgccacaattgcagccacaaaatccatctcagcaacagccacaagagcaagttccattggtacaacaacaacaatttccagggcagcaacaacaatttccaccacaacagccatatccgcagccgcaaccatttccatcacaacaaccatatctgcagctgcaaccatttccgcagccgcaaccattttcgccacaactaccatatccgcaagccgcaatcatttccaccacaacaaccatttccacaacaagcaaccacagtatctacaaccaanacaaaccaattttgcaagcaacaagcacaacaacaacaacaacaacnacaacaacnacaacaaacaacaacaaattccttcaaacaaantttgncaacaacaaatggattccaaggaagggaatgttgtnctggcaanaaaanaacaatagcggaatgcaagctncacaagtttttggaaaaaaagttcntttncaa

SEQ ID NO: 100861 - DNA, 427 bp, Triticum aestivum
  unsure (1)..(427): unsure at all n locations
  Clone ID: PAT_TA_100861
agaattttcccgggacgggagaggagatgaagttcggcaaggatttccggagccacctggagggcacgctgccggactggaaggacaagtacctcgcctacaaggcgctcaagaagctcatcaagacgctcccccccgacgccctccgtcgccgaacaacctctggctccctgnccccgcccccgcccccgnccccgnccgggcttcgggaactggtttcccccggattctccaacgtccaagctccaacaaagctcaaacgacttctaacaattggaaccgggaaggaattggtaacnttcaatcccgcctccaaaggttgcttaaanggagaaggatttgaanccaaattcaaaagccnaaaaaaaaaaattgggggctttttacaatccaaaaactngaantttcaactggaanaaaattttta

SEQ ID NO: 100862 - DNA, 556 bp, Triticum aestivum
  unsure (1)..(556): unsure at all n locations
  Clone ID: PAT_TA_100862
gcnaacactagttaacaccacncggaatggagacnttcctcgtcnttgcccggcctcgccgttgcngcgacaagtgcanttgcgcagatggagacnanatgcatccctggtttggggagaccatggcagcagcaaccattaccaccacaacagacatttccacaacaaccactattttcacaacaacaacaactatttcctcaacaaccatcattttcgcagcaacaaccaccattttggcagcaacaaccaccattttctcaagcaacaaccaattctaccacagcanccaccattttcgcagcaacaacaactagttctaccgcaacaaccaccattttcacagcaacaacaaccaagttttacctccaacaacaatcancttttccacaacaacaacaacaccaacaagctggtgcaacaacaaaatcccctggttgttcagccatccaattttgcnngaagctaaacccaatgccaaggcttattcctccaancaancaattgcaaacccctggtgggnaantgccanaaaagtncttgcctaggtccccaa

SEQ ID NO: 100863 - DNA, 578 bp, Triticum aestivum
  unsure (1)..(578): unsure at all n locations
  Clone ID: PAT_TA_100863
gttgagaacaaacattatctaacacaaatcaaccatgaagaaattcctcgtccttgccctcattgtcatcgcggcgaccaccacggccgccgaaccctttactgcattccgtattgcttcggagccgcaacatccatcatctccaagagcagcaaccaactctgcagccacaagaacatccagttccacatcaaaagttgaacccttgcagggatgccctcctacaccaagtgtagcccagtagctgatatgtccttcctcccggtcacaaagtgggggcaaaataacaactgctttggaatgttggggagcaantgttgttcagcaaactaaaaagcgattccccaaagcaagtcaaagattgttgagggccatccaaaaaacgtcntgcaccgccatttattttgcaaanancaaaaaaanaanttgggtanaaaggtaatttaaacccaancctcaagcaagnaagcaacaaacaagggtcaaaaaagaaanatgggtcaagggnttctancccagcccncaacnnccaancaannacaaacangcaacttgggttnaagggnttggntttntgg

SEQ ID NO: 100864 - DNA, 528 bp, Triticum aestivum
  unsure (1)..(528): unsure at all n locations
  Clone ID: PAT_TA_100864
ggcaacactagttaacaccaatccaccatgaagaccttcctcgtctttgccctcctcgccgntgcggcganaagtgcaattgcgcagatggagactagatgcatccctggtttggagagaccanggcagcagcaaccattaccaccacaacagacatttccacaacaaccactattttcacaacaannacaactatttcctcaanaaccatcattttcgcaagcaacaaccaccattttggcagcaacaaccaccattttctcaagcaacaaccaattctaccacagcaaccaccattttcgcagcaacnacaactagttctaccggaacaaccaccatttttcacagcaacaaacaaccaagtttttacctccacaacaatcaccttttttcaacaacaacaacaacnccaaacaggctngggggcaacaaacnaaatccccngttggttcaanccaatccaatttttgcnagcnagctaaaacccaatggcaangctaattccctcccaacanagcnngtgccngc

SEQ ID NO: 100865 - DNA, 555 bp, Triticum aestivum
  unsure (1)..(555): unsure at all n locations
  Clone ID: PAT_TA_100865
gctagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcagcaacaaccaattctaccacaacaaccaccattttcgcagcaacaacaactagttctaccgcaacaaccaccattttcacagcaacaacaaccaagttttacctccacaacaatcaccttttccacaacaaacaacaacaccaacagctgggtgcaaanaacaaatcccctggttggtcaagccatccaattttggangcaagcttaaaancccaatgcaaaggctaattnccnccaaacaaacaaatgcaaacccccngttgggnaaatgccaanaaacgnncttggctaanggtcn

SEQ ID NO: 100866 - DNA, 572 bp, Triticum aestivum
  unsure (1)..(572): unsure at all n locations
  Clone ID: PAT_TA_100866
cgtcctcctgtgtgcggcgccgccgctgcgcacatctcaggcgagtgcttccaacccatctcctcgccctcctccacatctccggccaaggcgctcacttctccggccctcctccacatctcatggcctccacccatccgcttcctgtcctttggttctccaagactgcagtatggtgctcggcggctgtgacagcggagctgatggtgcgccagccgaccagttgaacggaggcagtagcaaggggcaacggcaacagcctaaagggcggaggtttattggcaaggtaatggaactgcaaataggagtggcagcggcaancatgatgcaaagtgcaaagtggttcccaaaagatntttgggaaactaatttgtgagaatgaaggatgattaaaaatcaagagttatttgggggacaaagggaagattattccaacaaatgcaaagatttagcaaagaaggcaacaaattgcaaantgggaaaaaaaaanaacccaaanttcaaantgggaaatgggccncaacaaccaaaacgaatggcaaattttggggaanccgtttantttttacngg

SEQ ID NO: 100867 - DNA, 318 bp, Triticum aestivum
  unsure (1)..(318): unsure at all n locations
  Clone ID: PAT_TA_100867
gctgctgacancacaattgttgcaccacctggtaagtactttgttgcaaaacttgtgagcttccatacgcgnggctgtgttgttgcaatacaacatccctgcatggnatcagttgttgttgcaaaatttgttgaaggatctgttgttgttgntgttgttgntgntgtttttgatggatggttgttgcttgtgcngcctnccgctgccaaattggttgtttgtggntgcgaatactgtngttgccacttgtggctaanggtatgttgtgggnccaanacgggttgccngcttgcnngnatatgggnacgttttncggct

SEQ ID NO: 100868 - DNA, 504 bp, Triticum aestivum
  unsure (1)..(504): unsure at all n locations
  Clone ID: PAT_TA_100868
gccagccagcccctccgcaggcctatcaccgccgattccgcgctcatgaaccccaacactaggatcctcgcgctcaaagcccaaatagctggaacgacgcaggatcacttgcagatcttcaatattgaagctaaaacaaaagtaaagtcgcaccagatgcctgagcaggttgtgttctggaaatggatcacccccaagttgttgggcttggtaacacaaacatctgtttatcactggtcaattgaaggagattctgaacccaccaagatgtttgataagacagctaatctgggcaataatcagattattaactaccgttgtgacccggcaaanaaatggctccgtgcntattggaattgcacctggtgctcctgaaaaggccgcaanttggtggaaagggaaatatgcaaccttttctccggtttgattaacaagcgttacccaaggcacttnaaagcccaatgcaacatcnttttgcaacttttaanggttcctgggnaacna

SEQ ID NO: 100869 - DNA, 591 bp, Triticum aestivum
  unsure (1)..(591): unsure at all n locations
  Clone ID: PAT_TA_100869
cccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtacgacaccgtcgccgcggctgttgcttcaaggttccctggccantcctctggggtgaagtgcatcatcggctcctgctgcaactgctcctgccgcttccaaaggattaanatgacgaattaatgaaatggattctgttttggcgaatgaaaaccgaaggaaggaaaaagaaaagcttgcaacttgaaccgtgaaggcttgccaaagccctgcaaaaagaaanaaaagaaaagtggnaaaatcctnccgttcctcaatgggacaatcaaanccaatggggaacgaattaaaacctggacaattaaaaaaattttggngggaaggnttttcccnaaattnttcaaaattgggngggtcnccaacctggggggggaatccnaaacctttatgncctggngg

SEQ ID NO: 100870 - DNA, 524 bp, Triticum aestivum
  unsure (1)..(524): unsure at all n locations
  Clone ID: PAT_TA_100870
caagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccaggggaagcaacaaccatttccaccacaacaagccatatccgcagccgcaaccatttccatcacaacaaccatatctgcagctgcaaccatttncgcagccgcaactaacatatccggaagccgcaaataacaaatccgcagccgcaaccattttcgaccaaaacaaacatatccacaatcncaaccacaatttttcgcaaccacaaaaaacaatttnccaagaacaggagcagcaacnacaacaacaacaacaaaaacaacaacttnatcacaacaacagnttcctcaanaaaattttgcaaaaaaactggttccatgaagggagttttttcnacaanaaaanan

SEQ ID NO: 100871 - DNA, 582 bp, Triticum aestivum
  unsure (1)..(582): unsure at all n locations
  Clone ID: PAT_TA_100871
aaaccaagcaaaagtagttagcaccaatccatcatgaagaccttcctcgtctttgccctcatcgccgttgtggcgacaagtgccattgcacagatggagactagctgcatctctggtttggagagaccatggcagcagcaaccattaccaccacaacagtcattttcacaacaaccaccattttcacaacaacaacaacaaccattacctcaacaaccatcattttcgcagcaacaaccaccattttcgcaagcaacaaccaattctatccgcaagcaaacaaccaattttcaacaagcaaacaacaaaccaagtttctaaccgcaaacaatcaaccaattttccgcaagcaacaacaactnagtttttacctccaacaacaaacaacaaacaaacaacttngtgcaacaagcaaatcccctaattggttcaanccatccgttttggcagcaagctaaanccaatgcaaaggttntcccccancaagaagttgcaancccctggtgcaatggcaanaacgtcctgcctanggcaaaagtgtggcaacaanancaantttccaagttgatgcaaanaanattg

SEQ ID NO: 100872 - DNA, 504 bp, Triticum aestivum
  unsure (1)..(504): unsure at all n locations
  Clone ID: PAT_TA_100872
gctcctccctccccaacctaccggcgcatctccgacgacatggcccgcaccaagcagacggcgaggaantcnaccggcggcaatngcgccgaggaagcagctggccaccaaggccgcccgcaagtccgccccggncancgggggngtcaagaanccccaccgnttccgccccggcaccgtcgngctccgggagatccgcaagtaccagaagagcaccgagctgctcatccgcaagctccccttccagcgcctcgtccgcgaagatcgcccaggacttcaagaccgacctccgcttcgagtcctccgccgtctccgcgctgcaggaggccgccgaggcctacctcgtcggcctcttcnagggacaacaaactctgcgccaatccacgccaaagcgcgttaacaatcntgcccaagggcattcaactcgcccgccncatccgtggcaanaggggctaaggncgcgattttgnaatccaatgcgttcgtcctgttaanattgtttgt

SEQ ID NO: 100873 - DNA, 257 bp, Triticum aestivum
  unsure (1)..(257): unsure at all n locations
  Clone ID: PAT_TA_100873
gntttttttttttttttttttttttgcccggncaaattgagggatnattatttaaagccatattgaaaatcaagatcgagaaggttacacaggccacagattaaggttcaggagagacaagaaaagaaaatagaagaagaagaagaagaagaagaagaagaagaagaagaagaagaagaagaagaagaaananaacaaggnggacaanntgatcaganatcgacaaancactacgaaattgtacagagatagaaata

SEQ ID NO: 100874 - DNA, 539 bp, Triticum aestivum
  unsure (1)..(539): unsure at all n locations
  Clone ID: PAT_TA_100874
caagcagaaantcaaagtacgtagtagttaacgcaaatccaccatgaagaccttactcatcctgacaatccttgcgatgggaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccaagcctcaagcaaccacaacaaccatttctccagccccaacaaccattcccccaacaaccacaacaaccattcccccagactcaacaaccacaacaaccattttccccaagcaaccacaacaaccatttcccaagattcaacaaaccccaacaaacattttccccaaacaaccacaaanaaccaattcccccaaggacttcaaaaaaccccnaacaaaccaatttcccccaagcttccaggcaacccacaaanaaacctttttccccaagcccccaannaacaanttggcn

SEQ ID NO: 100875 - DNA, 536 bp, Triticum aestivum
  unsure (1)..(536): unsure at all n locations
  Clone ID: PAT_TA_100875
gaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggnagcaacaaacatttccaccacaacagccatatccgcagccgcaaccatttccatcacaacaaccatatctgcagctgcaaccatttccgcagccgcaactaccatatccgcagccgcaactaccatatccgcagccgcaaactaccatatccgcagccgcaaaccattttcnaccaacaacaaccaatatccacaaatcgcaaaccacaagtattcgcaaccacaaaaaaccaattttcgcangcaagcagcaggcaacaacaacaacaaccaacaanaaacaaacaaccaacaacnancaaccaacaacaagnttccttcaaacaaanttttggaaacaacnaactggatt

SEQ ID NO: 100876 - DNA, 516 bp, Triticum aestivum
  unsure (1)..(516): unsure at all n locations
  Clone ID: PAT_TA_100876
cggaaccaacaaatcccaagctaatctcgtctccgatcgactcgaggcttgtcgaatcctccttccccaccgcctcaagatgcagatctttgtgaagacactgacgggcaagaccatcacccttgaggtggagtcgtctgacnccatcgacaatgtcaaggccaagatccaggacaaggagggcattccccctgaccagcagcgtctcatctttgctggcaagcagctggaggatggccgaaccctcgctgactacaacatccagaaggagtccaccctccaccttgtcctgcgtctgcgtggtggcatgcanatcttcgtgaagaccctcaccggcaagaccatcactctggaggtttgagagctctgaacaccatcgacaatgtcaagggcaaagatcaaggacaanggagggcattccccggacaagcagcgcctgatctttgcccggcnagcaactgganggatggccgcaccctttgcnggactaaaaacatccaanaanggagttccaac

SEQ ID NO: 100877 - DNA, 536 bp, Triticum aestivum
  unsure (1)..(536): unsure at all n locations
  Clone ID: PAT_TA_100877
gcacaaatcaaccatgaagaaattcctcgtccttgccctcattgtcatcgcggcgaccaccanggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgattcccnaagcaatcaaaaatgtganggcaatccacaacggtcgtgcacgccaattanttttgcaaacaagcaaaaaacaatttggtacaaaggtattttcaaacccaaaccttcaagnaagcaagcaaacaancaaagggtcaaacaaagnaacaatgggtcaangggttntaagcccaggcccccaaacaacccaancaatcaancaancaagcnaacctngggttt

SEQ ID NO: 100878 - DNA, 555 bp, Triticum aestivum
  unsure (1)..(555): unsure at all n locations
  Clone ID: PAT_TA_100878
gccatgaagacctttctcatccttgccctccttgctattgnagcaaccaccgccacaattgcagttngagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcagctgcaaccatttccgcagccgcaactancatatccgcagccgcaactaccatatccgcaggcgncaaacaattttnnnccaaaaaanaacccattattccncnatttnggnanccatntgtttttcncaaaactntnnagaattcnaatttttgcaagcaagnaagcnaggcaagccaaccaaccaaccaaccaacnaacnaaaacnaaacaagccaaccaacaaccaacaaccaggttnctttncaaacnaaanttttggcaanaaacaanttggattcccatggcaaggggaatttttgtnttgccacccaaccaccag

SEQ ID NO: 100879 - DNA, 583 bp, Triticum aestivum
  unsure (1)..(583): unsure at all n locations
  Clone ID: PAT_TA_100879
gcacgaggcacatccatcgcctcccttcccacaccctctctcctcctcgtttcctatcgtcaattgtgatcgagtggggagcgagagagagagagaagagtggagaggagaaacaaggatcgaccaagaggttccctctcatcagttcatcgccaggcgtcatcatcatttcttaatggccgggaaagggccggtggttcccaagttcgggtcgtgggacgccgagaacatcggctacaccgtcttcttcgagaaggtgcgcgagaacaagnccgcgcccgtgccgggcacggcggcgccagcgcccagggggcacgacgaccaagagttcgacccctacgagtactacgagaacctcagccggaacgtgccctcgcgcccgcccagctcgcacggccacggccacgcggccccggcgcagcactatgaccacctcggcggtaacgtgccctcgaggccgccgagctcgcacggccacggacacccctcgccggcgcagcactaccccgcgcagcacgnnnacgggggctaccaccggcggaacgggagcaatggcagcagcgccgcgtcnnnnntcagcagc

SEQ ID NO: 100880 - DNA, 609 bp, Triticum aestivum
  unsure (1)..(609): unsure at all n locations
  Clone ID: PAT_TA_100880
caaatccccaccccggcctgcaattcattccaatcgcccgtgcgccgccccaaatcgccatcgctgcccccaaatcgcccgaggccgccggtcggagcccaccggtcggtctcctccgccaccacatcttctcgccgtcgcaccgttcctcacctcaccaccgccgcgccgttcttctcctcctcttgtgctcgctgccacctaaggtttcggtggtgctcgcctcgctgtcgcgtcgttctttcccctcaattgccgtgcctttcttctcctttggattgtcgtgttgctactctccttctcccctggtcgtcggcggctnaggtttcgggggtgcttgcctcccttcgtcgtcacatcgttgctcctcttcccaccgcgtcgttcctctccaagccgtgtcgaccaccaccggcgttggcttccaaagttgttcttccttgagctcctctgtcgtgtgggttctgatcatcgctgagctcctctgccgttccactgctcttctctgcgtcggctggtgcctcatgtggattttatggcttaagccangngnagaaagaaagggctctgcatatgaaaagataccaacattattgtttncatgaaatt

SEQ ID NO: 100881 - DNA, 594 bp, Triticum aestivum
  unsure (1)..(594): unsure at all n locations
  Clone ID: PAT_TA_100881
gcacgaggcggcgacggcggcggcgtcggacgcggaggccaggagcatactcgagcgggccgcggcggcatccttcccgcctctccacgccgtccaccacctcctctccgtcggggtttgtgtgcgatgcatctttcgcatgtttggagcctttagccatgcctgcttatgtgcgtctcttacggtctctttcttccattcatttcttgaagagcatgatgattccgcaaaaggcgggtcttgctcatgtttgtcaacggatgaagcatgctgctctatttgctttggaatattgctacccacctgccataaggatgagggtgtagtaccgtttgatgacatttctcgtatcgacataattacttcaatggtatctcaagcaatacaaagagagggttatcaaattgatgggttttctttagaaatttcactgcctgcagttgtagcagcgaatgaacgtgccatcaggttatatatgaaagaaaaatatggcagtgaaaattggttcaaggacgaaatattttctnnnnaacgatgtcagtgannnnnnnntctgagactgctgatagtaccatcgctcgannacnncngggn

SEQ ID NO: 100882 - DNA, 598 bp, Triticum aestivum
  unsure (1)..(598): unsure at all n locations
  Clone ID: PAT_TA_100882
ccaaaagccatcgcaaacccaggaagaaacggtaagctgttgcgcggcatggctttctaccgcggcagcggcatgggcatgggtatgggcatgggcatgggtggcgggtcttcgtcgtcgtgggcgccggcggcgatgccacctccgccgccgccgcccatcaggccgtggaccaaggcggaggacaaggtgttcgagagcgcgctggtggcgatcccggagcacgtgccgaatcggtgggtgttcgtggcggcgcatctgccggggcgcacgccgcaggaggcgtgggagcactaccnnncgctggtggccgacatcgacctcatcgagcgcggcctggtcgagccccccgagtcgtgggacgacgacgacgacggcgccgccggcgccggcggcaccgtcgcggcggggcgcggccgcccccgcggctcgggcggcgaggatcgccgcaagggcataccctngaccgnnnaggagcacanntatacacacaccaccgccgtcaaaatctctaactgccttccttccctggaccctgttcgttttcttgtccctttaccctgttattcgacggcgcgttcttgtaagacctnnntan

SEQ ID NO: 100883 - DNA, 597 bp, Triticum aestivum
  unsure (1)..(597): unsure at all n locations
  Clone ID: PAT_TA_100883
gcacgagggtgaaaagcaagatgggttagnnttgggttattaactcaaccaagtctcgcatatccagttcagttaaaggttgtaaggctgcatcagatgaagagtcgacagaacatttcattagtactatgaaggaaaaggatgtcaaaatagataggttcgaagtaagaggaaaagcatggactcgtcgaaggcttgttctgacaggaagtgatggtgcgttccatgtgctgcaatggaaacaacacaaaacaagaaagatgaatgttggctcggcaactacttctggtgagagcgagcggctgtcacgtgggttggaggaggagaactcagcgggagtcaaggagctgagggctttgattcaaggtgttgaagccagaatcagtgcacagttgaaggactttgagacaacaatttccactcggttctctccgttcgaatcccgaattcagagcatggacatacgactacaggcaatagagcaggagagagccgagtctacnnnnnccaatgtatggtagagtgatggagagatagtgtaagtaagttgatgtggactcaagcgtganngatgtgtatcccttanntactangnnn

SEQ ID NO: 100884 - DNA, 525 bp, Triticum aestivum
  unsure (1)..(525): unsure at all n locations
  Clone ID: PAT_TA_100884
ttcacacaactnntagcacaagcataaaannnnagtacgctnntannnnacgcaaatccaccatgaataccttactcatcctgacaatccttgcgatggcaataaccatnngcaccgccaatatccaggtcgaccctagcggccaagtacaatggctacaacaacaactngtcccccagcnncatacannnnntatcccatcaaccacaacaaacatttgcccaacctcaacaaacattcgcccatgaaccacaacaacaagttccccagcctcnacaaccacaacaaccatgttctccagccccaacaaccattcccccaacaaccacaacaaccattcnnncatnnctcaacgaccacaacaaccatttccccnncaaccacaacaacacatnnccccagactcaacaaccccaacaaccatttccccaacaaccacaacaaccattcccccagnctgaacaaccgcaacaaccatntcnccagcnncagcaaccacaacaaccttttaccgnnncccaacnn

SEQ ID NO: 100885 - DNA, 410 bp, Triticum aestivum
  unsure (1)..(410): unsure at all n locations
  Clone ID: PAT_TA_100885
ccaaggcccaaacatncccgcctttgctcattcccctacccggtaacggaaaaacaaacagtgggaatatggcaaccttttcaatccccattccatcccccacaaaaacaaaaaaaattcccttgttttaaacggggccacacatgtccaacactcctaaaaactgccacaacatgggcaaaatccctcaacctacattaaacagtggcttccaaaaaaagcgaggccctgctananacatgggtttaaaacaatcacggatgaccgagngnttccccccaagnacaagggccatatgtttttnacctgcccttgcccttttttgggaaccccctgaaactaaggcaataccccttccccctgggttgttttttcaagccnncccatccaaaggggaccnncttnntttt

SEQ ID NO: 100886 - DNA, 619 bp, Triticum aestivum
  unsure (1)..(619): unsure at all n locations
  Clone ID: PAT_TA_100886
nncacgaggcaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctgggaagcagctggaggatggccgtaccctcgctgactacaacatccagaaggagtccaccctccaccttgtcctgcgtctgcgtggtggcatgcagatcttcgtgaagaccctcactggaaagactatcacccttgaggttgagagctctgacaccatcgacaatgtcaaggccaagatccaagacaaggagggcattcccccggaccagcagcgcctgatctttgctggcaagcagctggaggatggtcgcaccctcgccgactacaacatccaganngagtccacccttcacctggtgctccgcnnnngtggtgnncagtaattgccctctcactcgnnntgctgctgctgctgtaccctgtgtcgtcctgtgggtgcgcctttgnncnngtgctgtctcg

SEQ ID NO: 100887 - DNA, 639 bp, Triticum aestivum
  unsure (1)..(639): unsure at all n locations
  Clone ID: PAT_TA_100887
gcacgaggcttcttttcccccctttcattctaaaaaaatatccgtcgaaccccaacccgtctcgcccgagactcaaaaccctcgcagcagcagcggaggccgccaccgccgcccgatgtggaacggcgggccgccgccgccgctgccgctgccgcccatggcggccgcgccccctcccccgggcacggccggcgcgggcctgcccccgccccctcctccgccggccgccgcgcccccgcaggccggccagccgctcaccccggcggagctcgaggcgcagctcgtcgagaaggcccgcaagtggcaccagctcaactccaagcgctacggcgacaagcgcaagttcggcttcgtcgaggcgcagaaggaggacatgccccccgagcacgtccgcaaaatcatcagggaccatggggacatgtcctcgaagaagtacaggcatgacaagcgtgtttatcttggagcactcaaatttgtgcctcatgctgtttacaaactactggagaatatgccgatgccctnnnaacaagttcgccatgttaagatcttgtaccatatcactggcgccataaccttcgtaaacgagatcccatgggtagttgagcccatttacttggcgcannnnnnctctatgtggat

SEQ ID NO: 100888 - DNA, 417 bp, Triticum aestivum
  unsure (1)..(417): unsure at all n locations
  Clone ID: PAT_TA_100888
cataagtagagcgcatcatttaagccaagcaagcagtgctcaatacaaatccaccatgaagacctttctcatccttgccctccttgctattgtaccaaccagcnccatactatggccacaacaacaaccagttccgccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgtagattcagcnnnatctacaacaacagatgaacccttgcaagaattacctgttacagccatgcaaccctgtgtcattggtnnnntccctcgnnngaatgaacttgccannnnnncgannnn

SEQ ID NO: 100889 - DNA, 476 bp, Triticum aestivum
  unsure (1)..(476): unsure at all n locations
  Clone ID: PAT_TA_100889
ggcgcccactgccctccctcnncccactcgccgttcccccaaaatgaaaccctccatccaaccactggtcatacattttgttcccannncttcaatttctcagcgacaaatcttacaaagcaaccactatgggatacatcagatctgcaatgagttgatgtatgtgtggtgtacagatgggtggtagaggagtcatcaaggagactatttgatctgaatcggattttgctgctgctggaatgacgtcctcaacgagtaccgctggaacaaagnnnaaacctttgtgattnnncccgatcggacnnnnnnnaagatgtgtaattaagcatgtgactgatggtgcatgatgaataannnnntgagagatgttgtagaagttgttgtcgncagcatgannnnnnnnnnnnngagnnncccgcactacaagtaccgcgacttctacatcgccggcgagagnnacgccgggcactacgtnn

SEQ ID NO: 100890 - DNA, 304 bp, Triticum aestivum
  unsure (1)..(304): unsure at all n locations
  Clone ID: PAT_TA_100890
cttatagccagccaccatgaagaccatgttcatcctcgctctcctcgccttcacggcgacaagcgcagttgcgcagctgtacactacctgtagccagggctacgggcaatgccagcagcagccgcagccacagccgcagatgaacacatgcgctgctttcctgcagcagtgcatccagacaccatatgtccagtcacagatgtggcaggcaagcagttgccagttgatgcggcaacagtgctgccagccgctggcccagatctcggagcaggctcggtgccaggccgtctgtnnngtgtcacag

SEQ ID NO: 100891 - DNA, 608 bp, Triticum aestivum
  Clone ID: PAT_TA_100891
caagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagtgtcgcgcattccatcatcatgcaacaagaacaacaacaaggcgtgccgatcctgcggccactatttcagctcgcccagggtctgggtatcatccaacctcaacaaccagctcaattggaggggatcaggtcattggtattgaaaactcttccaaccatgtgcaacgtgtatgtgccacctgactgctccaccatcaacataccatatgccaacatagacgctggcattggtggccaatgaa

SEQ ID NO: 100892 - DNA, 599 bp, Triticum aestivum
  unsure (1)..(599): unsure at all n locations
  Clone ID: PAT_TA_100892
gcacgaggacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattgtcnnncaacataccnnntgcttggtaatgtgggagcagtgctgtcagntnctnnnagcgatccccaagctgtcaagnnncaannncatcctcaatgttgcgcactccattatttagatacannggcacttcgtgagattactcgtcgccccggggcagtgcaacttgnngacnnnngtcaacaacaacaacannnntctgggttctagccagccnnnnctccagcagcagtgcagccctgtggcaatgccacaacgtcttgctaggtcgcaaatgttgcagcagngcagttgccatgtgatgcaacaacaatgttgccagcagttgccgcnnntcnn

SEQ ID NO: 100893 - DNA, 563 bp, Triticum aestivum
  unsure (1)..(563): unsure at all n locations
  Clone ID: PAT_TA_100893
gtagagcgcatcatttaagccaagcaagcgggggtcaataaaaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttnn

SEQ ID NO: 100894 - DNA, 569 bp, Triticum aestivum
  unsure (1)..(569): unsure at all n locations
  Clone ID: PAT_TA_100894
gcaaaactagttagcaccaatccatcatgaagaccttcctcgtctttgccctcctcaccgttgtggcgacaagtaccattgcgcagatggagactagctgcatccctggtttggagagaccatggcagcagcaaccattaccaccacaacagacattatttccacaacaacaaccatttccacaacaacaaccaccattttcacaacaacaaccatcattttcgcaacaacaaccaccattttcgcagcaacaaccaattctaccgcagccaccattttcactgcaacaacaaccagttctaccgcaacaatcacctttttcgcagcaacaactagttttacctccacaacaacaataccaacagcttctgcaacaacaaatccctattgttcagccatccgttttgcagcagctaaacccatgcaaggtattcctccagcagcagtgtgccacaacgtcttgctaggtcgcaaatgtggcagcagagcagttgccatgtgatgcagcaacaatgttgccagcagttgccgcaaatccccgaacaatctcgctatgatgcaatccgnnn

SEQ ID NO: 100895 - DNA, 568 bp, Triticum aestivum
  unsure (1)..(568): unsure at all n locations
  Clone ID: PAT_TA_100895
cgcaaatccaacatgaagaccttactcatcctaacaatccttgcgatggcaacaacaatcgccactgccaatatgcaggtcgaccctagcagccgagtacaatggccacaagaacaaccacccccccagccccaacaacaattttcgcagccccaacaaccacaacaatcattcccccaacaacaacaatggatgattcanncatttctacaacaacagatgaacccctgcaagaatttcctcttgcagcnnngcaaccctgtgtcattggtgtcatctctcgtgtcaataatcttgccacgaagtgattgccagctgatgcaacaacaatgttgccaacgactaacacaaattcctcaacagctccattgcgcagccatccacaacgtcgcgcattccatcatcatgcagcaagaacaacaacgaggcgtgcagatcctgcggccactatttcagctcgcccagggtctgggtatcatccaacctnaacaaccnnntcaattggaggggatcnnntnattgggattgaaaactcttccaaccatgtgcaacgagtatgtcccacctg

SEQ ID NO: 100896 - DNA, 515 bp, Triticum aestivum
  unsure (1)..(515): unsure at all n locations
  Clone ID: PAT_TA_100896
ccgccgccgtcttcctggtcgacggcgagctcccacctctccgccggccgcacccatccccgctccctatctctccacgggagctcgaccccgtcgccctctccctccgcgggagctcagccacaacgaccgtccgtcgcaggacactggtcctatcccatgccgccgcctggacgccgcgcgggagactcccgcggccgccgggagccgggacgcgttcctccacaacgccgtgatcccgggcttcgctgactcgggcctccctggcagcgctctggccgcctaccgctccatgctggccgccgtcgcgcgcctgaccgcttcaccttccccgtcctcctcaagtgctgcgcgcgcccaggctcctcgatgatggccgcgccgccgagtaccaggctcggcataactgtctgatcgcgttctaggccaggctaaacactgtctcagcatnnnncggggacgctannnnnnntgttcgacggaatgccggccagggacatcgnnnnnnnngaagt

SEQ ID NO: 100897 - DNA, 639 bp, Triticum aestivum
  unsure (1)..(639): unsure at all n locations
  Clone ID: PAT_TA_100897
gcacgaggctggactctggctcgatctacaaggcgttttcgcatgctcctctcttttgccttgtgttatttctttctttttctcttggattttgtcatttagatggataatgttggatttgttctcttgtttgttcaattttgtaaatttctccgtttgattgttcgatcatgtctcttgattattctcttagatctgaaatatatatttttttgcctcctcttttatcttaacattatgtggttctagatctgctctcacacctttaagcatattgacatcttctctcaacatcatcctcttccgtgctcgatgcgattggggccataatcgctcgccgcgccttcaagaacctttgaagcatctgacattctcaaaccctaatattggttcagatctgtcaagacccctaaagttggtgatgaagaattaaggcaatgacatatgaaaagatgaatctgcaacagatttcaaggttaggatttgtttttgtttaccacttttttgtaatcttattgtgatcangattcaaatcataattgagttagtatcgagtttgtgaagtcaactccattggtttgtgatacttattatattcataacnnaaattttgaacaatattataaaaaacgctctann

SEQ ID NO: 100898 - DNA, 638 bp, Triticum aestivum
  unsure (1)..(638): unsure at all n locations
  Clone ID: PAT_TA_100898
ccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcacaatgcaaacctgcgtcattggtgtcatccctctggtcaataatctgnnnnnaaagcgattgnn

SEQ ID NO: 100899 - DNA, 607 bp, Triticum aestivum
  unsure (1)..(607): unsure at all n locations
  Clone ID: PAT_TA_100899
cacaactagagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacaaactattccccaaccccatcaaacattccaccatcaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccannaagtgattgccaggtgatgcnnnaacaatgttgccaacaactnnnacaaattcctcaacagctccagtgcgcactcatccacagagtcgcgcattccatcatcatgcaacaagaacaacaacaaggcgtgccgatcctnnnnncactatttcagctcgcccagggtctgggtatcatccannctnaacaaccagctcaattggaggggatcacgtcattgnt

SEQ ID NO: 100900 - DNA, 636 bp, Triticum aestivum
  unsure (1)..(636): unsure at all n locations
  Clone ID: PAT_TA_100900
tggagaacaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagnccattccggcaatgtgcgacgtgcatgttccaccatactgctacaccaccatatcaccatccattgacgtcactaccggcatgggcggctactgg

SEQ ID NO: 100901 - DNA, 622 bp, Triticum aestivum
  unsure (1)..(622): unsure at all n locations
  Clone ID: PAT_TA_100901
caaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcnnnncattccggcaatgtgcgacgtgcatgttccaccatactgctacaccaccatatcaccatccattgacgtcactaccggcatgggcgn

SEQ ID NO: 100902 - DNA, 531 bp, Triticum aestivum
  unsure (1)..(531): unsure at all n locations
  Clone ID: PAT_TA_100902
acttcaccaatctagggtcaaatgttcatgggtaaacctcaatgatcgatctcacacctagaatgggtgtgattttgtagtcgttgaatccagcctcgaagattatcttcttccactcctgctcatctcgctcgacgccattgatgaacatgatgaaaaggtcaaacatgacttgtgtctctttgtgcttcgggtcctgcggtcctgcaccaatcaccatgtcgacaattatcaccttccctcctgcatcttttggcgcgatggctttcttgcaattttttagtatcttgatgcagtcctcgtcaccccaatcatgcatgacccacttgaggaaaacaancatcggccggtggaatnctcncccaacatgtncccgggggatgtnnccnggggcgcgaaccaagcctaaatncnaaatncccgncggnccgccntnggngggccggggaancaattcngancgttccgggccccaanttnncccctaatangtggngtcnttattacaaattnnctggggccggtcntttt

SEQ ID NO: 100903 - DNA, 561 bp, Triticum aestivum
  unsure (1)..(561): unsure at all n locations
  Clone ID: PAT_TA_100903
ccgaggtaccgtgtgtgaggtcaatcctccaatggtgttgcctcgttttctgtctcatcatcatccacnatgttcattttcgtcngntggagtttcangatcagtctccatctgttcttgttctgcatcatttgggccgtcatccacgtcgccatacaccatgagagcttaccacatgcccatncaaatccttgtgcttcagattaccaatccaggcaacgctccacattagagcagtgttccaaggaggggccttcacttggaagagaaaccgctccaaggatctcttttttggcaaggtaatcttggcccgttgattaaatgttccccttgtaacccntttgccntcctgcanataaaggtttggnttattcttgtcgctttctgaaattcttttatcatttnancctaaatcgttcgccaacnttgcccaanaactggngtnctccaagnaaanttgaangggttttaaggnaatnaaatcaattganctgcccngggcnnggccgccccnaaaaancnaaattcccccctggcccccaatggggggccggggaaann

SEQ ID NO: 100904 - DNA, 522 bp, Triticum aestivum
  unsure (1)..(522): unsure at all n locations
  Clone ID: PAT_TA_100904
actatataacgnacncacntacccgatgtccttgancaccatctccannccgctgnggcaanncacaatttgcagctcnttgaggngggccangtgtccaatcctgannaccttgccggcgaccttgttcagcccgagcccgaggntgaggttgtanggantccttttatcggtgtggatccccttgcagggatcacnatacccataggggctttggcctccacaactctactatacaatggcanctccttgtcatcacgaaggatgcantcctgtgtgaaaattgctttcgcctcagagatctcaacctcntcgaaaattgcangtgcaaacaaaagctgttctgcaagcgaaaanaanattgtttcccgctaacacgatttgcgagggtatataacanccggcattcacattcaataagcatgtcaaatttgcantaacaaaattnccctttgccaagatnaatttgnatccnatccccnntttgccncnantgcaaaacntttttttcctcaaaatccc

SEQ ID NO: 100905 - DNA, 290 bp, Triticum aestivum
  Clone ID: PAT_TA_100905
ccgaggtacaaactaaggacacaatctcacattcctcaagcaatcaatttacatggtcgataaaattgcagggtcttactaaaatacaatcagatatagcagctcagatcgagccgccgcttcattcttttaggttccactaattgcgaggatacatgtgtagagtcacacgattgaaacagtgaaaagaatagaaaaccggcgaaagacaccctttctagaatgaaaaacatgatgcaaatattgtccaggaaacaaacatgataagtacctgcccgggcggccgctga

SEQ ID NO: 100906 - DNA, 359 bp, Triticum aestivum
  Clone ID: PAT_TA_100906
ccgaggtacatctgcactgcctgctgcatctgcacaaaaaaaatcaaacacatggatagagaggactcagaccacatcgctccactggcaataaaatctactgtctattgggagcctcagacacgaggaagaaggcgtaggggtggtgcagttcaaataagttgcgtggtgaagaattccattgatagaggcgaatcctggccctctcacttcctgcagcccatctctttcgtgcgtgcttgatggagaccatgagcagtgcaagaggaggcgagtgtggccacccgaccagcaccgccgtggtcttatccgtcggagagctgcggaacgggccctgacttagctcctctagccacctg

SEQ ID NO: 100907 - DNA, 545 bp, Triticum aestivum
  unsure (1)..(545): unsure at all n locations
  Clone ID: PAT_TA_100907
accctgacgcctatgtccgcatcatcggattcgacaacatgcgtcaggtgcagtgcgtcagcttcatcgccttcaagtcaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacttgcccaagcctggtgtttgggtctttccaagtcgggagtgcagtgatgagatttcctgcacggaacgtcgctgccgcaatcgtagatgccctgtctccttttctggccgatgcaaacgaccctccggggtgttcntcccgacatgactttcncannataaaatttcccgccaatggnccgnccganggtcaatgaaagannaatnatggnnaaccttgnaanaatnttgcaaggggccgaatgttccttgctggtncccnccctttgnattnaatgggaccttttcccgnaatgntttgg

SEQ ID NO: 100908 - DNA, 575 bp, Triticum aestivum
  unsure (1)..(575): unsure at all n locations
  Clone ID: PAT_TA_100908
ccgaggtaccatgaatgttgttccacttctctacagcgcaatggttgcctggcactgaaaagtctatctcattcttacctgctgaatggtttcctttagctgtcgctattctttacggataccgttgctggcctaactgtctctcgtgaaatcacntttagagcatgtgtgactgggactatatattccctccatccgaaaaagcttgggacaagcttttttggatgggagggagtatgttggactgggaatatatgtgtctccgctgggactgggacctatcccggcccgttaaatactttgtggntgtgaggaatggaaattgaacaagtgtatacaagatgaagttaaatatggggacaatagggcttttaagccatggtanaaatanaattatgtngctttgttaccctgcccggggncgggccgcnccgaaaatnngaaatttcccnccgggccgccnatgggggggccggggancnatgccnacgttccgggccccaaattctcccccantagtgnagnnccttttaaaaantttcactgggccggnngntttttaaaaccgncgtggg

SEQ ID NO: 100909 - DNA, 288 bp, Triticum aestivum
  Clone ID: PAT_TA_100909
ccgaggtacgtgtggttatgtctctgtgccatgcgagacgcttattcgacctcgccctttgactcaaagttctcgccctccaccagatccggaatctcgtcatcgtcgtcgtccttcttgtcctcgccctcggcattcttctggaggctctggtagctctcggccaatttgcgcagagaggctaatgagtctgggccgagctggttgaggatgccgggcaccaactcagtcaactcctttgtcctcgccgttgccgtagatggcgaaggtgttgacctgcccgggcgg

SEQ ID NO: 100910 - DNA, 167 bp, Triticum aestivum
  unsure (1)..(167): unsure at all n locations
  Clone ID: PAT_TA_100910
acaccgttattcgtattgaaaatgcaccttattcgtagtatcattcngtaggaaaggggaaaaaacccgccaattcacatccatttcatccacgctccccttcatgatcaaaaagaatttctgcaacacactcagctatcgcaaatgcantggaaccacaatggcaa

SEQ ID NO: 100911 - DNA, 349 bp, Triticum aestivum
  unsure (1)..(349): unsure at all n locations
  Clone ID: PAT_TA_100911
ccgaggtantccncctgncanattatgcaagcctcattctctgtggaaggttcagatgactgattagacacncaggttgctcctggcacanataagctaatcttcaacttatctacnatgtgantttttgccagncctgtantgacgtctccaatgtgntcttctaatgcnaaaanntcctcatangtcatgctntctatatctagacnnatatctctatgntcatctactacatttgacccntcaaacaanctccgaaaantccatgnttgnaccatgcggcagaggtggnaaaattcttatnttcctatnattaactgggttcancacctgctcgggcggncgcncg

SEQ ID NO: 100912 - DNA, 411 bp, Triticum aestivum
  unsure (1)..(411): unsure at all n locations
  Clone ID: PAT_TA_100912
atacgactcactatagggcagcgtggtcgcggccgaggtactatgacagtaaaagctttgtcaatggagagtagtgacttctgaatagatcttctcagaagactgttcctggatctttgaggctctaacacaggtcacaaatgaaaccatcaagtgatcttcaattttaccgctccattgtcatttttgctatatagcttagtgcttcagatgcagtcttgatgcatgacaggcagtgctgctgaattgggtgcggaacctggatgaatttccagtggccactttcaagtgccactacctaacctatcctcccctgtataccggcttccaanagctgctgttaccgggcgagttctttttgaaattcaaanattccctaaaaattggggnacttgcccgggnggcgcccca

SEQ ID NO: 100913 - DNA, 237 bp, Triticum aestivum
  unsure (1)..(237): unsure at all n locations
  Clone ID: PAT_TA_100913
anaatattcaaaacacnagtanattaantgtnaatgannacgtttcgtttcatttcttttcttttncacaggtaatnatgcctantcnacatnaacatgtttcatcagtgattnatctcaaacgttcatcaaggaggatacttctctataatgtcaattcaactcatctccngacntcccanacctgtacancttggccactgtcancctcgtcntcatacctcgngnttgagcaat

SEQ ID NO: 100914 - DNA, 450 bp, Triticum aestivum
  unsure (1)..(450): unsure at all n locations
  Clone ID: PAT_TA_100914
ccgaggtgtactcccgtcttaaaccagtgctattgcaagtgtttggtacactatccgcccggtgtccttccccaagattagctttgaccgcgcgtgcagcctcatcgtattccgacccgctcacaatttcgccctacatcaatcaacgaatgtcccgtcccaccacaacccgcctcaccagcttacttcttaacatacgcctccccaatccccctctgcaccgccggcctctctgcaatcctatccacccacttcaacaaatgcggaaacgccatctcctccttggaaaacccactcctctcccaattcttcacccaagggtaggtttttatgtcagcaatggaatatcgtcccctttccaataaccgccaaatantccttttcttcccccgtgtnactggccgggggggcgctccaatccaatttcccccgncgncaatgggggcggga

SEQ ID NO: 100915 - DNA, 540 bp, Triticum aestivum
  unsure (1)..(540): unsure at all n locations
  Clone ID: PAT_TA_100915
ccgaggtacatcctatcacctcatggagaaaaggagcctagaaaagaacattcgacttgagctggaacgtgaggtatatccttttcagtttaaacatttctttttgtttgttccgttaatgatagttcaattgtgagaagtgctgcactcggctcccctgactagtgaactccgccgctgaacgatgctcctcagctacactgctcctccggctgaaggtttgctcttagttttagatctccataagttattctagaatctattatgctcttttgcattgaattcatggggttgaaactgtcaattgtgcctatgtttaattctaaaatatatttgctctgtctaaaaaaggtagaatgacaagggtatttagatgtttgacaacaatctgaaatgccccctttgattaataangtgcgtccgggagccanaaaaacttgagaaangnatcaaanattccttttgnaaaaaaactanaacttccgataacaaataactgcccngggcggncgcncaaatccaaatccccccggccgcaat

SEQ ID NO: 100916 - DNA, 266 bp, Triticum aestivum
  unsure (1)..(266): unsure at all n locations
  Clone ID: PAT_TA_100916
ggttcgtgcacatctctccctcatcgatctggttgattttgattagaaattcagtttcgttttttactgtccttgaaggaataaacagatgaaactcaccatgttctacctgcaattccagtcgtgcatctctctctctcacacacattagtatgaatcatattgatatttttattgctacttatgattgatttgcagaattgaacatatgacatagtgcaagttcatctccaagtatgttcgttcgtgacagtacctcggncgcg

SEQ ID NO: 100917 - DNA, 564 bp, Triticum aestivum
  unsure (1)..(564): unsure at all n locations
  Clone ID: PAT_TA_100917
ccgaggtccgaaatttcatccacgcgcgcagccctcccgcgatacaaagctctttgcctccgatttcactcgaattgacctagtcccgcaaaagataacgtttggagacaggctcgctcccgacctgcccctttcctccccgcgcgagacggctggagccaccgacggcgcaagtgttgctgataagtggaaccccgggaggntgaattaaacaccatggctgaaggagtttgtaagggaggaattaacaccacatgggatgatganaatgggatggtgcaactggcttnganggtgctttgtttattaatcaacaaacaatgggggaaccaattcaacaaanatgggatngggaaaccaacaatntnttttgtgcaancaatnaaggggaatgtnaaaggagaaantggaacaaagaatntcncaaagggncaacattttgggaaaggttaaaactttncaaaagnnactggcccggnnggcgctccaaatncaatttcccccggccncaatgggggcgggancantcaantccgggccaantcncctaaaantgagtcctat

SEQ ID NO: 100918 - DNA, 597 bp, Triticum aestivum
  unsure (1)..(597): unsure at all n locations
  Clone ID: PAT_TA_100918
ccgaggtacatctcagctctcaggacaagaagcagcagcatgtgttgcccaatgtccctctctgcagtagcaatgtccccatgaaccttgaaccctgactcagaggacttgcctaagtcctttctttggcaggaattggatttaaattcgaagatgcaggggcggactgcgatggagcttgttaaaagtgttaagagggtanggtcgaacactcggtggtatgccaaaatctgacacaaggctatgggaagaggtgaaaaaggggaacacaatgggaaaagttttggtttcaacttaaatgggcccccgactcctgggtcctcccccntaaagttttcccnccccttccaatgaaatccgaaccccnggtgaaactggttgaaaaacccttgttaaatttgaaaggtgtcctggcnttggttttgataaccaaaaaagaaaagggaacnggggggctaatgcccttggnggttatnaaccgaataatgcaatgtnaatnggnggggacntntttccaaaaatgcctaacntaatgttgcaaggttttggttggcnaantcaaaaaaaangnggggaanaaattccaatttttttctg

SEQ ID NO: 100919 - DNA, 282 bp, Triticum aestivum
  Clone ID: PAT_TA_100919
acatgataggtggggtggtggcagtgctatgccagtgggcatggtgcaactcttatcccttgagcaaatccatgtagataacatgtcatccatccatgacgaccatgatgtcgagtctgccttcaggaatgctgcacaggtgcacccaagatgcccccatgttacaatctactagtagtatcttgattggccttctctgtaacttaaataagctgttctccggtttacttgttttattcattattcattgtgtttactgtgtacctcggccgcgaccacgct

SEQ ID NO: 100920 - DNA, 548 bp, Triticum aestivum
  unsure (1)..(548): unsure at all n locations
  Clone ID: PAT_TA_100920
accattcacacttaaaactgactaacagaaaggaaaccaggaataattttccaacagtgtaatcatcagggatttaacatcaaacacaagctaaccctacaagtttgcgctcaagtatgatcaatacgaattcgacatgacaaccacaattgaacatgaacgacttgcaggattcacacataaaactgcataacgggtaagaaaccatcctaataaactggatataaacttaacaagatgaagattggnaagatgggagaagaaagggtcaaggggaaaaggttcaatttgggttggtgcctttttgagatnaatatgctcctatacctgggtggggatgtcatggnctcaacgggagattccgttgttaggattacggggcccaaaacgcggggcgcccccnggggggatgtcatgatgatcaatttgttttttacatatgaaanggggantttantccggcaaagaaataaataactaaaaacttcaattaaacgaaggtaagttatgatgcatggaactccggcgcgaacacgctatcnaaattc

SEQ ID NO: 100921 - DNA, 300 bp, Triticum aestivum
  Clone ID: PAT_TA_100921
acacatgtaaacactcatattctcaaaactcatggcacgtgaattacaggaaaggaattggatgtctcaaacgtcacaagtaaactaaatagcactcaaatgactaccgaccctacaggatggtagtataaaaataaagttataactgatgactaaacaaaatggaaggacgacgactcttctctatggaactaccagacagattcatcgcgacgcaccaccttttcctctcctagcctttactcttacagtatatggagtctcaagcagcaatttcaccaagtcttctgagtacctcgg

SEQ ID NO: 100922 - DNA, 312 bp, Triticum aestivum
  unsure (1)..(312): unsure at all n locations
  Clone ID: PAT_TA_100922
tttggaatggacgagcatatagaccgttcgcctacttcggtgacttgcatgaatcagctgaagctccctccttatgcaaccaaggaaatgttgcgggacaaattgttgcaggcggtgaggtctgcagctggcttgtagagacgcataggttttgatctggattgaccgcttgtgaacatgtgcagtcgagaaatgcagaggtttcggggtgctacctagctcatatctcaccgaccaaactagggatttgtgccctgttggatatttcttcaaagtacctcgggcgcgaacaagctaaaccaattcccccng

SEQ ID NO: 100923 - DNA, 255 bp, Triticum aestivum
  unsure (1)..(255): unsure at all n locations
  Clone ID: PAT_TA_100923
ccgaggtacatcgtgaagttgcggtgcaccacgggttgccgtctgaatcctggttttgtaatcgcactacaatgatcactgaccaaggcaaggcagccgtaaaggaggtgctagtattttgcctgcctgtgctatgttctgtttctcgagaagtgtttgacagggctgagagtccctgcaaattcagaccatgctgttgaaagttgaaattaattcaaagttgtatgtttttaactcttcaannanaaaaaaaaa

SEQ ID NO: 100924 - DNA, 454 bp, Triticum aestivum
  unsure (1)..(454): unsure at all n locations
  Clone ID: PAT_TA_100924
ggccgaggtacacaggcttctaaagccactcgattagctgctgcaccaggtgcatttccccaaggatgtcctaaagttcctcnacnaaattgtaatanagaatcgcccccaaanatttcggtnaaanctggtanatgncanccntgantaccacctgaagctaccggtataacacctggcatggatacccaagtcctgagtgaaaaaagataaccgccgaagcacgatntttttcaataaaattcaatccgcgcaaataaatcaacaaaacctaaagtnnttttcccgtttcccctnctaaattttctaataactggnacctcnggccggccaattnccttttttcnntttccttttggcgccaatttggggggggttttcnccggtaaaatnctngaaaaaagngggggccccctttttaaggtgttatttacaaattcancggggccgntcg

SEQ ID NO: 100925 - DNA, 547 bp, Triticum aestivum
  unsure (1)..(547): unsure at all n locations
  Clone ID: PAT_TA_100925
gaagcagaaaaagcatcgtctcgtctcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccaagtgcaggatatgcatgcagactttcatctgcaccacctctgaagcaaagtgcaaggagcatgcccgaggcaaagcatccgaagagcgaactcgtccaatnntttcctcaactcaagcaatgatatctgcccaatcaagacaagagaagaagaagatnaaagangagagagaagagagaagctgtcataatccacctaatnttatcatgttccccaatgactgattgttgacctnaacttggggtctgaaaatccggtgtncttgctgtccccgntggcntttgttntgtnnccatctantntgttatcctcctccaacaaactgtttgtgcnaaantaaccttaancccccggtggggttngccccaaaaaaaaaaaaaaaaa

SEQ ID NO: 100926 - DNA, 387 bp, Triticum aestivum
  unsure (1)..(387): unsure at all n locations
  Clone ID: PAT_TA_100926
ggccgaggtacaacgtcnanaaatcgttaccggtgacnacgatgggcacacgtgggttctcctccttgtngtttttttttttttttttatttcgtttcttttttatttataccttctcntctttatctttagctttatctanttnacaatagtatctaccggctcgaaactctaatttgatcgccttccatacttcacaagctgcggctanttcaggactccatttgcnngctgctcngggatantttcattaccttcgcgancaaanattncgccctttctttnaanancttgttactcgggccggcnaacacccaaaccgaaatcccgnggtcnccaatgggttggccnggaanaattgcaagttccggcccaattcccccnaaa

SEQ ID NO: 100927 - DNA, 210 bp, Triticum aestivum
  unsure (1)..(210): unsure at all n locations
  Clone ID: PAT_TA_100927
ggccgaggtaccactgccacattggcatatttcatgcgattacaanttcttcctttgttcagaacagttatantgcgccnacacaaagganagcatggntctatcaaggttgtagacgactcgcatgttctgttgtttgtagctnccgangacaagtctggtgcccnacnatcgtgnctagcaacaagcacatgaccctcacctgcccgg

SEQ ID NO: 100928 - DNA, 421 bp, Triticum aestivum
  unsure (1)..(421): unsure at all n locations
  Clone ID: PAT_TA_100928
ccgaggtacaaagaaaaatgataccgtcaacagagtaagaacaccagctagggatacataagaatgctctagaatctcaaaaatagcattccacgttgcattgaagaaactattcacacggccatcccaagagtcttcatgcaagatacgaaatgagtcacactgtggaaacattgagaagaccaacacgaaatacacaaaaccaccaatgacatcaaattgccaatttttccttcggaattttaaaatattaccaagtgcaatcttgctagaatcttcataagaaggatatacaagccttcgtttcatacttgttcccataacattccttgaagttctcgaaagacatgtgttggatgcaaaaaggctccaccacaaccanttacaaagcaagtgttgcacatgtacctgcccggggngg

SEQ ID NO: 100929 - DNA, 308 bp, Triticum aestivum
  unsure (1)..(308): unsure at all n locations
  Clone ID: PAT_TA_100929
ccgaggtacacaggcttctaaagccactcgattagctgctgcaccaggtgcatttccccanggnngtcctaaagttcctccaccaaattgtaatacagaatcgtccccaaagatttcggtcagagctggcatatgccaaacatgaataccacctgaagctaccggtataacacctggcatggatacccagtcctgagtgaaaaagataccgcgagcacgatctttttcaataaaatcatcgcgcaataaatcaacaaaacctaaagtcatttcgcgttccccttctaacttacctactactgtacctg

SEQ ID NO: 100930 - DNA, 287 bp, Triticum aestivum
  Clone ID: PAT_TA_100930
accggacgggcgaaagcttcgacatgtctgggtgacacgaaacgttgtttagccggcaggagttggggtctgagaagtttgccttttagtgtaaaaagcagcaatgcgttggttatcgcggtcttgtcgacctcctcctgagagtagtttagctcgagtggaattggcttgtttttctcgtgggaatagtttgagaagctgatatatatacagtatttgcccttaacctatatattaacttcaaagtgttggtacctcgggcgcgaacacgcctaaccaaattcccc

SEQ ID NO: 100931 - DNA, 764 bp, Triticum aestivum
  unsure (1)..(764): unsure at all n locations
  Clone ID: PAT_TA_100931
ttttttttttttttttttttttttttttttttttttttnccgnnccttttttatttataccttctcttctttatctttagttttatctacttatcaatagtatctaccggctcgaactcgaatttggtcgccttccatacttcacaagctgcggctagttcaggactccatttgcaagctgctcggataatttcattaccttcgcgagcaagatcgcgcccttcgttacnaacttgtacacaggcttctaaagccactccattaactgctgcaccaagtgcatttccccaaggatgtcctaaagttcccccaacaaattgtnatacaaaatcntncccaaanatttcggtcaaaagctgggaaatgccaaacatgaataccacctggaagctaccgggaatnaaacctggcaagggataaccaatcctggagttnaaaaaaaaacggcgaagcaaaatttttttcaaaaaaatcntcnccnaattaaatcaaacaaaaacctnaaagccnttttgcgntncccctnttaacttacctanaaannggcccnccggggcgcgaancaacnctaattcnaaattccccccgggccccaatggggggggcnggganaantttaaaatncgggncccaaattcccccaaaaanggagggccntattaanaaattanccngggcggctttttttaaanctcntgaacngggnaaaaaccctngggtttanccaaatttaaagnccttggnaaaaaaaaccccnttttcca

SEQ ID NO: 100932 - DNA, 185 bp, Triticum aestivum
  unsure (1)..(185): unsure at all n locations
  Clone ID: PAT_TA_100932
acactgcccctgttgcaacatgcaaagacacatgaggatgtgatcaactcatcncaactccttcaactcctccaagtaagttgtttccttatgtgacattgattcaggagctgtcccatcagactatgttccctctgtataaaacacaaacagaaattccagttatcctaagtacctcggccgcg

SEQ ID NO: 100933 - DNA, 179 bp, Triticum aestivum
  Clone ID: PAT_TA_100933
acaacacgtgccatttcttgtcatcccagcaatcactgtctgcataagcctcaacatgctggatatggctaaacttgtcccactcgctgccagattttcctgcggccatgaaaccaagtatctccagaccgcaatccaccaagcaaatggcttggatttacagtttgaaggtacctcgg

SEQ ID NO: 100934 - DNA, 229 bp, Triticum aestivum
  Clone ID: PAT_TA_100934
acagatgaacttaatgcttatttggtaaaatacagaattgtgcttgatcctcagctagaggcactgattgggaggcataacaggaaaccttggtctaagtttgtgaatgctgaaaataggcatctcgtgtccgaagaggccatcgactttcttgataaacttcttcgctttgaccatcaagataggcttacagccgaagaagccatggcgcatgagtacctcgggcgcg

SEQ ID NO: 100935 - DNA, 802 bp, Triticum aestivum
  unsure (1)..(802): unsure at all n locations
  Clone ID: PAT_TA_100935
ccgaggtacataacctgacgcttctcccatttcttccttctccttcttctcaacattcggaaacgtccatgaatcaaaggagcgacagcaagaacatcgaccatgcagatcttcaagctctccatcattctcttcatgacctcggcggccatggcggaatttatctgcgaagtcatgtcggaagaacacccggagggtcgttgcatcggcagaaaaggagacaggggcatctacgattgcggcagcgacgttccgtgcaagaaatctcatcactgcactcccgactgggnaagacccaaacaccaagctgggcaaagtacatgaacatnggcatacacatattcttaaggaacaaataagaaagataaatggggaagggaaanccaaaagcaatgtcagagttgacaaaaactgcaatgggactttatatatggcctgtcctgagtgaactgtttaagccttgccgggactcctcgcaacccngtnggntttaangggaanaaacctgacncactgcanctggngcatgttttccnaatcccatgaatgcgggcgttactccgggcgcgaacacgctaatncnaantcccnccggcccccaatgggggccngggaacaattgaacnttcgggnccaaattccccctaaaaangggttcggantacaaantccccggggccgtccgnttttnaancccccnnaatggggaaaaacccnggggtttnccaaaattaattgcccttngcanaaaanccccctttttccaactggtggtaaaaagnnaanaggccccccccattcc

SEQ ID NO: 100936 - DNA, 586 bp, Triticum aestivum
  unsure (1)..(586): unsure at all n locations
  Clone ID: PAT_TA_100936
ccgaggtacccatcagggttacctttttatttaggtaaatgtaagactccatcaccttttaccangtatccatccaggttacattatgcgcaaaaaaggttatacatttaattccaaatttgttgaatatatggttttactgcatgcttataagtctgtagctcttgggctgtacgacgacgaggtgcgcaagtgggtgacctctaacggtatcgaaaacattgggcaaagaaactggtgaactccgcgggacgggancaagtgaccttttgagcaanccaaaagaatgacagtgggagaaagctgctaagagtacgtccacaaagattaatcaaacaagaaggtggggaaaccaaaccgtccaaanctccttnaacggcttccaatggttccggcaaaccgaaccgtgtccctcctgtaatgtaccaacaataatcacaaccaaaaaagtttactggaataaaaatgttgtgaattnggtttcccccctttggctcntnacctggcccgggggggccgctcccaatcnaaantcccccccggccgncaatngggggccnggaacaatgcnaacttcgggccnatn

SEQ ID NO: 100937 - DNA, 256 bp, Triticum aestivum
  unsure (1)..(256): unsure at all n locations
  Clone ID: PAT_TA_100937
ccgaggtaccggccgccagcgaccaaatctcaccaggagatcttgtggtggtatacatgcattactctcgtccttcctatccctcgctgaagcgcaccaatcgcaaaagtccaagcggtgctcgctttcacgccttaaaagcgggccgttataattgctccccccccgcaacaagtttcaatcgggaatcnggggggccaaccgaataaggggtggagggcgtnaaaanaagtttggagaaatccactcaacaaat

SEQ ID NO: 100938 - DNA, 740 bp, Triticum aestivum
  unsure (1)..(740): unsure at all n locations
  Clone ID: PAT_TA_100938
ccgaggtgtttggnatatgccaactctgaccgaaatctttgnggacaattctgtattacantttggnggaggaactttatgacatccttggggaaatgcacctggtgcagcagctaatcgagtggctttanaagcctgtgtacaagctcntaacgaagggcgcgatcttgctcacgaangtaatganattatccgngcagcttgcaaatnnantcctgaactacccgcatcttgtgaactatggaaggcgatnaaattcgagttcgagccggtagatactattgataatgtagataaaactnaagataaaggaacanaaggtatganttcnttcccnccaaanctttccggtaantanaaccngnccggggnggcccctcnnaaatcgaattccccccggccccaatggttgcccggaaacatttcaacttcgggnccaaattccccctaaacgggcgtccgtaananaaattaactgggccctccnttttaacaacctcccggaacagggnaaaaancctgggnnataacccaaaattaaaacggctttggaannacattcccctttcnccaaantgggggttaataacgaataagggccncaacganttnccccttccaaaaaatttcccatccctnanatggncaaangggcnccccccctttaaccggngcaattaaccccggnnggggnggtgggggggtaaccccaaanttgnacccnaaattnccaaaagccc

SEQ ID NO: 100939 - DNA, 338 bp, Triticum aestivum
  unsure (1)..(338): unsure at all n locations
  Clone ID: PAT_TA_100939
attcactagtgattagcgtggtcgcggccgaggtgggcgctgatgtctacaaaactgtgatgcnnngcgagcagaaggaattagagatggtggtgcccatcaacaagccataaatgcagcgatgcatgcaatggacggatgagatatgagtatggcgcaaacgatgagagggatagacgcacaccacgaccgctccgacacgactgcggtgcgatgcatagaatgagggtcctgggcaacttgatgacatcctcttcatctgatgaagtgcgttcgagtggtcggacattgcaaatgatctggcggagcgcccgactgctatttgcctatacctgacc

SEQ ID NO: 100940 - DNA, 339 bp, Triticum aestivum
  Clone ID: PAT_TA_100940
tagcgtggtcgcggccgaggtactccacttttttctatagtcctggcattatttcttcttctgtatattgggaatccttcttcatcgatgcttgattccgcacaaaacatcttagggaaatgttttgagcacttcccattgatcatgcatggtgacttgtagcatgcctggccacatggtccatgcatcatgaaattttcaactgccatgtaaccttctggatcaacatccttgtctggtacctctgctgatatgattttgtcaatattttgggggctaggatccctgtcatctggatccaaaaataatagtatatgtgcatgaggtagacctcttttc

SEQ ID NO: 100941 - DNA, 277 bp, Triticum aestivum
  unsure (1)..(277): unsure at all n locations
  Clone ID: PAT_TA_100941
aattcaaaaggtattttctctttcatacataggaaacaacacaagcctagcttgcttgctcgatttctcaacattacatctatatgcgagcataaggacaaattttttattcaagcagcatatcacagatcaacacaaatgtttagttaaaacaaatatacatatctactcattcattgggacctcttccaccatngccgtctaaaggatagccggcaccacgggatcctccgccataaccgccacctgcccgggcggccgctcaaatcaaattnnn

SEQ ID NO: 100942 - DNA, 335 bp, Triticum aestivum
  Clone ID: PAT_TA_100942
tagcgtggtcgcggccgaggtacctccttgactagtatcgctgatgatgagcacaaatagaagtaacatcacttgctccagatctatcgcccaaaagacaatccgacgagacaccgggaccggattgagtagaactcttcctcctactcaacctttattccgccctccacaacacatgaagagattggggaaatctagagggccttagatccgctcagctggtcccctcccacaaccgtctgtccggccaccatggctacaacagctaccgcaaggagaggccgaacaagctctcatttattcaaccaggaagaactactattggcgttacaagg

SEQ ID NO: 100943 - DNA, 217 bp, Triticum aestivum
  unsure (1)..(217): unsure at all n locations
  Clone ID: PAT_TA_100943
tagcgtggtcgcggccgaggtgctggggctcatggcctaccgctcggtcatgcaccgtctcgggccggcgccggcgccgccgcaggacgagctgccggaggcgagagtgcagcatcagcatcagaacggcagtgtggttcagacaagtcgcaagaattactagtggtcactggtcagtgtgtcattagctagaatggcaaattcatggctgcnnnnn

SEQ ID NO: 100944 - DNA, 342 bp, Triticum aestivum
  unsure (1)..(342): unsure at all n locations
  Clone ID: PAT_TA_100944
tcgagcggccgcccgggcaggtacagcaagatggagcacataccctcaaaattcattacatgcataaatcgaaaaaaaaagtaacaagccatcactcagtcacattatatgattgttctggattccctacaaaaatttacgaagccgcgggaacggcagattcaacaggggactcttgttgtttctgcagtgactcccagtccacctctttcaggatcttgaacctttcgtcgagactcacgaaaccagactgaggggccaccgcaccagaggtgcctgctttgtgcacgaggattacggtacctcggccgcgaccacgctaatcgaattcccgcggccgnn

SEQ ID NO: 100945 - DNA, 181 bp, Triticum aestivum
  unsure (1)..(181): unsure at all n locations
  Clone ID: PAT_TA_100945
tagcgtggtcgcggccgaggtnngcacgacgttcgnnnntatggaatatgatgcctgtttaaaccgatgacaataaccgtaattcgtctctgtcatttactcccaactgatgaaatcgtgatcacgatcannacgtgagtaatatattgcctcctcctacctgcccgggcggtcgctcana

SEQ ID NO: 100946 - DNA, 260 bp, Triticum aestivum
  unsure (1)..(260): unsure at all n locations
  Clone ID: PAT_TA_100946
tagnnncggccgcccgggcaggtacacctgggaggagagcaccgtcgcatggggtgtctgtaatcatgctttccacttccactgactcagcaagtgggtcnngactcttcaaatgtgcccactatacaacatnnaatgggagttnnnnnaatannnnnactnnnccaccctcctccgccactgggcggcggcatgttacttgcctactaccaccccaccaaaagcccaggcctatctcttgtcgagcgtccntatctccg

SEQ ID NO: 100947 - DNA, 317 bp, Triticum aestivum
  unsure (1)..(317): unsure at all n locations
  Clone ID: PAT_TA_100947
gcggccgcccgggcaggtacagtatttgaacttgttcagtcccatcgatagcagcccactacgagtcttcgaatatgcttttctcttcattaaatcctcatacaaaacagaattcggggtaactgcaggtgttgcaagagaggttttgaggtaatgttcacatgcatagagaacatttctttcataagcatcccacgttttgagatcttcagtgtccttgaagtggacacgcatcttctgtgcattggccctcatcttgcgcatcaactcaggtgttcgactagataccttctcaaactgacggcattgccattcnn

SEQ ID NO: 100948 - DNA, 256 bp, Triticum aestivum
  unsure (1)..(256): unsure at all n locations
  Clone ID: PAT_TA_100948
tagcgtggtcgcggccgaggtcaaaattaanncacttgtggtggactaattaacaacatgttgtgtatctaggatactggacgcaggtttgcctatggaatcctatgagttctatctggacctnnnncgctatggatccgtgaagcacatcgggttcgggctaggcctncagaggatgctcctctttgtcaccggcctggacaacatcatagatgtcatccccttgccgaggtacctgcccgggcggnnnctcgaa

SEQ ID NO: 100949 - DNA, 344 bp, Triticum aestivum
  unsure (1)..(344): unsure at all n locations
  Clone ID: PAT_TA_100949
tagcgtggtcgcggccgaggtacttacaccacctgacgagcaatcaatcctctttgagggagctcattctaaactacactacctctaacctcagctaaactacctctgatctgaactacactatctctaattattccgtgatggcctgcaatgcaaacgacggaataggcatgaatgaagagttttcgggcagctgctcctgtttgggtttgcatcggcaggagtcactatgatgcctaagtgagctggtgccgcaactggaaccaccttttaacttcaacatcgtgtcgcactggttgcacgccgcaaacataagtttannatttttggtgtgtatcttggtg

SEQ ID NO: 100950 - DNA, 352 bp, Triticum aestivum
  unsure (1)..(352): unsure at all n locations
  Clone ID: PAT_TA_100950
tagcgtggtcgcggccgaggtgcacnnnncnncaacactcannnntaatnnnngnnnnnatgttaatggaggagacaaagcaactggcgtcgacccatntgctgacattaacattgaacaaagcttcntatgtatcatggnnnnnntcaaacactcaattagaatcannntccttgaacatccaccaaaaaatctgatcaacacaaactatatattgtgcttgcaagataggctcattaaagctcctggagctggagaacctggcaaaaagcgtgctgcctcaccggttgtatctgctgnnnnagntctgtcttctgctcttctatggtacctgcccgggcggccgctcana

SEQ ID NO: 100951 - DNA, 475 bp, Triticum aestivum
  unsure (1)..(475): unsure at all n locations
  Clone ID: PAT_TA_100951
ttccagcggccgcccgggcnnntactcaaatgacacattaacntggcgcatnnnnnacggcgctaacagtagcaaagcttnntnnnnactaaactaactanngatctcaaaaagcacncgtatacggattcatgtaaacgcctcatttcttcttgatggcagccttggtcaccttggcgccagttgggtccttcttctccacacccttgatgacaccaacagccanagtttgcctcatgtcacggacagcataacgaccaagaggagggtaagtggcttaagtctccacaaccatgggcttggnnggaatcannnnaactatgccnncatcaccgttcttgaggaacttgagcgcgnnnnctatctccttaccagatctcctgtcaatcttggtcaccagctcagcacacttgacagcaatgtgtnnnnnnnnnngcaatccagcactggggcgtatccgttgccaatctnnnnn

SEQ ID NO: 100952 - DNA, 286 bp, Triticum aestivum
  Clone ID: PAT_TA_100952
tagcgtggtcgcggccgaggtactaccaaggagctaaactaacagcaaccatccatcatcaatcggtgacactagcaatgagcgacagcggcgacatttcgaagaccccctccccttgctgttgcttggcatgccacatcgcaagtccccaggataaatattaacagaagaagaatcgttgaacaaatcatgagctagctatcacagtataactagctccaatgagctagaaatctatgcttcttccgacttgaacatcatgtacctgcccgggcggccgctcgaa

SEQ ID NO: 100953 - DNA, 246 bp, Triticum aestivum
  Clone ID: PAT_TA_100953
tagcgtggtcgcggccgaggtattagctaaagcattgcgtatgtctgggggagatcatatccactccggtacggccacccggacctgagggccgtcgagatggaggagcaccgggaaaatggtggattcgttggcagctcggcgctggctagtggcatatgatcatgatgatatgacatctgctctgtttttgccattgtcgtcttgttcgatttggtagagtacctgcccgggcggccgctcgaa

SEQ ID NO: 100954 - DNA, 336 bp, Triticum aestivum
  Clone ID: PAT_TA_100954
atgtcatataaatgctttattagcgatatattctgttggtcgaaagaccgatacattgacaacaatgtaaggaagattcaagaaccttctagtagcaagtattgtgtatagcctactggtctccatacatttgcatccattcatgatgcttcaaaggcagtcggacccattcatgataatcgcagcttgtcgctgatagttcaaattttatcataacattgaagcccaaggcggcacagtccatgctcgacggtcgttccgaaaggcttgcaacattgtcatgatctggtatcactctctccagtttccatgtacctgcccgggcggccgctcgaa

SEQ ID NO: 100955 - DNA, 213 bp, Triticum aestivum
  unsure (1)..(213): unsure at all n locations
  Clone ID: PAT_TA_100955
gcggccgcccgggcaggtacagcgacatcaagatcgtgcaggtggcnnntctgatggaatctctcacgaaactctccgaaacctacgccaagtggccagcgtgcaaagacaaagacctcttcaaattcgccaatgaagacagcgccgacggagccgagcccgtgaagatggaacctggtccctcgatgaagtacctcggccgcgaccacgcta

SEQ ID NO: 100956 - DNA, 289 bp, Triticum aestivum
  Clone ID: PAT_TA_100956
gataaatggcgcttttattatctcaaaatatagcatcaaagtgatacaaagcattaagagtatcacccggcctctgcataactaggatgcacacagccaaacaccagtagtctgataaacagaaagataaaagaccgacaattcggcaaccatagagtccatagaccgagactatgcctatgttaaaagagatggtggaccgagccggagattacgctgccatccatgttgggaaaaaacctccgtagccacttgctccaacatcgtacctgcccgggcggccgctcga

SEQ ID NO: 100957 - DNA, 220 bp, Triticum aestivum
  Clone ID: PAT_TA_100957
tagcgtggtcgcggccgaggactcgatccatgacgctgcaagcaatttgtgcatttttctggagaaccggatctatatctggcaattttggaatctgagctagtaaatccatcgttcgtctcagcagacgggctaaatctccatcatccattgcagagtccatcattatctccctccatgtcaaccctgacgcccagacctgcccgggcggccgctcgaa

SEQ ID NO: 100958 - DNA, 308 bp, Triticum aestivum
  Clone ID: PAT_TA_100958
gcggccgcccgggcaggtactactcatcaatttggccaatcaggttcatcattcatccctgcgcaggaacacttctttcctgcaagtaagtagaaggtgttttcagctcgcctcattggtgcgcccaggcgaatctttggtcaatcaggttcatcttcacgacacagatcagggggctctgtttccttttggttgatcatcctgtagctgacataaattagagggttcaacctgtagttaccgatgttattgcttgtaaaacataacctatacttttcagacatagtacctcggccgcgaccacgcta

SEQ ID NO: 100959 - DNA, 435 bp, Triticum aestivum
  Clone ID: PAT_TA_100959
tcgagcggccgcccgggcaggtacttctactccctagttcagctttctacttcaagtaattctaccaaaatacaacctagctagccacacactttgtttgcgtccaacaaaagactccacgcatcttaagtgctatgccaaaatactacctagcagcctgcaagtaatatgtttagatatgcccaatctgccttttgagccaggctaaccttggttcatccgtagaaaacgataggaaaagctctctattctccttgcttttgaagatatcagcagccatcaccatatcagccatttgtagaccaggtagacgttcaagtgttgtgacacacctactgatgctatagggatcctcaagcttcttctcctcaatagctgcaaaccgttcaatttcttctttcttgagcttcaagtacctcggccgcgaccacgcta

SEQ ID NO: 100960 - DNA, 241 bp, Triticum aestivum
  Clone ID: PAT_TA_100960
gcggccgcccgggcaggtacccattcctgaatcgcaaaatcatgacaagagcagcggctttgaccggttcaaaatacaagaaaaatcacggtgtgcctactactgaatagtcaccacgctgtagattcaacgaaaagctttccaaaatgatgctcgctgatgatactctcgccatgtccaggacctcaggtgccaagaactcgtatgtctagtctgatgtacctcggccgcgaccacgcta

SEQ ID NO: 100961 - DNA, 518 bp, Triticum aestivum
  Clone ID: PAT_TA_100961
tagcgtggtcgcggccgaggtggtaaaggcatttctgagttggagagggctgtaatagaggttagaggtcttgagtccataccttccgggggacggcggtggactgtaaaccagagacaattggaacagctcatgaggacccaagaagctttcacaagactagagtcgtcgatcaatgagcagctacccttagatttttggactatagacttgagggaagctgcattggctctggcaacaatcagcggagaggacatatctgaagaagttctgagcagcatattcagcaaattctgcattggaaaatgattcgtccttcagaatcatgctggtcctcagtcattccgacaattttgacttttgagcagcgtagtaacatagaacgatctgaacaagcccagtagctatctaaaggagcaatgaaattgaactattttctggacggggtcaaagatttataggtcgggattactgctgtcactgttccaaatttgtacctgcccgggcggccgctcgaa

SEQ ID NO: 100962 - DNA, 347 bp, Triticum aestivum
  Clone ID: PAT_TA_100962
tagcgtggtcgcggccgaggtactgtttggatctctatttagatccccatgacttgtcaattgccgatcccttcaacaactcttttctagctgaagaccatactcttccagtgatatcaatatcatgtccttccagttctgacgaggatagtaactgaagatcgtgttgtcttttgcttgtttttatggtgctgatacctgaatattatgttgcctgcagttcaatgcttgtttctctgtttgtagtttaattgtcctttgtaattcccagcatggtatgttatgcaactagttcactgtcaaaagttgtaactgtgagctggtacctgcccgggcggccgctcgaa

SEQ ID NO: 100963 - DNA, 322 bp, Triticum aestivum
  Clone ID: PAT_TA_100963
tcgagcggccgcccgggcaggtaccgcatcaattgccagagaaaagctaatatcaatttcttgtttccttgcacaatatcatgaccagcaatattcaccaaggaaaattttatttcctttcctatcttcagaacttgattacagttttcaacttttctgaatggaagttttattgggggccggtttgcaaacttccaattaactgaaccaggagcaaccttatccatgacctcaaggagcacccatccatttctaagatcttcgaatacattgtttatatatgtagaaattccaaggctgtacctcggccgcgaccacgcta

SEQ ID NO: 100964 - DNA, 359 bp, Triticum aestivum
  Clone ID: PAT_TA_100964
tagcgtggtcgcggccgaggtacttgccctgctcggagccgcagccgtcgtgctccatcggtgccatccttcctcttggttgccaccggagaatccctcatctctccaaaaaaaggatgtatggtgagttagtgcttgcacgggttcatattttccttactcctggttcactctccccaatatacttgttcaattgatcaggcacctaaagttctagaaaaggaaacattgcacagtttatacagaacaaaaattaggtagaaagaatatggaaatgtcaaaataaattatcattagtgttttcccacaacctggagatccaagcagcaaaaacgcaacctgcccgggcggccgctcga

SEQ ID NO: 100965 - DNA, 615 bp, Triticum aestivum
  unsure (1)..(615): unsure at all n locations
  Clone ID: PAT_TA_100965
gcggccgcccgggcaggtacagaaagttgctaggtgctgttgttgtaattgcggctaatgctgggggtgcatggacaccaattggtgatgtgacaaccactatgttgtggattcacggtcagattacgactttaaaaataatgcagggcttgtttgtcccttccgtagtttcattgatggtcccactggccctgatgtccctcaccagtgaagcaaatggatcgtctcatgaatcttcaagtttgctgtcatcagagcaaatggctcctcgaggacaacttgtatttgctgttggacttggagccctagtgtttgttccagtgtttaaatctctcactggattgccacctttcatggggatgctccttggtcttggcattctctggattctgacagatgcgatacattatggagaatctggaaggcagagattgaaagttccacaagcgctttcacggattgatacacaaggaattctattcttcttnnntatactgttgtcggttggcagcttggaagcagcagggattttgaggcagttggcgaactancttgatgccaatattccaaacgctgacctcattgcaagtatcannnngtgtagcatcagcaatt

SEQ ID NO: 100966 - DNA, 232 bp, Triticum aestivum
  Clone ID: PAT_TA_100966
gcggccgcccgggcaggtcaaaggtagcttttctataccctattatttcaggaaaaagaatcattgtagcgaaaatagcaacaatagctcttgccattctgcgtcacatctgatcttgacttgtaatttttcaccagcttcagcctaagcaatctgaatagtaggaggtgagctcggaagcagcaataagtctcaagcccagtgccactgtacctcggccgcgaccacgcta

SEQ ID NO: 100967 - DNA, 279 bp, Triticum aestivum
  Clone ID: PAT_TA_100967
gtggtcgcggccgaggtactgtgggtgaacgtttgcagggctggatttgtatcgcgcttttacataatcattgcgcttgcttcgctgtggagttttgtttggtccgctgccgcgaaggaactgggatggcaggcagagagagaggctgggacggcgtaagagggcgggcggagacattgctgaggtggactgatgattgggacaggcagtccagtcctcatcactccgatcggcatacggtataggcatcctttgtacctgcccgggcggccgctcgaa

SEQ ID NO: 100968 - DNA, 192 bp, Triticum aestivum
  unsure (1)..(192): unsure at all n locations
  Clone ID: PAT_TA_100968
nnnnagcggccgcccgggcnngtacannnctgggaaggaaggacttgaaacagacgacgcaaacttgatcanngaaaggtctgacgctcccatgcccttcctaccctganatttctccanntntctccgtctctcaaggttgagcaaggatatggaatgactcacggtgtacctnnngccgcgaccacgcta

SEQ ID NO: 100969 - DNA, 299 bp, Triticum aestivum
  unsure (1)..(299): unsure at all n locations
  Clone ID: PAT_TA_100969
tnncgtggtcgcggccgaggtacatgacaacaaacaagacacacacacacacacacaaggagctaaaatggcatttggagatgcaaaccaaaattaccagtgtcatttgctgaaaattgacactacacaggcaatccagacttcaaagttcagagtaatatcatgccacttcttgacagaaagaaaatacaggcatttctatgtgcacaacacgccaattttttctatctgtttttatctgtcaaaactcatgagcaagatcctggggacaaacagaacctgcccgggcggccgctcga

SEQ ID NO: 100970 - DNA, 468 bp, Triticum aestivum
  Clone ID: PAT_TA_100970
gcggccgcccgggcaggtacatgttgctcctatcaagattcacagacgggatcgagattagctcgctacacccctatgtagtgtagttaaaactatacaaaaaatagcaactacacacctatccctatgtaaactttgatacttgtgcctatccactttgatcactgctgaataaggtttagtaagcttttgacaaatcaaagctcaaaccataccgataggtcttgaatcaaaaggctgaaattccccagatgaacagaacaagtctactgtagaccttacaggtttcaaatcaaatctctggaattagcatctgtcctgaagacaattcacatcaggctacagcaaatgtgctaaataaagcatgtggaaggatacacatgcaactcatctgagcatgtctcctcccaaaacaagtccaccgcaattaccagtcacctgcagagtacctcggccgcgaccacgcta

SEQ ID NO: 100971 - DNA, 386 bp, Triticum aestivum
  unsure (1)..(386): unsure at all n locations
  Clone ID: PAT_TA_100971
tnncgtggtcgcggccgaggtacaaatgacnnacattagtgccccccaaaatggaaaagaaaagcgacttactatcctaccaaaataatataatttacacgtggactaaaacgccgcgggacaaatggacaatagttacaggccatgcaacatgcgtggaaccagctaatcagcataacaatgctaccaggctgccagcgtatgcagttcagcacttcaactttgctctagtcaagaaaaaaggccaccatatctttcaggctgctcttctttttcgccacaggtgccccctgcacttgtgctacagtcttctgccagtcgtttttccgctgcgacgcaagattcacgttcacggtcctcggtacctgcccgggcggccgctcgaa

SEQ ID NO: 100972 - DNA, 365 bp, Triticum aestivum
  Clone ID: PAT_TA_100972
taacgtggtcgcggccgaggtacagctgatatagttgatgtttgataacagttggttcaaggtgtgtggccttttgcatttttttctgacctgtctattttctgaattctgctgagccggtaaagacagtagatcgagatatttcagtccctacagatgctttgttatttgaggactaagcattaaacatgttccagtttctagtccattacatgtagattacttatttaccgagttactggaaactgtttaggcttccaatttattctcagttatgttgtgatgggctgcgcatgtgagttgacatagcaaacaacttattttgatgagcctaaagcatgtacctgcccgggcggccgctcgaa

SEQ ID NO: 100973 - DNA, 489 bp, Triticum aestivum
  Clone ID: PAT_TA_100973
tagcgtggtcgcggccgaggtacaacaagaaatgtgctaacaaaatgtttttacaaaaagaaaggctgtgtgatatgagtcatatactatttacatgtgatgatatctcatgctcatgatgtggtagataaatgcatctcctcgtcatcttcatgcccctccctcttctcagccgccacatgacacgccacttcctcccacaatccttcttcttgttgttttcttcccccacctgcaccagatcaaacatagaagccaggctgaacattgcgatcttacagatctgccaagtgcatcctcatgaaatagatagtagcgtcgctgataaaaaaagtagattggccaatctaggtagcatcagaagttgtctccatcggaaagaacactgcctaatgccatcttccagaaagcttgaaggcgtaggcttcagcctcggaaagagccctcttcagctcgccgttctggtacctgcccgggcggccgctcgaa

SEQ ID NO: 100974 - DNA, 406 bp, Triticum aestivum
  Clone ID: PAT_TA_100974
gcgtggtcgcggccgaggtccagatcggggcgagtaggcgacgagtcaccgtcgtcttttctaccctatttgtttaatgcttattgtcgtgtttttgttttctgcttttttcgggtgtcgtgtttgtatgtttctttttgtggtgctgcttatatgtgtgactaccgtatgatcgtatatatatgctgaaaagtaaaacaatttgcctctgcctcgacctctcccgcggcaaaccctagcgccacggagtagagatcggcaaaacgacaaaaggagttaatgatttgtggcactaaactatgtaaatcggcaaacactctggtcgtccactaatttgtggcaatgaaattctgctaactctgcaaaaatcgtttccatattgtacctgcccgggcggccgctcgaa

SEQ ID NO: 100975 - DNA, 363 bp, Triticum aestivum
  Clone ID: PAT_TA_100975
tagcgtggtcgcggccgaggtaagtgatatcattttcttcgtggttgctgttataaattttgctataacaaggtagctcatgtgttgtattcctgtttggtagacatgtcctgcttccaaggattgttcttctgctcacaggttgcattcctgttgcttcacaatgtttgtatttaccatattactcctcaatgccatgaggtcagtcatcatcatatgttcctccatatttaacatagtcatttactattctgtccctattacctccagttcttacatgtttgtctttcatggcatctgttgtcttacagttgggagcagctccaattccatcagatgtacctgcccgggcggccgctcgaa

SEQ ID NO: 100976 - DNA, 187 bp, Triticum aestivum
  Clone ID: PAT_TA_100976
ttcaagcggccgcccgggcaggtacttctccagtagctgagaccacgcttcctcgatcgatctcgtccactgtgagcatatggtttatgactttatgaaactcatgtctaaattcattttctattcccgtgcagaacccccaaactttctatagccttcaagatgtacctcggccgcgaccacgcta

SEQ ID NO: 100977 - DNA, 549 bp, Triticum aestivum
  unsure (1)..(549): unsure at all n locations
  Clone ID: PAT_TA_100977
tnncgtggtcgcggccgaggtacaacatgtancnnnattcctttacatacatagtttgggcaatattactacttnntntcactaaggttnnattttcaaacaatgaattgattgcctcccnnnacgggaatgggatggacgcgatcgatcaatcaccannctgccatcagtttccattcatnnnaaccctgaacattnncctcccagaaccaactccttgaaccgagttatgcatcccattgcgcgctcaaatttgccnnnctccagcgcaaagctgaaccggcagtagtcgggtatcccagtccaggagctgctgtttatgcacagccccgtggctctgatgatggtttccctgatgttgctcgcatccagcttgccctcaaagccatcacntttgaaacgcttcccaatgtaagcagtcggtttctccagcatctatatgccagcacaaccggtggcaacgtcccaaccgcaactctgcaacgtctgttcattgtgcaacggtgacacaagagaaaatacctgcccgggcggccgctcnnaatngnn

SEQ ID NO: 100978 - DNA, 315 bp, Triticum aestivum
  Clone ID: PAT_TA_100978
gcggccgcccgggcaggtacttcagcaacaatatgttcaacatcttcaaatgcttgcagagagactgctcattttagcacgacgctgagttatgtcaattctcaagataacatgatcaatggtagaacagttgtaaatcgagcggtgagctgcagcacatatccccgaacaaggacatgcgtcttgaatcttgaaataaagatgtttctgcatctcgctgcacaaaattcagtcattcatcgtaacccttagcttgcctcttgttagcgattcacactgttttcttagctcagtacctcggccgcgaccacgcta

SEQ ID NO: 100979 - DNA, 573 bp, Triticum aestivum
  unsure (1)..(573): unsure at all n locations
  Clone ID: PAT_TA_100979
gcggccgcccgggcaggtacaaataaacacacaaagtacagatttgagcttgcctccaaaattttgacagctgaacgactatgtatgtcttgggatttcctaatctccatcagttttgctatttcatcgtggaaagaatctccccaatcaaagaaatgatcgtagaacactgtagggattccagggtgcgtgagtatataagcatatccctgaaagacaattagtttgtgcatgtgtttagtaaatgactaacagttatatctccgaagagaacagctcacttgttctaaagcaaatgatgcggaagcggctgttaatacacaattcacttctatactagttccagctgcagcagcatggtcagtggtcacatcttgaaacagactaacagtatatctagatcaagtcagatacaatatgggtgaaatctttgtctattcaaatacagtataaacatgtgatccttattgacgatacctgtcttgaaattcttaatgtgacgaacgactttttgatgcctacgatcattatttaactgcgacctcggccgcgnccacgctaatcgaattcccg

SEQ ID NO: 100980 - DNA, 497 bp, Triticum aestivum
  unsure (1)..(497): unsure at all n locations
  Clone ID: PAT_TA_100980
tnnngtggtcgcggccgaggtaccgaactgcatagcaaagtctcctggttccaatgcaaattcgaagaaatggctagcggctgaccagctgcaggcacaagatgttgatgtgactggtatgacgttgaggcgtcctattgaccgtggctaccttatcaatacagaggtgcagcgggaggtgtgggaacgggtcctgcgcagcctgctccaggtggatccgacaaactcatccttgttactggtggagccacagttcaaccctccaggactgcagcatgctaccgatgaacttgtgttcgaggagtttggcttcaactctctttgtgttgcagacgctccttcccttgtccacctttacgaggccagccgccagccgtcgctctttcatactcaatgcagtcttgttatggactgcggcttctccttcacccacgcgtcccctgtccttcagaactttacgctgaattatgctgtacctgcccgggcgnnngctcgaa

SEQ ID NO: 100981 - DNA, 347 bp, Triticum aestivum
  unsure (1)..(347): unsure at all n locations
  Clone ID: PAT_TA_100981
ctatagctatttccnnnncttttttttaagtaatgagcctatcctctatcttcttttttatgtttatatttcaatataccgaaacctatataagactagataaatattaagaggactcttccgcctacataaaaatatatcatggtcagcaaagttgtttctttatttttatttgccctctttaataatttcaatttcattaagaaaaactaactaaataaatggaaaatgaaaattaatagaattctttttttttttttcttcaaatccaaaaaatttctcttttttatacataggnnnntcgattcggcattggttaaaaaagacctgcccgggcggccgctcga

SEQ ID NO: 100982 - DNA, 411 bp, Triticum aestivum
  Clone ID: PAT_TA_100982
tagcgtggtcgcggccgaggtctgacgctcaagcagcccgggttccatggctccgcgatatcctacaagtccgccgagaggaagaagccgcaggacgccgggtaccacaactggagtttatccagcagaccgagcctgctatgacctggttgttttggctgttggctactgaatgtggttgctgaacttgtgcaggatttcattgatctgaatttatgaaatccttccggatgacttggagaagagtgaccaaaaaatgttgctttgagacagagcatcatgttttggcgaatgggcttgtcttccatcacgtgttatttacaaatgtagaaaaagttttttgtttttgtttagtccagtgtttctgtaaaattgctgtgaaaaatgtacctgcccgggcggccgctcgaa

SEQ ID NO: 100983 - DNA, 349 bp, Triticum aestivum
  unsure (1)..(349): unsure at all n locations
  Clone ID: PAT_TA_100983
caaaaacatcaaacatcatgttaatttcacatcgtcaattttcactacgctacaaccggggcaaacaccacttctctactgatgctaatcaataggccaacaattcagttctaccatcgaaaaaaaaaaccctacagcattctaaaattcatcccccgcccccgggaaactcaatcccaatctcgttgccggaagctcaacctgccgacggcgatgtcatccttgggggggaccgagctctcgaaatggctgaatgaggtacaagcttttttttttttttttttttttggggtatcaaaaactggttttaccccccatgaaaaatgacctgcccgggcggccnntcaaa

SEQ ID NO: 100984 - DNA, 473 bp, Triticum aestivum
  unsure (1)..(473): unsure at all n locations
  Clone ID: PAT_TA_100984
gcggccgcccgggcaggtactggttcaggggcnnncttgtgtcgctggatgtgctattaaagaggattttaatttggtttttcaatcagtgtgtctgggtaagatgaattggtaatattcagctagctggagacggaactaccgctgcaatcactactggagacggaactaccgctgtcacatgccgctttatcaagggtgttgacaaaagggccatcatcactagaggctggagtggcttcttccgtcaggcacacattaagaaaggtcaagcatatgctttcgccttcaaatgcactttcaaggggctgtgcctgatcgtctactcaatataaacaggctgctgtgtggtaagcctatctacatgcctggctcataacattgtaaatggtcatttgtaagcttattagagaacatgtatcatcagcaaccatttatctatcatcaaatcgacctcggccgcgaccacgcta

SEQ ID NO: 100985 - DNA, 353 bp, Triticum aestivum
  Clone ID: PAT_TA_100985
tagcgtggtcgcggccgaggtctcaacaacaaccactccacctccacgcactccacccttaccacgacaacccggattcagtgccattgaagcgctgttcctgaatttaccccttccaacccttcctccaccaaacaacaccaacacataccgccaagatgggtctcacattctcgaagttgttcgaccgcctctggggaaagaaggagatgagaattttgatggtcggtttggacgctgctggaaagaccaccattctctacaagctgaagttgggtgaaatcgtcaccactattcctaccatcggtttcaacgtcgagactgtcgagtacctgcccgggcggccgctcgaa

SEQ ID NO: 100986 - DNA, 396 bp, Triticum aestivum
  Clone ID: PAT_TA_100986
gcggccgcccgggcaggtacgattggcgctctcggtccaccatgtgattgccatttttgtgcagaaaacacccttgaaataaggctttgcccactttgttcgtatctcataaatgtgcgtcatatacaggtgttgtttcagattgtacattttcagcgacatagcccaggcattttcaaactcgaccactgtgagcatgtggttgacaacgtcgtggaactccgccctgaactcattcttcttcgtgtagagaggtcccaagcactctttagatatcttcaatatgtgccatttgcaccaccgatgcacagtctcaggatagatttaacttacagccacctccatagctctgttctgatctgtcaaaaccccatcacctcggccgcgaccacgcta

SEQ ID NO: 100987 - DNA, 502 bp, Triticum aestivum
  Clone ID: PAT_TA_100987
tagcgtggtcgcggccgaggtcttacaccgccccaaagggaaatagaggttcagagttacagtggaagccaccacccactgaaactgcaacgagttgactgggaaaaaccaccttcaatatataagagttccttcttacaccgccccaaagggaaatagaggttcagagttacagtggaagccaccacccactaaaactgcaacgagttgactgggaaaaaccaccttcaatatataagagttccttcttacacctacactataaaaaaaataaggagtatgaaaaagtcaccttggatcataattcaaggaatgtattactctttgctccgttctatttaaaatacatattgtaacaattaacatgttaatgtgtgtctggttatgtcttgccttgctacttgggtgccaccgatgtctgtttattgtcttccatgcaaataaaagaatccaaatacatcaggtctcttaatatttgtacctgcccgggcggccgctcgaa

SEQ ID NO: 100988 - DNA, 261 bp, Triticum aestivum
  unsure (1)..(261): unsure at all n locations
  Clone ID: PAT_TA_100988
tagcgtggtcgcggccgaggtaccaacgcactaatcgatttgtcagcagnatggaaaacagcatggncagncgtatgagtgaaccaatttggttgcacaaaaccttagttcatnncatagtggacccgctccaacattcnnatgacctgcaaaactgntntagacctgcctggtgcctttactgaagatccatcatcaaanacagtttgatgttgctcactggtgcatctctannaattgcaccagcatgtcaccatccan

SEQ ID NO: 100989 - DNA, 320 bp, Triticum aestivum
  Clone ID: PAT_TA_100989
gcggccgcccgggcaggtactaggtctgtgggtgcattgaataattattctacgtcggggaataaaggttctcatcctggtcacctgggatattatctctttctttttttgataacctggtggatactatcatcatccctagagaaaaacttagtcagcctctgacatcttatcccatgcatgcatgcatgcaactggttaagctcatatctccgtataatactctttaattgattgatattgctgtgcagctgggacaccacataataatgcggcagttgcatcttctaatggttagtacctcggccgcgaccacgcta

SEQ ID NO: 100990 - DNA, 514 bp, Triticum aestivum
  unsure (1)..(514): unsure at all n locations
  Clone ID: PAT_TA_100990
gaaaaaaaaggcgggggggccctttcccctttttttggggccccatttaaatttttccaccctcccccccccccccctccaaatttaccttttccccccccccttccttttttacccctcccccccccccccctggccgggggggcccaattaaattcccccgggccccctggggggccggaaccttccaccttgggccccatttccccttttaggggnggttttacaattcccggggccccgttttacaaccggggaaccgggaaaacccccgggttacccccctttattccctttgcccaaatcccccttttcccaattggggaaaaaaccaaaaaggcccccccttttcccctttccaaantnttgccccccttaatggggaatgggccccccccttnnagggcccttaaanncgggggggggggggggttcccccnnggggaccctnnncctttnnnnnnncnnaaccccccnnncntttcctttttttccctnnntttnncnnnnnnnn

SEQ ID NO: 100991 - DNA, 595 bp, Triticum aestivum
  unsure (1)..(595): unsure at all n locations
  Clone ID: PAT_TA_100991
agcggccgcccgggcaggtacaacaaatcnntcagtgacgatctcgttgaagaagtggaggccgaagtcaggggagcgggggcaatagcagaggcaactcataccgcatatggacctgccggaagctaaatgagtcggatcaccaacgcaccgtcttgtttcccttcctccatcatctgctcagctcatggcctcctctactgccttcttgcttctcagcagtgcattgggtgacactcagcccgtgccatcgatgaatcgatggaggtggatgtccatggtggggtcgtcaccgaatttgacgttgctggagatgttctcgtcgagctcggtgaagagagccttgtcaccgttcatgtagttcgaggcacccgtgtggagaatagtggagatgctagnccttgtagaaagctttggataagaagataggaaaagaagcagccctatttgtataatggggcaacaaatattttcccagctaaagtgctaccgtttgtggagcgagtcctgattcaagatgagaaagtagaaatacagtagaatgacaacaccactcagtaatagttgaatttgtacctcggccgcgnccacgcta

SEQ ID NO: 100992 - DNA, 277 bp, Triticum aestivum
  Clone ID: PAT_TA_100992
tagcgtggtcgcggccgaggtaccagcccaaggttgcggacgagcctccaatcatgccgtacgcgcagaaggatattcctgcctagagaggcaaagaggtggaaaggaactgaggtccgagatcttggtccgagtctgacggtgtcctcgcgagtccgcctgaccattggagagtcaagatcctcatgaagttagttgattaacgtccgaaacgatttgatgtgtctctgtctcttcaaaagcaacttctttgtacctgcccgggcggccgctcgaa

SEQ ID NO: 100993 - DNA, 410 bp, Triticum aestivum
  unsure (1)..(410): unsure at all n locations
  Clone ID: PAT_TA_100993
gcggccgcccgggcaggtaccaatacaactgaggggatacatcaatattagnaagtgcctgattacatttagtatacgcggcaatgaaaagatgcgtataacatagatgcttactatagtctaaggcccgtgcatgtcttaatcttcagagcaagaacaaaagggttaagaaatcactaaaactaaatctggactacgctgcagatgaaacaatggtatttgctttagtggtcacataggcatggcagttaggttagatgcagcaaaggtaattagaatttngnaacagtctttcattctttctaggcgttgttctacttaccataaacaaaaagggttggaaatatagattgattacataggcaagcagtgagctggcgctgacgggtacctcggccgcgaccacgcta

SEQ ID NO: 100994 - DNA, 431 bp, Triticum aestivum
  Clone ID: PAT_TA_100994
gcggccgcccgggcaggtaccagaaactacatcctcctcttcttcgtttgtcccctcctgtgggctaaaatagacaccaattgcttcaataaattctctaccattggcaaagaagccaacgatgacagcatctctctgacgtggactttggaagcgagtcccccctccttgtccatatggtccatagctactggcattggtgacaaataaaagtgacgatacaacatctgaatggtcaggactcggaccaactgttccagaaatttccatcagaaattctgaatccccgagaagaatctgatgagaactaccgtcatgagactcaaccgtccgtccccatggcccggcaatgtgcacttgtccattgcaatcactatatgtgaacgaaagcgaattgactacctcgccacacctcggccgcgaccacgcta

SEQ ID NO: 100995 - DNA, 324 bp, Triticum aestivum
  Clone ID: PAT_TA_100995
tcgagcggccgcccgggcaggtacacatatactgcaccaactaatgtccgctcccatgggctgtaaatctagatgctactaataaacaagttttagtcgaagacttccaaattctgaatatgttttaatcaaagaggatcaaaatataaacacaccatttgagctaccagtgccaacttagtaaatagaataatctatcttcaaactttttggatactgcttgctcatggaaaagttgttggcatcatcttcaggtcccattcattgtagatgatccgacacttgaagcaatgcttgccattgacctcggccgcgaccacgcta

SEQ ID NO: 100996 - DNA, 483 bp, Triticum aestivum
  unsure (1)..(483): unsure at all n locations
  Clone ID: PAT_TA_100996
tagcgtggtcgcggccgaggtacccatgcagattcgggccgcagatgcagaatagatcactgattgatttcgctgtagcgtgtcctccaaatccctctctcagatatacccattggctcccgtgtgggcagggtcgccttcgtcccttgaccaaagacatgactgatgtctttccattcttctctcgaatctcaaaaaatcctcccatcaaaacatcgttccagcacccacctctaagccttcacttgctccttgacctgctccaccacaggcctgagctgacccttcgcctgatcaaccttctccgccgcgatcttcgccaacttctccaattgctcctttcggatcttgcgcacatatctgaatagcagcacgaaaagtagctccacacgttccttggtcatcatcaggattccctggacgaggaaacccttgagcaattgcggtgcaatgcccttgtacctgcccgggcgnnngctcgaa

SEQ ID NO: 100997 - DNA, 342 bp, Triticum aestivum
  Clone ID: PAT_TA_100997
gcggccgcccgggcaggtacagtttatggctacaacttgaaggtccttatttgggtctcgtccaaaaaaatggagctggaaattttccatgcgagcctaatttttagaatcatgtttttagtttattctgactagaaatgtccagtgtgtgttccatgatggtaactccaaatatgatatttttggtcctgtaggtattttccatgtaaaaatttttgtacaagctttttttttttttttttttttttttttgctgagagatgcaatgcactaattttcatagcacgatataaatattacaagcatgcacgcagcacgcgtacctcgggcgcgaccacgcta

SEQ ID NO: 100998 - DNA, 307 bp, Triticum aestivum
  Clone ID: PAT_TA_100998
tagcgtggtcgcggccgaggtacatgcattggactcatgttaactctagttctgcatcctgaatgaacgaatgcttaacttgcatgtttgaaacggccaattgctgattgctgatagctcctgatcctgccgttagatatgtatggtttgctgtctgaattgcaatgatcgtatttctgcaatttgaactgtatttgctgagttcctgagcatggactcaagtcacatacccagcatgaagggatatttctgctccatttatgtctttttctactagatgttcatgttgagtgccaaaaaaaaaaaa

SEQ ID NO: 100999 - DNA, 301 bp, Triticum aestivum
  Clone ID: PAT_TA_100999
gcggccgcccgggcaggtttttttatcagataccaaaaacatgtcattacagtcaagcaatttggttcctctacatacacattcatcagaagaagaagaaaaaacaggcctcagtggtaattcgacatgccgaatgacagtatgcatttgatgggtacagagcactccacaaaattgcatgaagtctagcgagcaccagcagcctcttgcgatttccccgggcggaatctccgcatccatttcctctggttggcggtgagctcgtcagggtgcacggagcacctcggccgcgaccacgcta

SEQ ID NO: 101000 - DNA, 394 bp, Triticum aestivum
  Clone ID: PAT_TA_101000
gcggccgcccgggcaggtacagcagcaagacaagatgattttcagaggggagaaaatatcccatgaggattagggtgcggcgagaagttctattacaagcatgcgaaggatgaccatctccaaccgcggcccctccctcaaaacagagtgctatatacaaaacggatccgtccatgtccatcggctcccagatgcccaatctgtgctatccttattccattcatcttttctatttttgcacccgaggagctgcttatactctagccttgatgtgaggtgtagagattatgtttacagcatggctccacttcttcttttagatgccccgtgctctgtgctggtgcacaaaccacaaactgaagcagatccatgtacctcggccgcgaccacgcta

SEQ ID NO: 101001 - DNA, 471 bp, Triticum aestivum
  Clone ID: PAT_TA_101001
tcgagcggccgcccgggcaggtacattgctttttgggaagaaacaatctatagcataacctgcgtaaatcattaaaggaaaaaaggtattcatcatccataggctagtcagctttgacacgagctcttctctggtgagcaactatgaggatcagcgatactaacatgccaatcacatgcccagcaattgcaccataagtgacacatattggccattcctgccaagatctctcccagtcaaggggcataggccaagcaccaagccacgctcctattacagctccatgagaaggcgcagagatcatgtagtccacaacattggatgatgtgcaataaatagtatgagaaagcgcgttctgccaatccactttggatgctccaaagacacatgctgctggaacaaatgtgaacagcgacataagacttgaccaatagattgtcgctatccagtacctcggccgcgaccacgcta

SEQ ID NO: 101002 - DNA, 509 bp, Triticum aestivum
  unsure (1)..(509): unsure at all n locations
  Clone ID: PAT_TA_101002
tagcgtggtcgcggccgaggtacaacgactgccccagaatattcctccacatcacgtttgtgatgaacttccctgtccttcctacgggtgctttctccatcaagttatcgttaggtggttcggtggcaagtgctagtgcacctagggtgtccatgatcatgttcacccaaagaagttgaacggctgtcagcggcgcatctcctgtaaagcaagcggaggagaagttgactagtaatgcaacaatattaacagtcaactggaactgcacaaacttttggatgttgacgtaaacagagcgtccccatttcgcaacagtaacaatcgtggagaagttgtcatccagaatcacgacatcagcgctctctttcgccacctcagtccctgcaatgcccatggcaagtccaatatctgcctcacgcagcgcagntgcatcattagtgccatcaccagtcacagcgacaacttcattggaagttgtgcgcaagtacctgcccgggcgnnngctcgaa

SEQ ID NO: 101003 - DNA, 436 bp, Triticum aestivum
  Clone ID: PAT_TA_101003
tagcgtggtcgcggccgaggtacggcaacactattgaaacttaatttgggacagatagtccacgaatatctccactgacttgataaagcactagtcttcaaaacctcttttacaggcaatttcgataaaattgtgcgaagcacatcctcaggaaggtcttcaaatttaacatttttccttcctttctggttggatggtttgacattgtaatggtccaaagttgtttctgtgctcattagatagttcgtcattttatttttgacctggagagggtcttctgttataacatttgaccttcccttctggtggatttgtttgctatagcaatgatccaatgttgttctttcactcattacatggtttcccattttgaagctgacattggcaaggtaaagttatgggtctgtctagggtacctgcccgggcggccgctcga

SEQ ID NO: 101004 - DNA, 361 bp, Triticum aestivum
  Clone ID: PAT_TA_101004
gcggccgcccggcaagtacttcttaagattaaacaagtagtcatacagagtggtctccttccactccacaaccttgttcttgtttgccgcaaaaactgaacgtctgctaaaatcaacatcatcttcacatgaactcccatccgatattttcttggagaaactaaaattttcttccatcggattcgcatcaatgctgccattggtgaaagctgaaaaaaccacaacattggtctcttcctggctcattggggagtaagaatttcatcgggaaggggcatggacaagtcccaacctggcttttatactactacttctaaaagtaagtttcccaccaaaatgtacctcgggcgcgaccacgcta

SEQ ID NO: 101005 - DNA, 373 bp, Triticum aestivum
  Clone ID: PAT_TA_101005
gcggccgcccgggcaggtaccttttttagaatatgtgaacaaatctggacaacaagaacatttttgaaataccaaatattttataatttgcgaacaaaaattaaacatgcgaacacattttgaatttgtgaacaaattttcaaaaatgaacattttttgaatatgtgaaatttttttcaaaacgaaaatatgttttgaatttgcgaacaaatttgcaaaatgggaataagtttttacatttccagaacatttttgaaattttgaacaaaatttggaaacaggaacatatttatgaaattgccaaacattttttaatttgcgaacaattttttaaagcgggaacatgttttgtacctcggccgcgaccacgcta

SEQ ID NO: 101006 - DNA, 253 bp, Triticum aestivum
  Clone ID: PAT_TA_101006
tcgagcggccgcccgggcaggtacttcctgggatgtcttcctgcctactaggaagcgagaagcgctttgcggagctccaatctccctgatgcatatagatgttcttcttgcgcagcactttgggtgttttgttatgcttggtttagtttatagcctatttttgtagctcagatgtatcttttggtcaacttgctctgctttgtcaagttgacactgccaactctagagaagtacctcggccgcgaccacgcta

SEQ ID NO: 101007 - DNA, 230 bp, Triticum aestivum
  unsure (1)..(230): unsure at all n locations
  Clone ID: PAT_TA_101007
tanngtggtcgcggccgaggtaccggcacgcgagcaattgatcgtcgatggagatnnncncgataatataatgccgatgggaatccgagctcaaaagtccaacaccgtcaaagtgatattcatcagtggccccaaagcactgggagcaaacttcctaccaaatagntngcacacagaagtgtgcttcgagttgtnnnggcactgcgtacctgcccgggcgnnnnctcgaa

SEQ ID NO: 101008 - DNA, 467 bp, Triticum aestivum
  unsure (1)..(467): unsure at all n locations
  Clone ID: PAT_TA_101008
tagcgtggtcgcggccgaggtacctgtccgctcttgctgtttttggtcagggtggaggccttcacagttacgcgtttcatgaaatccctcctttgagcatacaatacgacgagaaatgattgaattatcacgtctggagcgggtatacctgctaatccgaattcgaaaacctgcatgtcttgcatacaagctgtaaaattcccttgcagcatcttcagactcaaattccataccttcgcgaggtgttaattctgtatcatcttcatgtccaattatattttctacttctgatggttcatttgatgaaatctccatagcagtaaaggctctgtgaagtccggttaaagcatgattttggtcattgtctcgctttgactcaaattcttctgattaatgcaccttccataaccagtattggccgtcacaaatctatgtcgattttctacctgcccgggcgnnngctcgaa

SEQ ID NO: 101009 - DNA, 379 bp, Triticum aestivum
  Clone ID: PAT_TA_101009
tagcgtggtcgcggccgaggtaccctttgcatttctatgaggattggcttttaattctagcaactcagcaacaagcatgacagtctctaatagctcatcaacattctctcccttaagagcacttatctgaaccatcggggtgtcaccaccccacatctctggcataagtcctatctgggaaagctcttgcatgactcgttctggattagctccctccttgtccaccttatttatagctattacaacagggactctggctgcctttgcatgcgcaattgcctcatttgtttgtggctgaacgccatcatccgcagacacaacaatgatacagatatcagttacctttgctcctcgagcacctgcccgggcggccgctcga

SEQ ID NO: 101010 - DNA, 405 bp, Triticum aestivum
  unsure (1)..(405): unsure at all n locations
  Clone ID: PAT_TA_101010
ggggagcatagtgtatttataacgccagcgcaccgcgtgtgtcacaacgaaaatgacatagaccggtatattgagctgagaacaactgaaataaagggctataagggtgaccttgaaaaccaagcacttgtgaagttgacaagcttaacggatcatgcactattccttgggtataataacaccatgtgttttgccactaaagatttcccaacattgaagccgaactgtgtctatatcacggatgactcttttgagtatgtcaacatgtgtaagcataactggcgaaaaactggagtttggaatataaaaaacannnntctgcagacttttgatggggatttgcttactaattcctggatgaactggccttctccgngttggataacaccctcccttttctnntac

SEQ ID NO: 101011 - DNA, 305 bp, Triticum aestivum
  unsure (1)..(305): unsure at all n locations
  Clone ID: PAT_TA_101011
tagcgtggtcgcggccgaggtactctttcgagcaattcaatattttgataactatngatctggtgattttccaacacataaatgtgatctgcagaaccaatttttacagcaaagatattcgcaccttatactcttattcaagaacgtgtggatctgcaggttaatcagcagaactcaaagaatgcctctttgagagacaaaattctggcacaaacttctcccattcccggtcgatctttanncgattccatggaacacaggaggccaacttcaaccagnnntacctgcccgggcggccgctcgaa

SEQ ID NO: 101012 - DNA, 325 bp, Triticum aestivum
  Clone ID: PAT_TA_101012
tagcgtggtcgcggccgaggtactggcagttcatgagcccacagacattgagacgctttgcaagctttgtggtccatgaccgaataatatctaagcacttggttgagaccgttctagtgggaagggaacatgcagaatcaccagaatgtataccagcctgctcaatatgctccataattccaccgatcacaacattcccaactgagtctgctaatgcatcaatatcaatttcaattgcatcattcagatatttatccaccaggacgggtcgttctggatctacttgcactgcagtcgcaaggtacctgcccgggcggccgctcga

SEQ ID NO: 101013 - DNA, 498 bp, Triticum aestivum
  Clone ID: PAT_TA_101013
gcggccgcccgggcaggtaccgagcttcattgtaagaatgtttctttagatgtgctaggacatccacagtttatgtgatggtaactatagaatgcttcaaatgcaaaacatttgcagcaagaccaaatatgcagagccaaataagtggttaaatgggtcaagttcatgctaataaattagaactgaatgatgcattaccaaataagtcaaaacaatttataatatggaatatgaagtgcagtgacttaatgtttgatgtcttgagtttcattaagataggaagtttcatacctttttatcctttgggtcaggaatctctcttggaatagaatcatatcccggcgaaacagattcgcagctaagcccccgagtgggaggtctgctctccactcggtaagatttttacaaacttaggtgaaatggattcgcagctaagctacccactgggggacttctcatgtaaaaaaaagcttgtacacctcggccgcgaccacgcta

SEQ ID NO: 101014 - DNA, 377 bp, Triticum aestivum
  unsure (1)..(377): unsure at all n locations
  Clone ID: PAT_TA_101014
tagcgtggtcgcggccgaggtacatctcctccgctgcttcagtgcttgatctcacatcatgatgaacttgtctctgtttctcataatgacagatactttaagaggcatagcttgccaggctcaagcaaaaatgtttgcgcattagagcagatagacccagtagactttttagtttgttattacaactatgaaggttaacagcaccaagttgtcactacgatgcttcaaggttgctacttccaaatatggtcaagttccccactatactccttctttctaccaaattatgagaaaaatatataagcattagaatcactaactggctatgacaacaaagaagtgtctatggatagtacctgcccgggcgnnngctcgaa

SEQ ID NO: 101015 - DNA, 431 bp, Triticum aestivum
  Clone ID: PAT_TA_101015
gcggccgcccgggcaggtacagctgatcctcctcaacgccatgaataccagaagcaattagaatgtccagcaagtagcagaactctctttcctcttcgtcttcaaattcgcaaggggtgtcttctaccagctgtatagtttcatcatgttcagtagactccatctcagagcacgagtaattaccaagtgcagcatccacaactacctcagcaacagtttctgctgaaggaaagtatacgagctcaggccttggctggggagcatgaggatcttttgtatctttcttaatgttttcagtatcggaaaaatcttcagctggatattcaagaacggatactgggcttgcctgctcaatctctttgcaggaagcttgggggatatagtttatacgtgcagcaagtggacagtgtacctcggccgcgaccacgcta

SEQ ID NO: 101016 - DNA, 272 bp, Triticum aestivum
  Clone ID: PAT_TA_101016
gcggccgcccgggcaggtgtacatacaggtacgcaaacatacagcacccacccacacgacacagatcacacgacacctccatcaatcccacgggaacgcaacacacaacccacagacacacaccacggaacagcccgtataaactcactcacagcgacgccgcgcctccgagcacggcggcgcgccacaaaacagctacagatttctggcaactccgttacaacattaccactacatgttttttcttttttacctcggccgcgaccacgcta

SEQ ID NO: 101017 - DNA, 237 bp, Triticum aestivum
  Clone ID: PAT_TA_101017
ccaattttccaatccaatttagcaacaaaatacgagcaaattccgttatacgcttaccaggggggcagaaaattaagaagaaacatgaataaccaatatcacgttaaatactgttcaaaacagccacaacatcaaccagtttcaacatagtaacagaaaagcagccgatgggatgtcttaatttcgttttaacagttcctgcttctttgggatggtacctcggccgcgaccacgcta

SEQ ID NO: 101018 - DNA, 268 bp, Triticum aestivum
  unsure (1)..(268): unsure at all n locations
  Clone ID: PAT_TA_101018
gcggccgcccgggcaggtacttctcattttttttagataaagtaaaaatgnnnacataaccacgagtaatgtatttagcttaggattgggtgccaaggtttttttagcacctacccacacatcacctagcattggtgctaggtaatttcacctacctgcagtgtttggttagcatctagcaatgtagatactgtaagccataacctggtgttgtcctaaacaaaatgtatactttctcacaaaaagtacctcggccgcgaccacgcta

SEQ ID NO: 101019 - DNA, 391 bp, Triticum aestivum
  unsure (1)..(391): unsure at all n locations
  Clone ID: PAT_TA_101019
ttnnagcggccgcccgggcaggtactatgacattgtcccctggattttccgagaaacctcgaattatcttcggcagcacctgtcctcaccctgcagtcaatgtcacacgtgtaaataattgtagttctccaaaaatatttaaaactgttacacactatgacattgtcccctggattttccgagaaacctcgaattatcttcggcggcacctgtcctcaccctgcgtgtccacgccggagattttgggtcaagctgttcaatcgactgctcggacacttgcagctcccttctcctcccgccgccatttgggaataactccgggatgacttcacacttcacataagatacaatcttgcatgagaagtagagtacctcggccgcgaccacgcta

SEQ ID NO: 101020 - DNA, 317 bp, Triticum aestivum
  unsure (1)..(317): unsure at all n locations
  Clone ID: PAT_TA_101020
ccaaaaataaacnaaagaacaatggcccctttgttttataaaaaaaatatcacacgggggttttatttttgaacccggccttgccccaaaaccttttttcgtncaaacccaaattttttggaacaaaaaatttcctttggtcgaaaaccaaattcggggacaaaaggaaatttaaaaaataacctttatacataggccattgtttaaacttgaatttaaggccttgccgaactccncaaaacctgggggcctaaaggcaaaaaaactaaccccctgcacctggcccaggttgtcaaaccnnntaacccggacatagg

SEQ ID NO: 101021 - DNA, 222 bp, Triticum aestivum
  Clone ID: PAT_TA_101021
tagcgtggtcgcggccgaggtcaaagcattggctggttgaggttttggttgcccatgatttggcaacattggtaagaaaaatgaactagagttggctagagttcatttggcatgccaaaaatttggcaaccatccaaacgaagaccaatctttgggtccaaaattttgataaggtgcactttggccacaatccaaacacacccttactccaaaaaaaaaaaa

SEQ ID NO: 101022 - DNA, 161 bp, Triticum aestivum
  unsure (1)..(161): unsure at all n locations
  Clone ID: PAT_TA_101022
tagngtggtcgcggccgaggtacnncggaaaaggtctttattcgcgtttatgatctcaccttcaacattctcgaattccctttgcacgtacacggcgatgtctcgtcggatcctccggagtggctcgnnnnnncggacgaggatggaaagggattcgacca

SEQ ID NO: 101023 - DNA, 167 bp, Triticum aestivum
  unsure (1)..(167): unsure at all n locations
  Clone ID: PAT_TA_101023
tnncagcggccgcccgggcaggtgaaaacagagcatcggggctccgtgtcggttaaatttggccattaacagatnatttggtaaactggcaccgctaatgccagcttactatagggagttgaaatgatgatgtatggaagacaagtacctcggccgcgaccacgcta

SEQ ID NO: 101024 - DNA, 615 bp, Triticum aestivum
  unsure (1)..(615): unsure at all n locations
  Clone ID: PAT_TA_101024
tnncgtggtcgcggccgaggtactcaagacattgcgcgaggccgatgaacacaaccgcaaccgctgcatccagttgcgcgactgctttgattggcgaggccacatctgcatcgtcacacctcttctcggcctctcggtcttcgactttctgaagggtggcggctttgtcccattcccaggttcacatattcaagcattcgcccgacaactgcttggatccattgcgttcctgcacgacctcaacctcatccacactgacctcaaaccggaaaacatcctcctcatcaaccacacatatcagaccttcacatacaaccgcaacatcccatcttcaagcactttgacgacacgatcagcgaagttcaggagggtgctccttagcccacagataaatctgatcgatttcggaagcgcaactttcgacgacgaataccatagctccgtggtcagcactcgacactaccgcgcgccggaaatcattctgggaattggatggtcacatccaattgacttgtggtcacttggctgtattctcgttgagtgctggacaggggacgcactcttccagnnncacgactgctgcgagcatctaggcatgatggaggcngttactnn

SEQ ID NO: 101025 - DNA, 306 bp, Triticum aestivum
  Clone ID: PAT_TA_101025
tagcgtggtcgcggccgaggttttaaagcaaagcaaagagacaggttgaagaatgaataattgatatagcacaaccttctagatgcatttcttgttatcccggactcccggttataacagaagtgcttttgcaggcttacaaggaatgtatattgaaggccatgaaagagtcatcgaatgtgttccatcataaatttttggaactctggaacaaacagaaagatgtcaatggggaggcatacctgcctgcgatatacatcaacctaaagcttttgagcgttgtacctgcccgggcggccgctcgaa

SEQ ID NO: 101026 - DNA, 226 bp, Triticum aestivum
  unsure (1)..(226): unsure at all n locations
  Clone ID: PAT_TA_101026
ttnnagcggccgcccgggcaggtctgcgaggcaccctaccaaaccagcaagtaactaactcaagtagctactattgctcaaaaaaaaaaaaaaaaactcaagtagctactacgaactactactgtcaaaaacgctcttattcttagcagagatcgatcgatgtatatcatgtgaataagcaaaaacatgctgctacgctgtctgtacctcggccgcgaccacgcta

SEQ ID NO: 101027 - DNA, 252 bp, Triticum aestivum
  Clone ID: PAT_TA_101027
tagcgtggtcgcggccgaggtaccgccacttctcatgggaattggaccatggaaggcaatcccagtggctttggagaaggctggcatcaccaaggacgatgtcgacgttttcgaggtcaacgaggctttcgcttcgcaatgtctgtggtgcgccaacgagcttggtctggacatgagcaaggtcaacccgcttggtggtgcgatcgcctttggccacccactgggctgaacctgcccgggcggccgctcgaa

SEQ ID NO: 101028 - DNA, 280 bp, Triticum aestivum
  unsure (1)..(280): unsure at all n locations
  Clone ID: PAT_TA_101028
taacgtggtcgcggccgaggtacttaatcctccccgataagaggaagcagatttctgatttgcgcactccatggactgatcttacatgctcggcttcgagctgagacggctcgcgagcttctggccgagagacttggcagcctgagaccnnnacgagagccacatggccttgatctnntnggtgaggcgggggtcggacagctcatcgatccatctgttgatgaatctctcttgccttgccgggtccatggagcgggacctgcccgggcggccgctcgaa

SEQ ID NO: 101029 - DNA, 601 bp, Triticum aestivum
  unsure (1)..(601): unsure at all n locations
  Clone ID: PAT_TA_101029
tanngtggtcgcggccgaggtacgccctcatcattgcccggcaacatgctaaatcaacagccacaccaatctcctgcatctggctgcagatcctctgtgtttcatcaatctggtctgccttcagaaaggcaaaaatgaggtggctaaaatgagggcatgaaggggttatgccgctgctcaacatcatctggatggctttctcagctttggagcagcatctactttctgagtatgatctgatcaatgcaaggtatgtcgtcgagtcgggaacttgactgtgtgattgcatctcctggaaaacaatctctgcttcatcatgcagcctggaagtggcataggcattgatcatggagttgaaactgatctttccaggcatgataccaacttccttcattctatcgaatagtgaagacgcctcctgatgcctcccagcctttccatagaagttaagcatgttggtgtatatcttctcgtcgatcagtaagcctagctcttgtgcagcagcaaacatttcagcagccttgtccagctttcctcctnnnnnataaacacttatcattatattgaaagtctgcaagnnntgcccgggcgnnngctcgaa

SEQ ID NO: 101030 - DNA, 289 bp, Triticum aestivum
  unsure (1)..(289): unsure at all n locations
  Clone ID: PAT_TA_101030
tagcgtggtcgcggccgaggtcggccgaggtccgcttaccactgagtctgcaatgaagaagatcgaggacaacaacacactcgtcttcatcgtcgacctgaaggccgacaagaagaagattaaggccgctgtcaagaaaatgtttttgtacaagcttttttttttttttttttttttttttgcaggaaaaaatccaggcaaatacagggaactagggagtgacaattacagtaagggactgatcgagagatctatcctgtcaaacacgactctgatgaacaannnnnnn

SEQ ID NO: 101031 - DNA, 454 bp, Triticum aestivum
  unsure (1)..(454): unsure at all n locations
  Clone ID: PAT_TA_101031
tnncgtggtcgcggccgaggtacctggtgtgcagggtgtcctgaagaggacgcatgtcgtcaatacctctatgaatctcatgtgaatgatgacgagatccttctgctcgaccttgcaccaggagatgcaaaagcagccatgcacgccattagccacacctgcaaattgggcaatcaacttcgaatcgatgggatcttggtctggtagatgcataatactctgtgtggtagagcttgctgccatggagaaacaagtaaagctgaagaggggagtaaagcttaatatgcccatttaaagtaaatcgagaagaaaatggatcaagatctgttgttcatagagcttgctgcatgtcagaagaggtggaaactagcatccctcgcagaggtcctgatctgatctgttcttcatgtatcactaaaatagaaactagtacctgcccgggcggccgctcgaa

SEQ ID NO: 101032 - DNA, 331 bp, Triticum aestivum
  Clone ID: PAT_TA_101032
tcgagcggccgcccgggcaggtacaattcctgaatcatctgctgtttcaatttcaagtgcttgcaaggccgaaattttcctctgtgatggcatcaagtggcttgtcccaggagaaggacaacaaaagagagatcgtctgcattaatctcctgtcatgttttggaaatcccagaaggaagacaaaagggagataatcttcatcgcctacagatcagcttgccttggtttcactctgaacatgggggatgatcagaagagagataaggcaaaagggagttgatctcgccacctacagaccacagatgaacgtacctcggccgcgaccacgcta

SEQ ID NO: 101033 - DNA, 349 bp, Triticum aestivum
  unsure (1)..(349): unsure at all n locations
  Clone ID: PAT_TA_101033
tnnagcggccgcccgggcaggtacccaagagtgtaaaatacagtaataaaagagcatttggtatacttttaatggaggaattccttaactgggtgattatgggaggataacaaattgcaaaatatcatatatgaatcatgttttaaatatacaatagtgcagatagcaatcagaagcttcagagtatcttaccattccataatccattatgatcatcaacacataatcagaaggggtcgcaccataatttagatgtgcaaaattgtttccatgaaacttactaaaatttaatgtatctaagaaagtaaaccatagatggtattcaggtacctcggccgcgaccacgcta

SEQ ID NO: 101034 - DNA, 239 bp, Triticum aestivum
  unsure (1)..(239): unsure at all n locations
  Clone ID: PAT_TA_101034
gcggccgcccgggcaggtacagtgacaagacctcgcccaaataatctcgttgtgggcctgacaatccacacggcatggaatcttcaaacacggtcaggcgaccaggacgtnnnaggcggcggtggcggagtcgtcgacgtcgtcgttagcgccattactggggcagttgaggaatgcgacgaggagcaagacgcagaagaaggtgaggcagttccgcaacctcggccgcgaccacgcta

SEQ ID NO: 101035 - DNA, 334 bp, Triticum aestivum
  Clone ID: PAT_TA_101035
gcggccgcccgggcaggttgcatatatggccgagaagcaactccagcgtggtccgtggagcagtttcgaatggcaaatgaagaccgccgcgccgcggcatccttcgtcatgccgctcctgaggctgagcatcagtagtagtagtagaatagtccgggtaggaggaagagacaaatgatttcttttggttttcgatccgcgctctgtttttgtttttgtttttttttctttaactgatccgtggtctgttattgagcgttggtcttgttgtctcaaattcagttcttatttatttcgatataaaataagttttttatgaacttaaaaaaaaaaaa

SEQ ID NO: 101036 - DNA, 411 bp, Triticum aestivum
  unsure (1)..(411): unsure at all n locations
  Clone ID: PAT_TA_101036
taacgtggtcgcggccgaggtagcacctctgttaatttttggtgtgattaaatcacaagtgtaatttgaaaaacaacataaacatgccacaatcatagtcacgggtgagatttcaaacattgaatgaatggattggcattgcacatcattgaagaatgcattagtttggggaccnnactcacgtggcctagctggtctttgtggcagatttctgtttcttagaattaaaaaacacatacacagcagaaaggagagaaaatacagcctccgaataatgattaatcaagagggcaaattatggtttaattgaattaatccagaagtgcatttggtaccgccaatatttggtccagtatttgttcatggatcgaggctataattcatttgtacctgcccgggcgnncgctcgaa

SEQ ID NO: 101037 - DNA, 502 bp, Triticum aestivum
  unsure (1)..(502): unsure at all n locations
  Clone ID: PAT_TA_101037
agcggccgcccgggcaggtacttgattccttgccttcctaggaagcaggaagcacttgtctggccttccaatgggtgcagctccgcatagatgacgagcccgtcaccatagcatcttcaacatcgagcnnnnnnnnaaatgataatagatgcagcaaaaacgcgacccccccctcgtcacgtgtcgcggtgtcatcatgaatgggtccagcaaaaatcattggcgggtgtagctttttgtcttgctggtccccgcacgccgtcaccgatgcaagcacgtcgctcctccggtcccaacaaaacatgccactgggtccagcaaatatcattggcgggtgaagttattcgtcttcccggtcccaacacaccgtcgccgcccctgcgtcaccgtcgtagcacatcgccctgtcgatcccaacaaaacatgtcaccgnntccaacaaaaatctttgcctgtcgcagnctttccatctcgccatgctacctcgggcgcgaccacgcta

SEQ ID NO: 101038 - DNA, 492 bp, Triticum aestivum
  unsure (1)..(492): unsure at all n locations
  Clone ID: PAT_TA_101038
ttnnagcggccgcccgggcaggtacatgtcagnttgcagaccaagtagggaactatccatccttggctgcatccaaggactcataccaagtccaccaaaattgaatgactggaaacctgggtttgctccatctcgaagccacatgagagaagaggtcaagtcatcctcctttccaccatataaggagggcaatcctgttggccaaggccgcttcagtcgcatagggaaaggagatgaatacattgggtaagtcgtcagaggctcaatctcccagagagacacccttggttgcctctctccagcagttgactcatcccatccaaccttaacagaacgccagtgtgagttcggccaacgagcaggatcaagggcacttattcctgtaattgttcccatgtatcgcctgacactggattcttctgtctcgaaaagcatccggaaacgcatgcccacagnnnatacgggtatgnnncctcggccgcgaccacgcta

SEQ ID NO: 101039 - DNA, 378 bp, Triticum aestivum
  Clone ID: PAT_TA_101039
ttcccgcccgggcaggtattaacatcgctagcatacatatggcattctcggctgatatagttttcttaataggtattggtattaatctggttaagccccactttattcctctgagaaaatgcctacagttctgcatttagaaaacttgctcgcttagtcacactcacctataccaaaaaaggctttcgccccgctttataaatgtgcaaaattattttactattttgtttagaacaaaatggctatattagacacttatagggaatatttctttatttcttagttgtacaaacattgccgtccccaacttgctaagtcggcatgattaatggttttccatatgttatgtttacttgtacctcggccgcgaccacgcta

SEQ ID NO: 101040 - DNA, 239 bp, Triticum aestivum
  unsure (1)..(239): unsure at all n locations
  Clone ID: PAT_TA_101040
gggccaaaaaccccgggtttttttcccggggggggcngnccccccaatttaaaacccccattaaattccccttccacttccccttggttgtttggaaaccccccccttaacctaaaatgatccccggggggccggggtcccccgaatcaccccccccgggcccttaatgggaccctccccggcgggccctccaaaataaattcccccggcccccctggggggccggaaccttccaactc

SEQ ID NO: 101041 - DNA, 418 bp, Triticum aestivum
  unsure (1)..(418): unsure at all n locations
  Clone ID: PAT_TA_101041
ttnnagcggccgcccgggcaggtacgcatacaccagagagaaaaatgtctccaatcccatgtctcagccattcaaaaccgaagggcaaaggtttccaaatcttgactcatgagaaacccacagcggctataaatatacatgggtccatcttcctcttgcatgcaccatttccaaaacttgttgctgcatccccataccacaaatggctcttccacttcattgtcatctcacatctatgttttttcagctgcctttcctctccatggtgtttgtagacacaaacttcaccgtgtcagaagcggcatattaccccaattctgttgatggctggatgcagactgtgaaccnnacatgccaactggccccctgtccataagnatgctgtttagcagcagagacctcggccgcgaccacgcta

SEQ ID NO: 101042 - DNA, 255 bp, Triticum aestivum
  Clone ID: PAT_TA_101042
gcggccgcccggcaggtccgccgccggctccatcgccgggataatgtccgacctaaaggtctacaagccgttctccacgactgactgatcgatgcgtggctggccgtcgcatgaatgcacagatcctcgatggacagaatatgcctacaagctctaatcaattaatcaaccaattatcacacttcactaaaaattacatgttcaagtaattgttgcttctaaaacagccggtgtacctcggccgcgaccacgcta

SEQ ID NO: 101043 - DNA, 622 bp, Triticum aestivum
  unsure (1)..(622): unsure at all n locations
  Clone ID: PAT_TA_101043
gcggccgcccgggcaggtacacacatctgacatggtagatatatgataggtgccaaatgctgggggatttgaattgatgcttacatacatgctcgcaggtccgacatacagaacccatgctacgaacataactttgtaatctactggataaaccatgcaacaagactaaagccggcaacgcattcaacataactccctactagtcaaatgcataatctgaaggagctaggaccttccagaatgcatcatggacgagggaagagaagtttccctggaacttgaggcattcatgcagggcatcccatttcgttttggacacagtatactgtgcattggcgaatggtttgcactagtaagctagcagatataatgtgcgaaacatgggagacatagattggaaatgtgtgtgccttggtgagtggcattttcagcttgtgagcaccaaagtgccttgccacatggaggacacacccgcctgtgtcggcacaggagaaaatgcagtcggtcatggaagggaacttgagagtccaattatccttgctagttgnnnancnagcgtagaattcattcagncaagtgaacaatgcatcatgcagcttccatgctataatctcgtcgcgtt

SEQ ID NO: 101044 - DNA, 268 bp, Triticum aestivum
  Clone ID: PAT_TA_101044
gattaacgtggtcgcggccgaggtcgtcgacatggcaatcgagtaactcctaaatgcggagaagcagtgttgcctggctggcgatgtggccagcactaggaaggacatcgtcgagctctccttcaaggatggcgcctggaagatgcttaactaccagatcgttgtcctctctaagaggaggagggccagctcaaagaatggcgtcacctgggaggacggcagcggcgtgcccgtgttcgcggagtacctgcccgggcgggcgctcgaa

SEQ ID NO: 101045 - DNA, 231 bp, Triticum aestivum
  unsure (1)..(231): unsure at all n locations
  Clone ID: PAT_TA_101045
aggggcaaagtttacgggggaacaaaaatgggtctcaaaagccaacccaaattaagggtgtttctcttgatcaaaattatgcccagggtggccaaaaaaaaaagggccacaaaacgttctaaaaaacaaaaacctgtcaacaattttgtggttgttgctgctgctgctacntnccaacagtcatgccttaatggagtgcccccggatgacctgcccgggcggccgctcaaa

SEQ ID NO: 101046 - DNA, 275 bp, Triticum aestivum
  unsure (1)..(275): unsure at all n locations
  Clone ID: PAT_TA_101046
gggggcaaaatttccccccaattctcgttccaaccgtggttccaaaaaaaaagaaattaaaaaaaaaganatgatccccggggccggggggggggtataaataattccggggggtggcttcccgaagaatgaagaaatcttttaataagccccccgggaaggccgaaccccaaaagggccccctcttgggccccttgggccccnaggatttctgggtccccctggggaacggggaaaacaccgggaccccggcaaccccggggaacccctacctg

SEQ ID NO: 101047 - DNA, 166 bp, Triticum aestivum
  unsure (1)..(166): unsure at all n locations
  Clone ID: PAT_TA_101047
gcggccgcccgggcaggtacattctatgtcttatctcttgaccgctttatgaananccaaatgtctacaatttttacatttttatgtgttcttcnnngccaacngnnnaactcattccnnctgctgggattgcctacacattcagacctccgccgggaccacgcta

SEQ ID NO: 101048 - DNA, 317 bp, Triticum aestivum
  unsure (1)..(317): unsure at all n locations
  Clone ID: PAT_TA_101048
ggccgctttaaaaaagaaaatttccattatttcacttgctaaattaacaattggccaccatcttttacacttttctttaccgatctaccatgcctaatataaccacccaagtaataataattactcaacacaccagggcccccatgtttcaaatattttatannnnaaaaaaaccaaaaaaaaacctcccaagtagtaataattactcaacacaccagggcccaatatcaaatattcaaacctncgcgtaaaagggaacccggagcttgggctcnnnnacgggctccaatggggacctgcccgggcgggnnnnnnaa

SEQ ID NO: 101049 - DNA, 275 bp, Triticum aestivum
  Clone ID: PAT_TA_101049
taacgtggtcgcggccgaggtggccgaggtacggacagtcactgcacgcgcagcagcttatagcccggtgtgtttttaatcttttcgtccctgtcaagtgtggcaagatggttttggcttttttttcccgtgtgggtgtgtgaattgtacattttctagtggttagattttgtcaggacctggaagcagttagcagccgtgcatagcaaactgcatacacagcccaaatcaaatgttgttaattggtagagtacctgcccgggcggccgctcgaa

SEQ ID NO: 101050 - DNA, 291 bp, Triticum aestivum
  unsure (1)..(291): unsure at all n locations
  Clone ID: PAT_TA_101050
tagcgtggtcgcggccgaggtacacaggcttctaaagccactctnntacactgctgcaccagatgcannnncccaaggatgtcctatagttcctccaccaaattgtaagacacaatcgtccccacnnntntcanncagnnntnnnatatgccaaacatgaataccacnnngaatctaccaggtataacacctggcatggatacccagtcctgattgaaaaagataccgagagcannatcttttacaataaaatcatcccacaataaatcaacaaaacctaaagnnatngnc

SEQ ID NO: 101051 - DNA, 426 bp, Triticum aestivum
  Clone ID: PAT_TA_101051
gcggccgcccgggcaggtacgcttcgcattgtgaagtcattgtgaacgtgaaggatcctggcttcggctcgatcaaagtcccggtgctgctgattgcgggtgatgaagacaagtcggcgccgttgaagggtgttcagtatattcatgagcatctgggaagtgagcagaaggggttgaaggtgttgaagggcgtgggccattggcattgcatcgaatctggagatcaggttggcagcctgatcaaggactttgcggcgaagattgcgtaggatttgattcctgctcatcagcctacttcagtctttcagtctcgttggaaggcgttcccaacgacagcctctttccaacattaggttcactccacactatccgaccttcggaacaagccagcgaccaccaaaaaaaacctcggccgcgaccacgcta

SEQ ID NO: 101052 - DNA, 489 bp, Triticum aestivum
  unsure (1)..(489): unsure at all n locations
  Clone ID: PAT_TA_101052
cggccgcccgggcaggtacaatcataaaagttgcttttaccaaaaaaatacaagttgctaattattttgatgggagcaactagttaaaaggtgccgctggatgggctttnnnggcaccggtgggcacacaggaggagagccgttgtcacatggcacacgttgaaaattctagaaaacaaaatgcgtatcgcattggatgcatcctgcataggaatctttttttcccttggttttgtctgtgtttttagatttccaacttggctcanngttttcctatttattctttattttttttgggttatctggatttttttggttggcgttcttgtgtttttttcatgttttactattttttcagaactattttgtgctcccgtcttgcatacgttaattcatnnngggagcacaagtgcactacacacaggggattaaaaataaactattgcaagnagctagcacaagtattgnacctcgnnnnngaccacgcta

SEQ ID NO: 101053 - DNA, 203 bp, Triticum aestivum
  Clone ID: PAT_TA_101053
agcggccgcccgggcaggtgcgacaagttatgcaattcacttgaataaacccgaatgattaaggacatacaaaaaggcaacactcaacaaaacatttcctgaagtaacgacatcgaacaccatcccaagaccattgagagcatcaaatgggcgtgcattgccacacatttcatgttttcagtacctcggccgcgaccacgcta

SEQ ID NO: 101054 - DNA, 250 bp, Triticum aestivum
  unsure (1)..(250): unsure at all n locations
  Clone ID: PAT_TA_101054
gcggccgcccgggcaggtacgtgcagctacacgttgatccacgacgtacaagtacacatnnnnacaagcatgcattagctccacannnncataccataatccacgggtaaaaaaatcaagttccaccatcgatcttcttccccnnngtagcacactcctcggattagnggctaactaccaannnntcccttacttgggggcaaatgcccggannntggtggcgtggccgacctcgnncgcgaccacgcta

SEQ ID NO: 101055 - DNA, 415 bp, Triticum aestivum
  unsure (1)..(415): unsure at all n locations
  Clone ID: PAT_TA_101055
taacgtggtcgcggccgaggtacacaggggggtnncatcttgtgctctctctattcaaaacagaaagagagtagcagcatcagcatcaatcttcttttttcagtttcgcccccacgtgcaacttgaaaggatcaaccgggggtctggccacatcagcatatgaggatctctggcaagcttctcgaggtttttcaccacagcagagacctggatttttgcatcgtttgagaacagaacctcccatgctgctagctccatagccacctgtctccatattttctttggggtcttcaacaggtccatcctctccttccagcattgcaatctgttttttccttcttttttggtttgcaacagcttgaaagtatcatgtatttagctccccctccagtacctgcccgggcggccgctcgaa

SEQ ID NO: 101056 - DNA, 604 bp, Triticum aestivum
  unsure (1)..(604): unsure at all n locations
  Clone ID: PAT_TA_101056
tagcgtggtcgcggccgaggtacaacagtaagtgatgttaatcttagtaggttatgtggttgaaaccaacttgggagccagctatcgtcatagttttggaggaacaaagacttgagactgataggaggctgtagaacttcaagcacttcaacatcattgttgtcgatatcaaactcaatatcagactcagggaaacctgtgggacgatcctcccgcatattcagtttcaactcatcaagatatttcttattcttcaggtttagttctgcggcatgatctttacttagcaagtgcacatcaataagctccaagtgcccacggaattggttcagattcttcattaacgtaatctttctccacttgttatctggaccaagatacatgcgacacccatcataatatgttaatccaactgattcaaacttctgcaaactaatcagtttaccaaagtcatcgggcaagcattctagcctgcaattcttggcatataaaatttgaagatgataaagccaacaaaaagttgaagggattttcttcaganngcgagctttgttgatttcnnnnnacctgcccgggcgnnngctcgaaatcgaattcccgnnnn

SEQ ID NO: 101057 - DNA, 342 bp, Triticum aestivum
  unsure (1)..(342): unsure at all n locations
  Clone ID: PAT_TA_101057
agcggccgcccgggcaggtacttcatgttgcctctttggcttgccatggcttgcagcttgcaaaccatgcccagctgactcaagagaagcttgtccatcaatagggagatctggaaatttcaagaagttccannngccaatgcataactacaatgacttggctagcctgttctttaacaccaacgatggcaccattagaaacctctacagtaatggcactgaccatgagttccatatcacctcgatccttgtgttctttattgcatcatattttctgggcattttcagctatggccttgccttaccatctggccttttcgtacctcggccgcgaccacgcta

SEQ ID NO: 101058 - DNA, 428 bp, Triticum aestivum
  Clone ID: PAT_TA_101058
tagcgtggtcgcggccgaggtaccaattgcttttgcagcagaactgcggacatcatcagcatcagcctgcagcaaatctttgagaagagttttttttttttttttttgacaaaagggacctgtttccggtgtcatatttacagggctctactgccacaattcctaagccagtctcaatgcgccccttggagcggactattgatcgtcgagcacatgcaaatacttcttctcttctcgcttctccttctctgtcatgggaggcagatcgaagtatgacgagcttcggtatccttgcaagtatttgtatgtgaagttggcaatgtcacccggctccatgcctagatccgcaaaggtcttggcattcttatcgatgaattgatccaagtgctcgcgctacctgcccggacctgcccgggcggccgctcgaa

SEQ ID NO: 101059 - DNA, 240 bp, Triticum aestivum
  unsure (1)..(240): unsure at all n locations
  Clone ID: PAT_TA_101059
ctaaaattattgggngnataacctaaataacctgaaatgtaaatgtaatcttcacatcgtncccattaaaccacaaaaaaatccaccttcataactcggaaacaaaaaggacagtttcttatttgaccaaaaaaaacctaggcatatatgtccatgtaaatgtaaaggggaaccnntacctcaggaacacccctcttgcacccggaaagggctggaaacctgcccgggcggcccctcaaa

SEQ ID NO: 101060 - DNA, 300 bp, Triticum aestivum
  unsure (1)..(300): unsure at all n locations
  Clone ID: PAT_TA_101060
ggacccccaaaacccaattggttttgaagtttaaaagggggggcccatacttttttcacaagttaataccccacaaaaacccttttgacaaaaacccacccaaccaaaaaccgggaaaacccttttttttaagggtttttttaccccacacaaaatttncaaaataattttgggtcaagcctttttagnagggaaaacccgatttttccgaaaaaaaatgggggtttggacctcctttggggagggaaaacccaaatgaacccaccgggtgacctttaaaaatgaccattgacnannnnn

SEQ ID NO: 101061 - DNA, 330 bp, Triticum aestivum
  unsure (1)..(330): unsure at all n locations
  Clone ID: PAT_TA_101061
taacgtggtcgcggccgaggtaccttggcatcaacaaccacggccatgatagcggagttgtgctggccgacagccctgctaccatgcgccgagcagtctactgatttcatnnnnccgtgaggactgctgggctcaaggggttgaatcgggttcaccacatgtgggggcaacctgggttggcactcatcttggagcacaattaaatggaaatcagtagcaaaaccacaatctgcatagggggaatctaatcctagaatttnncttcatttatatattccgaagtggttccatgattttatattttgcgacctgcccgggcggccgctcgaa

SEQ ID NO: 101062 - DNA, 411 bp, Triticum aestivum
  Clone ID: PAT_TA_101062
tagcgtggtcgcggccgaggtactatgggtgtagaaaaatatacatgcaagcaccggaaagacggagccgctgcagccaaactacaaaatgagccggacaaggcacagctactacttactgcaacttaaaaaggctaatgtcgcgagcatcacttatttttcaccatcatcatctattcatcttgagagacgatatcttgacagccttgtctctatctgttgccatttcttttgcaatattctccacatttatgatgcggattggatgcattgacacaatcaggattgatttctcctgttggctctgatttcatgacagcctttccctttcttgagtctggcttgcttttaggtgttgatggcgcttcattcaaatgatcgaaacagtacctgcccgggcggccgctcgaa

SEQ ID NO: 101063 - DNA, 412 bp, Triticum aestivum
  unsure (1)..(412): unsure at all n locations
  Clone ID: PAT_TA_101063
taacgtggtcgcggccgaggtgagtttgttgccgtcagagacagatgaacacggaaacgtcaacaatgtgatcagagtcggtgacatcgcccggattcgtcctgctcccagccaattgcagataaaggatccatctgttgttaaggtgatagagagggcactgactgaggatgagcggttttcgctggcgtttgcggcacgcctcatggcatttgcaatctgcccaatcagattggctccaaagcagtaggcatgccatcccaacccaactcccgattccgtagtttacataaacctcatgaacagagagcaatcgtttcgcaccgtatgctcgttgaaatcaaacgtggttgggcacaatgtatatctcttgtagttctatgagctgtacctgcccgggcgnnngctcgaa

SEQ ID NO: 101064 - DNA, 185 bp, Triticum aestivum
  unsure (1)..(185): unsure at all n locations
  Clone ID: PAT_TA_101064
aaaccncnnnnggagccccccattattatcatctaaccccggaaaaaacaaaccttattggtcacaaaacttaagggaacttaacaacacaaacagcaccctgcatgcatgcttaaattcatgttcaatccacactccacacgncnnncataaattgnacctgcccgggcgggcccttaaaaaca

SEQ ID NO: 101065 - DNA, 192 bp, Triticum aestivum
  unsure (1)..(192): unsure at all n locations
  Clone ID: PAT_TA_101065
taacgtggtcgcggccgaggtacatctaatgtgcaaccctggcttgctaccnccaccacatgacacaannncgtggcaatcaaatggtttgcttctgntnnnacttcttaaaatactactgccacatgnnnaccagggaggcttacacacacaatggactgcattcctacacttgcatgatcccannnntnn

SEQ ID NO: 101066 - DNA, 335 bp, Triticum aestivum
  unsure (1)..(335): unsure at all n locations
  Clone ID: PAT_TA_101066
nnnnagcggccgcccgggcaggtacttacaaatattgatattgacattatccagaaacgtgcagccaaagctaatgaaaaggttcatatatatattttttaatttgtatttagtgaaaactgacttggcacttgacatacagtatgtgatgctagctccaggtaaatatgcattgcagtaaatgcaaagggggggaatagtggatctgcattcaattcttgcagaccttactatataaattacccaaagaaagaccagacttaactgaaaatgaaattttagagaacgttcacttaaacattcaaagaaaaattacctcggccgcgaccacgcta

SEQ ID NO: 101067 - DNA, 372 bp, Triticum aestivum
  Clone ID: PAT_TA_101067
gcggccgccgggcaggtactgtagcctcttgctggtatttctgtgattgtgctagtgtgtggaagaggaacagcaattttaaacaatcatcaatcacgttgacagattcctggcttgaacaattcttcagtgcagtttgcatcaaatcaaacacatctcctagtaattccccaagtaatatcataaaagaatgagtctctgtttgtgaaacttcagttagctctctctgcgcacaagtttttagcacatgtatcccaagcatttgaacctgcatgttggtgctacgaagtgatccctgaataatgtgtatgcaatgcctaaagctgtcacacatatgcacatcattcttagtcctcggccgcgaccacgcta

SEQ ID NO: 101068 - DNA, 282 bp, Triticum aestivum
  Clone ID: PAT_TA_101068
tagcgtggtcgcggccgaggtgtggaagcgtgtagccaaggatgagaagaaaacatcgccaaatgatgagaaaaaatcaccggaagaaaagaatacaaattttttctcgaaccttcgtgagaggaaggccgccctattttcgaaaaagaatgcaaaaacttcagagttgccatcggcgcccccaccatcagctctgggtccatttgacgagagcgaatggacgattttgtagttgagactcgaggatgtttccttttgtacctgcccgggcggccgctcgaa

SEQ ID NO: 101069 - DNA, 268 bp, Triticum aestivum
  Clone ID: PAT_TA_101069
tagcgtggtcgcggccgaggtacatttgagcaatttctccattttcagatgttgcatgaccccaaaaccacggcatctgggtgatccaaagaacatacagggacaaagaaaaccagaacggtttgctgtttgcaccctccattaaaaacaagaccaaccaaaaccaagcctttcgctgctggacaggggatgttagaactgacaaggcccacctttgatatgatgactttttctttaaaaaatggtacctgcccgggcggccgctcga

SEQ ID NO: 101070 - DNA, 340 bp, Triticum aestivum
  Clone ID: PAT_TA_101070
gcggccgcccgggcaggtcagaatttgacgtttggatatcagggtctgccgttgggcttgggcaaggagccgacggtcaatggaagtgcgaacgggcagggcaagaagggcgccgctgcgagggagagcggcaaccttggctggacactcttgctgggattgggagttgtaggatggcagttcttgtaaagggtgggagagagattgatgatggtgtgagtatttgcattagcgagctgcattagtgtgtttgcgaagggaggagcagcgacataacttatcgacagagaaacgcatatagttcggaaatctgatgttcggggcctgaggctcaaagcag

SEQ ID NO: 101071 - DNA, 398 bp, Triticum aestivum
  unsure (1)..(398): unsure at all n locations
  Clone ID: PAT_TA_101071
tagcgtggtcgcggccgaggtacttgaccgtgttcccactgaatcatncttcgggcttcacatcggnnangggccaggagcnnnngctgattgcctgggaggagttgacggatgcngtgaggcacgnagnnngntaataccgactttggttccgccactgtgccctttcaaggacgcatcgttcgataacaacctnnacnacgctcagcttgactgagtggctgtcacatgngacttctgcagctttcacatgccatatcgcnaatgctacccttanatagcgnncttctacatcctcttcacaatcacttttgaacaaacatctttctagttgtcatccaccacctttgatagctgactggaagcaatcaattctatcgagatngccttgcaaaaca

SEQ ID NO: 101072 - DNA, 196 bp, Triticum aestivum
  unsure (1)..(196): unsure at all n locations
  Clone ID: PAT_TA_101072
ccccaggttggccccaaaggacccccaccaaagttttaaattnncaaaacctatacccaggacccgctcaattcaaacaaggggttatcagtcccctaaaaaaaggggcccaaacccgacaatgtccctgcccgggcggccgttaaaaatcaaatccccgcggcccccatgggggccgggaccatgcaacgtnggc

SEQ ID NO: 101073 - DNA, 213 bp, Triticum aestivum
  Clone ID: PAT_TA_101073
tcgagcggccgcccgggcaggtacttgaatatcatcctaacgtaaaacaatgacaaaaaatgttaagatgatccttcacgcccttcttgttaatcacctggcctgcaccccactcaccgacagctggttcgtcgagaacggcgacttgtcggagttcgacatcagagacattgatgaccccgagctttcgctacctcggccgcgaccacgcta

SEQ ID NO: 101074 - DNA, 321 bp, Triticum aestivum
  Clone ID: PAT_TA_101074
tcgagcggccgcccgggcaggtacaattgccgccaaacacataaacgctggcgccaaacagagcgagctgatagtttcttggtgccaaaatcctcccactcgtcctcttcctcctgatggtcctcctcggagaaaaaatgagaccaaggtatgctgatctgaacgtgttgtagagatctcgcttctgctgaactaacgttgtggccaatcagaacgtgttgacaatttcctcggcgcctcctcctgctcgtctcccttgtccctcccactcgtcctctctagcgagaacaagaccaaggtacctcggccgcgaccacgcta

SEQ ID NO: 101075 - DNA, 445 bp, Triticum aestivum
  unsure (1)..(445): unsure at all n locations
  Clone ID: PAT_TA_101075
aaaagggggggaacaaaaagggagggaaccaaaatttaaaaccgccccaaaaacaaaaaaaaaggaaaaaaaaaaaaaacggccaaaaaaagggaccaaagcggcccccccgggaaaaaggggcccccccccccggggggcccaacaaagggcccccccccaaaaaacggcccccccgggggggccggccaaaaaaaaacccccggggccgcccggggggccgggaacccgcaacncnggccccaaaacnccccaaaggggnaccaatcccaaaccgggggcccccggttanaaaccaagggagggggaaaccccgggggtnccccaactaaaacggccggaaaaacaaccccnnttcccccggggggggaaaacaaaaaaggccccccccgaagggccttcccaaanntnncgcnnccggaannncaaagggcccccccctgaa

SEQ ID NO: 101076 - DNA, 428 bp, Triticum aestivum
  unsure (1)..(428): unsure at all n locations
  Clone ID: PAT_TA_101076
tagcgtggtcgcggccgaggtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacgttgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataagtaagaaatccccagacaaccctctgaacaaggcaactgagtgaggatacagtcccagtttcgtacctgcccgnnnnnnnnnnnn

SEQ ID NO: 101077 - DNA, 258 bp, Triticum aestivum
  Clone ID: PAT_TA_101077
gcggccgccgggcaggtacatgccgcagcttctttagtttcgcaaacccagcagggaaacttattaactgagtccttttaagacttaaggtttctaaattctgaagtctgctgacagtttttgggagtgatttcacattggtgtcattgaggcacaaatacttgagattaaataattccccaattgaatggctgatagtctcaataggcaagcctgataagtccaacactgcaaggtacctcggccgcgaccacgcta

SEQ ID NO: 101078 - DNA, 220 bp, Triticum aestivum
  Clone ID: PAT_TA_101078
tggccgcccgggcaggtactaaacagtcatgcggctctccacagatttcttccaaatgccttgcaaagttccgcagagaacaagctatctcggaatttcttccaaatgcagcaagttccgagcaagcaaaactatactctgtaaataatcttcctgaaccagagttcttaattttctttctatttttaccttttcctgtacctcggccgcgaccacgcta

SEQ ID NO: 101079 - DNA, 373 bp, Triticum aestivum
  Clone ID: PAT_TA_101079
gcggccgcccgggcaggtactatctgtggtgatacagttcaaggatcagaaactttttgcagttactgtttgaaaaatgaagctgttgttgccactgtagtcactggcaggacatcaaaattggagcgagaaatccaacatcttgctgctgtatgtggccactgtggcggcgcggactggatcatggaaagtggggtcaagtgtgtttcgcttgcatgcccggtgttctatgagcgtcggaagattcagaaggagttgagagtcgtctcggaatccgctggagaagctggctattatccattctgctgcggggagctattctgactttgtattcttgttgttaatatcttgtacctcggccgcgaccacgcta

SEQ ID NO: 101080 - DNA, 603 bp, Triticum aestivum
  unsure (1)..(603): unsure at all n locations
  Clone ID: PAT_TA_101080
tagcgtggtcgcggccgaggtacaacgtcgagaaatcgttaccagtgacgacgatgggcacacgtgggttctcctccttgttgtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccacttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcnnnnncgcctaatccatgtgcgctgccactgtaaataaatgannnatgttcnnnnngcgacn

SEQ ID NO: 101081 - DNA, 353 bp, Triticum aestivum
  Clone ID: PAT_TA_101081
gcggccgcccgggcaggtgcttgatttagggtttataccaaacattgtggcttacaataggcttcttgatggcttacatgtgcggagatctttggaataacaagtgaactcctctaggcatgtgtatgctccaaacattttttggccacgtggaagcatcaaactgcaagaagtcagagagttgctgcttacaattcatgcgcacagacttttggaggaacataaaacaaaacaagggatagtcggatagatgtcagttgagatgagcggtggtcacaattgcactgacagaagttgcgaaattccagtgattcaaatgaggtttgaactgtacctcggccgcgaccacgcta

SEQ ID NO: 101082 - DNA, 332 bp, Triticum aestivum
  unsure (1)..(332): unsure at all n locations
  Clone ID: PAT_TA_101082
gcggccgcccgggcaggtactataccaccatactctgctaaaaagaagaaaacaaatataactgcagcgtgctctgtcataaatccactaactaattccgattctgcctccgctaaatcaaannnnagctactattagctttctgccacacttcctataaagaatatgataaatatagggagtaatggcattataaatcatatcgctctttgagcttcaatattaacagttaaatttaagctaccacttaataatactaccaacagtatagctgagctcagtataagctcataacttattagttgggctgtacctcggccgcgaccacgcta

SEQ ID NO: 101083 - DNA, 407 bp, Triticum aestivum
  Clone ID: PAT_TA_101083
tagcgtggtcgcggccgaggtactgtgtccaagaaaagcggcaaaggaaagcataccacacgtcatgtttcattacttccgatagttgatggaggttttcttgctgatactcctggatttaaccagcctagcctgatgaaagtgaccaaaaggggtcttgcagaaactttccctgagataagaaagatgctagaagaaaatgagtcctccgggtgcttatttaatgactgtgttcaccttggtgaacatggctgtgttgtcaaaggtgactgggaaagatatccatactatctgcagttgcttgatgagatcaaaattagagaatccttccagttacgaacatttggaactaaaagagaaggtgatgtcaggtataaaacaggtacctgcccgggcggccgctcgaa

SEQ ID NO: 101084 - DNA, 328 bp, Triticum aestivum
  Clone ID: PAT_TA_101084
tcgagcggccgcccgggcaggtactactacacacatatccaaaataccataaagaccattattcatcaattgccatgcaagtgactagtgagatccttctcgggagacaccatcaggattgaagccacaattgttattgttaccaccaatgttctcctcatcattgccgctttcattgttgcaatggtcaacatcatggtcgatagggccatcctctgaactaacatgagatgaatccgtgtttacccactagtagaaaaagggtcaaacgtgaagcacattagtgccggtttgtatttgagccggtacctcggccgcgaccacgcta

SEQ ID NO: 101085 - DNA, 271 bp, Triticum aestivum
  Clone ID: PAT_TA_101085
tagcgtggtcgcggccgaggtacctgaaaaaagagcactcgaagaccccattgggacggagcggcaagccgatggagatagcctcggcagtgtcattcctgtctatgcctgcagcttctttcatcacaggccaggtcatttgcatcgatggtggtcgaaccattagtgcttagccatcaccccccatacgtaagttcttgaatactagcaaaaacgtgtgggagactgaaataataataaataaattgtgccaacaaataaaaaaaaaaaa

SEQ ID NO: 101086 - DNA, 349 bp, Triticum aestivum
  Clone ID: PAT_TA_101086
gcggccgcccgggcaggttgataaagttggatttggagatgaccatattgacagaggatgacataaagctcattgggagtctatccaaactattcactctccgtatcaagctgctccaagatagtaaggtccatttttgtgttaaagaggctggacttgaggtgccaacttaccaaatggtcaaggtcctagacatcggtttcaactcaaacttcgaagttacttttgggacaaacacaatgagaagtcttgagctgataaaggctcactgctgcaatggttcttcagtgaagttctccggcctgaataacgtaactgaactcaaggtacctcggccgcgaccacgcta

SEQ ID NO: 101087 - DNA, 263 bp, Triticum aestivum
  Clone ID: PAT_TA_101087
gcggccgcccgggcaggtggcggatggagagccgaagaagggcgaggtggagatcactgctgttgagagcagtaggtaagagctttctgactgatgtttgcaaggctccgtcgaagtatcagtcgatgagggactctcaacatcggaccatctcaaaatcggaccatctcaacgagagcatacactccgatggctgatatcgtatcgtaggcaacagcaagcagatcgtcaggcgtagtgagacttctctcaaaaaaaaaaaa

SEQ ID NO: 101088 - DNA, 524 bp, Triticum aestivum
  unsure (1)..(524): unsure at all n locations
  Clone ID: PAT_TA_101088
tagcgtggtcgcggccgaggtacatatgtcctctgaactactcgaactctctctgtcttcccatccatggctacacttgaataagcaatttgttgaaaccgcaattctcggaggacaatgagtgaacctctctttctcacctccatatgcaagaacgagtattacatacattgttagtcatgaaaatgatctgtggtatgtttgttgtcagtttactaggagttgcactatttggtttatctcaatcgtcctaagagatgtctacctatttccatgtcacacctcacatgcagcgaagcgggctgaaatatccccagtccccacctctttagagcaagtccatgtcgctaaatcctttgtgtttttttgcacaaacaacctnnnagaggatttgcataaaaatactcctcttgccttggacnnngaccnnncaacctctgatatggacctccaagtctgttttcatgatgtgttttcannnngctttgaaagtcgttccaagtaattgtacctgccccggnnnn

SEQ ID NO: 101089 - DNA, 572 bp, Triticum aestivum
  unsure (1)..(572): unsure at all n locations
  Clone ID: PAT_TA_101089
gcggccgcccgggcaggtaccctgacggccaagccaaaaattattaaagataatgaagcctaaactaccctcattacttgttaaatcacatgtcagctctatcaatcagtaataaatatcatagatcatcatcccaaactttcaattttattttgcaactgtcattgggatttcatacatgcatggagatgattttttcaagctctatgtgaccgatgagaaatttatcacaggactatcgaccattgagatgagggattgcttctccatcaattaggccggggacatcaccacaacccaacaagtcctcctcctttgcatcaactactaaaaaatcttgacatctccggcaatggacgttttaaacctggattctctcctaacaaatatgcagagcactcatccatttcaaataaaatgaaataaacatctcattctacaatattgctacaaactgtcaatcctcctagatccatcagnccatcaccatcaccatcagaaaatcacggcaatctcgccgggtagggttacggtcgatgagtgnctnnnnnnnctcggccgcgnnnacgcta

SEQ ID NO: 101090 - DNA, 502 bp, Triticum aestivum
  unsure (1)..(502): unsure at all n locations
  Clone ID: PAT_TA_101090
tagcgtggtcgcggccgaggtactgatacatccctccgcatctcctcctcaagaactgctgcctccctccccttccaccgccgccaaaacccccttctcctccaacaacgacgccaacgatccatcctgatgcatcgacatcataatatccgtcccacccacaaactccttttccacatacaactgcggaatcgtgggccactccgaatactccttgattccagccctcaactcctcatcctccagcacattaaacgccgtaaatttcgccggatccacgccctgcaatcccaggagctgaatactcgcgcgactgaaaccacattgaggcgtctcgggggttcctttcatgaagaggacgacgggcgcggaagcgacggctttgtcgattgcttgccgggtttcggtggagaggaaggatttttgaagggaggcgannnggggggagaggagtgggttgaggcgcggtcggagagcggacctgcccgggcgnnngctcgaa

SEQ ID NO: 101091 - DNA, 313 bp, Triticum aestivum
  Clone ID: PAT_TA_101091
ggttttttttttttttttttttttttttttttttttttttttttttttttggaggggaaaaccctaatccggtggttggatttaatttttttgtttttgtttagccggggctttaattttaatttgcatcctcctcaacctaaattggggggggcttacatacttttgctctttttttcccatttgagtaaaacgaaaagtaaaactgaaaaagccaacccccccacaaatgggaactaaaatgggccctgcccgggggggcgtttaaaattaaattccccgggcccccttggggggcgggaacatgcaaagt

SEQ ID NO: 101092 - DNA, 506 bp, Triticum aestivum
  unsure (1)..(506): unsure at all n locations
  Clone ID: PAT_TA_101092
gcggccgcccgggcaggtacaacatacattcaggacatcaatttctccagcatacattctgaatcttgcttaacagcatacataattgagtcattcacaaactattttttatgatgtaaatcatttccaaaagaaggaaatggcaaaacagaacagcaaccacaaggcagaaccgcagtttccgaatcttcttcttcaggacagcaacttctccatgatgcttgacttccaaatcacacacatacgcatccaacatcttgttcttcgacaagctggcgttgagcaagtcattttcattcctcaattgatccttcagtcgatacacaacatcgcgcaaatcaccaagcaacatgctcataaaatatctgcagtcgactcccagtgctttgccgcagttgtagtactggatgccgggatggcccgatgtgaattcgccataagcaatagaaccctttttcttttaccattttctgacgaggaattgtacctcggccgcgnccacgcta

SEQ ID NO: 101093 - DNA, 435 bp, Triticum aestivum
  unsure (1)..(435): unsure at all n locations
  Clone ID: PAT_TA_101093
tnncgtggtcgcggccgaggtaccgcctccacgacgccgagaccnnagggggcaggacagtgtgagactcctcctgctgttactctggcagtatactcatcatatcaactctcatcaggccgcataactaggggggagctaattcacaaggatatatatacaccggcgcttctatctgtccagcagccagttgaggaccgtctttttcgggacgactccgtcggcgtcttctttctccggcttcacggaggtatttacagcgttgcggatcacggagttgaggtgcatcctcagctgcgcgttgtcgatgagcaggtcagacaacatcttcgttgtctcttcatcagtgaggcttgagtcttcgctgcccatggtaattgaggatttaccatcggaattttcgccatcgtcgacctgcccgggcgnncgctcgaa

SEQ ID NO: 101094 - DNA, 410 bp, Triticum aestivum
  unsure (1)..(410): unsure at all n locations
  Clone ID: PAT_TA_101094
gtggtcgcggccgaggtacaagcaatgactctgtatgagtttgcgttggtatgcagggttacttggcatgtcaaagaaccacaagccataactggccgtgcgagcatctcagatcttgtaggtttatgaaggtgagcgccctgttggcaaaatagggcatgcgatcttcatatgtcaaacccttgttaatgaatttgcatcgtcgaatgacttgatgaatgtttttgtacaagcttttttttttttttttttttttttttttnnnctgaattttcatttcattcatagcnnacggggacggaacagggaacacggaacgggagcgnnntcacanntaacgggagccaaaacanntcggaacctacgcgatggagcgagatctnngnnacctgcccgggcgggcgctcgaa

SEQ ID NO: 101095 - DNA, 294 bp, Triticum aestivum
  Clone ID: PAT_TA_101095
gcggccgcccgggcaggtacaataatggtgctgatggttcctgtaaaacaaaattttcaggacctgttgcagtaattgatgaaaacatgaagcttactcttgcaaatagtcatgatgcaatatgcctgatgctcatgatctgcataactaaaaagcaccagctggttatgtccaacaggcggcttccttgtctagatacatatttggataaggctctgatctatctctggccacgtttcaagacagtgtttgacatgtatattcaaagcttgtacctcggccgcgaccacgcta

SEQ ID NO: 101096 - DNA, 369 bp, Triticum aestivum
  unsure (1)..(369): unsure at all n locations
  Clone ID: PAT_TA_101096
tcgagcggccgcccgggcaggtacatgttactgactnnttcgatattttgagaatcaataggaaatgctatttgcttcttaagaagagcagcttttttgaaatgaaagagtttccacgggcgtcgtatatcctttgttcaaataaggttcatgtagcataatggtatgactgtgcgaaacgtatcttcagtttaaacttcaagaaaaaggacaccttcagtttgaatatgtgccccacatttagaggtttgagattgttatctccaccacatggcggtgtgagacnnntgtcctcataagagactgaatataacacagatgtatttggtggaggaaatacttgtaagtacctcggccgcgaccacgcta

SEQ ID NO: 101097 - DNA, 213 bp, Triticum aestivum
  unsure (1)..(213): unsure at all n locations
  Clone ID: PAT_TA_101097
gcnnnccaaggaattttggaaacccgggaattatctttctccatttgctatgcaaaatccctggcactggcaaaaattatcggcccacagttcaattttttccctccgggtaggaaccnacctccccctaaaannnatccgacaaaaccttttaactttttcctaccccctaccaaaacaattattacctgcccgggggggcnntcaaaaaca

SEQ ID NO: 101098 - DNA, 335 bp, Triticum aestivum
  unsure (1)..(335): unsure at all n locations
  Clone ID: PAT_TA_101098
tngcgtggtcgcggccgaggtacaggagcagcatggtcgatgtccggcaatgtgaggattcgccaatctgaaccgaaataataagcagtggtgcagatcgctcacactgtctctcaccaaatctttcgctgaactcaaatacctgctgaaactcaaatacctgcaaaagtaggagcctggaatattaaggacctgggcctcgtctgggcgctacagcagtgggaaccgagtggctcagccgaacttcttggggctgtgcagttgaacggccaaagctggcagcggcgaaacacgctgagtgctgcagcgatgacctgcccgggcggccgctcgaa

SEQ ID NO: 101099 - DNA, 268 bp, Triticum aestivum
  unsure (1)..(268): unsure at all n locations
  Clone ID: PAT_TA_101099
aaaaccgancctggttgggatttcctctgggaaaaacccaaaaggganncctccctaagggccggggggccttttatcaacgggganattcccttgccgggttccaaatataaacaaacctaaaaggcccgaaacccccccggcccttttggggacccctttaccctaactgggggaggacctccccaaaaacnnttttgggccccccgaaaaaccccgggcggaacccccctaaaaaaattcccccggcccccatggggggcgggaa

SEQ ID NO: 101100 - DNA, 417 bp, Triticum aestivum
  Clone ID: PAT_TA_101100
gcggccgcccgggcaggtctacgctttaccggataatggctacatagtcggcacgcacctgggcatgtcccttgatgtgatgctgatcgagatagatgaaaggttcaacgcactgaagctgctgctggccgtcgtgttccggcaagctagggacatgcctggcctgtccaacccttcggttactgatcttcagtgggaacatgagttgcaactggaaatcatcggcattacagtcgcagaatgcattgctggattgcaggaggagctggagaggaagttgtatgagcaaatttctgtcacaaacattatgagcaagaattggcaggaagcagtatctcagtttgccgcgatgcgtgaggacctgggtgctctttctaagctgttgttgccttcagtacctcggccgcgaccacgcta

SEQ ID NO: 101101 - DNA, 430 bp, Triticum aestivum
  unsure (1)..(430): unsure at all n locations
  Clone ID: PAT_TA_101101
tagcgtggtcgcggccgaggtacanttcctgcaactttnnnatgatannggaaatggtggaggatccttacatgattatcttcatatttcctggtgcannnnnataagatgtgttgaaaaactgtctcacctncaaaatgaagaaacaaagaactaatgttccagtatatttgcnnnggtgaaatattaacgccagttnnagcgcaccggcctcgatggcaagacacnnctaccatcaagatatgcattgagattgaacatgngnaatcatttacctccctgtacatccctaatttttcaatcaactcactttcngncgtnantccgctgcattggtgcaatcgttccggcagtgaactttgactccacagttcttgcatcgagcacgtnnnntnnnctgctttggtacctgcccgggcggccgctctaa

SEQ ID NO: 101102 - DNA, 567 bp, Triticum aestivum
  unsure (1)..(567): unsure at all n locations
  Clone ID: PAT_TA_101102
ggaattnnnntgattcagcggcgccgggcagactggatnnnnngnnnnnntacaactantgacaataggggaatttgtcagatcaataatcttggggcaaatgctggccactttgctgcaatctctagcataccgggcgactggtgtaaccaagtctaccacatcaatttcatggaagaaaagattaccatcgtctgaacctgccttcaacactggagatgcttcccctgtcacacagtttactgatcttccggcaacatcatcgctgcacgagctcgaggaacatcgaggtggtgttctagacacgtgcaattccgatgtctcgtgaattccgccccattccatgtaactgaagtcatcagtgggataatattcaacatcagagtcagcaattctggtttcttcttccactggttgggccccagaggattctgaaattcttgatccacagacctcactcccttccatcggagcaaaaaactcatcagtgtctgattcaccgaagtcatcaatggtatattcaacatcacagtcagcacttctggtacctcggccgcgaccacgcta

SEQ ID NO: 101103 - DNA, 370 bp, Triticum aestivum
  Clone ID: PAT_TA_101103
tagcgtggtcgcggccgaggtatcaactcgtgacggactttatcccgttgagtttggataatcaggtgttgcagttgtcgaaggttagtcagatttttgcgaagagcaagttgacgagtgtgtttgcgaatttcgggtgtccggctttgtagagtgcagaagggagggggaggtgtatatacggaactggcgcatgtcgagtgggatcgtatatgggggattgtatatagtaatatcacgagtatgatgatatggagcacagcatggaagcaatgcaagctggatttgacggtatggtgtgtggcattcatttagtctaccttgagcatgaaattacggaaggcggtacctgcccgggcggccgctcgaa

SEQ ID NO: 101104 - DNA, 164 bp, Triticum aestivum
  Clone ID: PAT_TA_101104
agcaaaaaagtcccttcatttattaaaattcaacccgccatcctattttcagggggtatatcaaaaaacgctttgtttttacaaaaacaaccctgcattagttacaatcctacccgcgatccttaattaaactggttcaccacctgcccgggcgggcgctcgaa

SEQ ID NO: 101105 - DNA, 442 bp, Triticum aestivum
  unsure (1)..(442): unsure at all n locations
  Clone ID: PAT_TA_101105
tagcgtggtcgcggccgaggtacatctaatgtgcagttcgggcttgctaccaccaccacatgacacaagcaggtggcagcaaatggtttgcttctcatcttacttcttaaaatactactgccacatgagcaccagtcagccttacacacacaagggactgcatccctacacttccatgatcccatcagtcgttggggcaggcacgagtcttgtcctctgaactaagatggtcgcggcgacctccggccagggcaggggctacggctaccgtcatctgttgccagcttctcattgcaaccattatcaacatcacggaggtcatttctatcagcaggcgtatatgaccccctcttcttattgtcaccatgttcctttaactgtcttggtgatttnnnnnnnnnnnnncccggnnnnnnnnnnnnnnnnnnnnnnnnnnnnnnnn

SEQ ID NO: 101106 - DNA, 349 bp, Triticum aestivum
  Clone ID: PAT_TA_101106
tagcgtggtcgcggccgaggtaccgtttctcattccttcagcaccgaccggaggtcatcatgattggaaatggtcatcaggcaaagggtgtgtcattgtgtcaggtttactgttcctctctttctcgcccagcatacaactggctcagtagatcaccggattcttggagattcatgtgcgtaagctcaaaagctttatattgttgctctttagagaggtccaattgagaccatggcctcgttgtagaacttgaaccctatggaaccatctcctccatgttcccagtgttcaacttcaaccacaggatcaaacctgcacccaaccacacctgcccgggcggccgctcgaa

SEQ ID NO: 101107 - DNA, 322 bp, Triticum aestivum
  unsure (1)..(322): unsure at all n locations
  Clone ID: PAT_TA_101107
gcggccgcccgggcaggtacctgcactactcaccctgttaaggctganntanntgagagctggcaaatgaaatgccagcagctgcagcgggtcttcattcccaagattgcaccaactcagagcnnnntacttgatattcttcccatgaccctgaaatattggacacttgagggtcccatcggcccagccacctctaatgatcagtctgaggagcctcttggaaattggcttgagtgcttggaacgtaagtgtctccttctcatcacatgcacagagaagtaagctggaaagcagaggcataacctcggccgcgaccacgcta

SEQ ID NO: 101108 - DNA, 314 bp, Triticum aestivum
  unsure (1)..(314): unsure at all n locations
  Clone ID: PAT_TA_101108
nnnnnngaaaaacnnnnncaaagtattttncttaggggggcaaaacacngnatatactctccgtccattttttccataaaagctggtctcaacctgaaacaacaacaaccccctggctggctaaggggccctcaacctgctaaaggccctactacccctctccctccataaaaaaannacctccccaacggatcnatacctgtatttcttgacaaacattttctttttggcggccccggcctccccgtcgttggtgtacctgcccgggcggcnnctcaaaatcaaattcccccggcccccatggcggccggaac

SEQ ID NO: 101109 - DNA, 344 bp, Triticum aestivum
  unsure (1)..(344): unsure at all n locations
  Clone ID: PAT_TA_101109
gcggccgcccgggcaggtacttcattccacttagagagataacaggacatgtnnnacatctgagtgaacaagcataaaaggggaaatactcctaagacccttactcacataagatgtccttgtgtgtttagcaaactcacatgcatcacacacaagcttgttcttatccaccccacacattacatcgggaaagactttactcatcttctcaaaagacatatgtcccattctacaatggtgaagcattacctttgtttccttttctcccatcattgttgctaacatcgtagacaccgcattatttggcacctcgcgatccatgcacctcggccgcgaccacgcta

SEQ ID NO: 101110 - DNA, 478 bp, Triticum aestivum
  unsure (1)..(478): unsure at all n locations
  Clone ID: PAT_TA_101110
ggcccgganttttcctttcctcccaaacaaaaggaaaaggggcggggacaaaaaaacccgaacgggggggggggccccactaaagggggcccaaaaaatccggaaccccccccaaggggccaaaaccaagggcccccccccggggggcccccaaaaaaaaaatcccccggcccccctggggggcgggaaaanaccaanacgggccccaatccccccaaaaggagngggnaaaaaaaaaaacgggccncggtttnaaacnccgggaaggggaaaaacccgggggtaccccaaataaaagccctggaaaaaaacccccctttccccacggggggaaaaaaaaaaaagcccccccccaaaccccccccccannngtgcccccccctnaagggaaaagggccccccccttaaccgccccaaaaacccggggggggggggggnnnncccccnngggaacnctnnnnttnnccannccccannn

SEQ ID NO: 101111 - DNA, 201 bp, Triticum aestivum
  Clone ID: PAT_TA_101111
tagcgtggtcgcggccgaggtactgcactgcacatgattagaacaatagagtctctatgctcctgtagggcattttagcgagtgccggacacacatttaggagcaatagttccagatgttttatgtttgcacaaaatgtcaaaatatcgcagtgtgtagatcagttacagaaatctgtgtattaatcgtaaaaaaaaaaaa

SEQ ID NO: 101112 - DNA, 538 bp, Triticum aestivum
  Clone ID: PAT_TA_101112
tagcgtggtcgcggccgaggtatcatgcatcataacctatccttcgttttactgaagtttttagttatttatttcttggccgaataaatcccctttcatatgtaaaatacaattgatcatcatgacatccccaccgaggcgccccgcgtctgcgccccgtaatcctacacggatctccgctgaggccatgacatccccacccaggtataggagcatattgatctcaaaaaggcaccaacccaattgaacctctcccctgaccctttcttctccatcttccaatctcatctgttaagtttatatcagtttattaagatggtttcctatccgttatgcagtttatgtgtgaatcctgcaagtcgtcatgttcaattgtggttgtcatgtcgaattcgtattgatcatactgagcgcaaactgtagggttagctgtgtttgatgttaaatccctgatgattacattgttggaaaattattcctggtttcctttctgttagtcagttttaagtgtgaatggtacctgcccgggcggccgcta

SEQ ID NO: 101113 - DNA, 388 bp, Triticum aestivum
  Clone ID: PAT_TA_101113
gcgggggcaaagatgtttctcattattaattacccgaatacatagtcgacagattgtataatatattatgtgcatgtgcatatacatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaagccttgccggactcctcgcagcccggtggcctgaaggcaatgaagctgacgcactgcacctggcgcatgttgtcgaatccgatgatgcggacgtacctcggccgcgaccacgcta

SEQ ID NO: 101114 - DNA, 200 bp, Triticum aestivum
  unsure (1)..(200): unsure at all n locations
  Clone ID: PAT_TA_101114
gcggccgcccgggcaggtacttgacatgaataatttagacnntcgacatcatcgcaacttagctcggttcattttctttactccggaagaaggtcaatcttatttgttctgacctgtctgctctagggatcttggagctattccagctgcatcagatcctctcatgattttcagtttccacctcggccgcgaccacgcta

SEQ ID NO: 101115 - DNA, 155 bp, Triticum aestivum
  Clone ID: PAT_TA_101115
tagcgtggtcgcggccgaggtacgacgtctcgcaccacttcttggcgtccccgatgatctgctggttgtgccgttccacgtcccgctccagcttcaccttctccgtgttgcgcggctcgccccagtagtcgtacctgcccgggcggccgctcgaa

SEQ ID NO: 101116 - DNA, 420 bp, Triticum aestivum
  Clone ID: PAT_TA_101116
gcggccgcccgggcaggtaccttctttttttggcattataagctgcacaactggagttagaggctgattggtttgatgccaacatttggtaaatcaaaagttgtcaaaatttggcaagtttttgtgagcttgacaagaaacaaaccaatcactagccaacatttggcatttgccaaaccttggcatgccaaattttggtatcaaaccaatcatgctcttaatcctctcaaatccctcaacccctacattccaactgaacttgtgacctcagtaaaaacatggatgtctcatcagctgagctgcaacttgattcctggggtgcttcatatttacagatgtgatgttgatgtttacagttttatcttcaacacctaataaggcacaagacacatccattgtacctcggccgcgaccacgcta

SEQ ID NO: 101117 - DNA, 389 bp, Triticum aestivum
  Clone ID: PAT_TA_101117
tagcgtggtcgcggccgaggtacactaccttcgaggcttacacacaagatgctgcggaatttcctgaagtatttggagatgcgactcaaacagttggcaagctcagcaacggcgggaagccgaagtacatgaacatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctgacgcatgttgtcgaatccgatgatgcggacatacgcgtcagggtacctcggccgcgaccacgcta

SEQ ID NO: 101118 - DNA, 323 bp, Triticum aestivum
  unsure (1)..(323): unsure at all n locations
  Clone ID: PAT_TA_101118
acaacaggaggatcggcagggtgtattaaagtcaattttgaaatcttttcttattggaacacacaagtaaaaccttgcaacggtataaacatttgaaccatggaaaaccnnnttcacctgtccacggttatgtcaactaaaaaaacaactgaacaacgtgcctaccacgaggtttcacgccacttgtcctcgtccgatcatactaaatctccaaccgctgaaatggaacttttcgaggttgaccaatgcccctggtaacagccggatcggggaaagctnntcctgctcctgccctttgcaacctgcccaggcggccgttcnna

SEQ ID NO: 101119 - DNA, 323 bp, Triticum aestivum
  unsure (1)..(323): unsure at all n locations
  Clone ID: PAT_TA_101119
tngcgtggtcgcggccgaggtacatcaccaattgagaatttaatggtcgtgataatgttacatggagcctgttcacgtcttgcgccgcttgctgcctttggatatgtcatggcaacacacctttctctttatcctgcaattctcattctacctgttgctcttttattgggttatggtccagatactccgccaaccaaagtatttcttcagaaaggcttgagtgccagtaaaattgacatgttagataatggaaaaggtggggaacacctccacgctggcgcacgaggcactctgggcggtacctgcccgggcggccgctcgaa

SEQ ID NO: 101120 - DNA, 310 bp, Triticum aestivum
  Clone ID: PAT_TA_101120
gcggccgcccgggcaggtacgtataggctggcaaggatgtggcgagtgatcggcgacggtgcaacggtgatgaagcgcatggcggacatggcgagcgtgcttcttctcgttctgggccgtgcggtagatcatcaagacttgtatgcacatgtgctatccagctgaagaaggcaactgaaaaaggaggctcgccccccatccactagcaataccatcgtttagcacatcagcaccttcaagatatacaaaaaccatacaactaaactagactgcagaaatgtaaatatgtacctcggccgcgaccacgcta

SEQ ID NO: 101121 - DNA, 228 bp, Triticum aestivum
  unsure (1)..(228): unsure at all n locations
  Clone ID: PAT_TA_101121
tnncgtggtcgcggccgaggtactcggcgcctccgacgaggacgacctcggcgacgacggcgaggatcaggttgatggggatgctgttgccgaagtagttgagggtgttgccgtcaaggagaagggcgccagtcttgaaccaaacggcctcgggaccgcagtttgcgccgaacttgttgagcgcctcggggatgatgaatccggcacctgcccgggcggccgctcgaa

SEQ ID NO: 101122 - DNA, 554 bp, Triticum aestivum
  unsure (1)..(554): unsure at all n locations
  Clone ID: PAT_TA_101122
gcggccgcccgggcaggtacaacacagatgagtcaattcgaggttttgctgaagcttctatggcaatcgcttatgagaagaaatggccattgtactttagagcttcagagttttaaatgcccttcgctaccatgtcattctgtgatgccttacaatcccacaagtcactgtatacatacattcatacaaacatacatatggttctgaggagaaaattaataatgaaacaaataatgtattgagtggaggtgagccatgtggttttaatcttcgtcaccatcaactctcattcaaaaccagtgatccctgacagctgctattggcttcaagagcatgtcaaaacccggcgaaggatggggnnnnngggtgctggattgcatcaccagcaattggccggcctcaagagcgtgccaaagccacgcaacagaccggtgattaccggcacagatttcatgacacgggtctcttgttagcatcgtaagaggatgccagtctcctcgcccaaagattgtcctcgggagaccnngatatggacctcggccgcgaccacgcta

SEQ ID NO: 101123 - DNA, 423 bp, Triticum aestivum
  unsure (1)..(423): unsure at all n locations
  Clone ID: PAT_TA_101123
atcgatatgttgaggcttgtctgtatcttccagctgaccgggaatcgacgattgtcgctgctgctaggatgctcggttggagagatattatcaaagtttctctgtgctcgcacttgagttgcacttcagccgatccctgctgcatttccaggatgattcgcatgaagtgtctggtcgaagctgtttgccatcaaannnacatgcgtcctcacgctgcaacaagatccgcgcagcgtatgctcctcatttcgaaccacatcagtccaaagtgttgatatcatgctccggtccatattccaacacaacgtccgagcaaaacttctcaaactccttcgcccatatcttcatcctctccgctcgcacccctttcccgtcacctgcggtgggccctgcaagaagtacctgcccgggcggccgctcgaa

SEQ ID NO: 101124 - DNA, 286 bp, Triticum aestivum
  Clone ID: PAT_TA_101124
gcggccgcccgggcaggtactcttgtcaccaagtttctgtcattcgttgagatcaccattgtagagatgtcgctcggtcttgaaaaaaaaaaactccacgcttaactgacttcttgaagcaccatccttccgtttaacaccatccctgccattaaagcaccagcctcccgtttgaggtttcagagtatgtcattgacgtgatgctctatgtattcttcaacttcttggagacacatgtatcatctataggcgcccttggtagagtacctcggccgcgaccacgcta

SEQ ID NO: 101125 - DNA, 337 bp, Triticum aestivum
  Clone ID: PAT_TA_101125
gcggccgcccgggcaggtacacatgtgccatccaacagaacgcagaagaaacatccaggccttaatccaattactttatagcaatagattgcaagatgcaaggaaggaatattgtcgggtaacaatatagcatcaggtcatcactcaggcatggccaaatccggacttcatagccagttccatcttcatgggtttctttagactctgacagttcaggcttcatagttcattccatcttcagaatgggtttctttggatttctagcaagctgggtccggaactgttccttgagccgtgcttccctctctaactctgtacctcggccgcgaccacgcta

SEQ ID NO: 101126 - DNA, 404 bp, Triticum aestivum
  unsure (1)..(404): unsure at all n locations
  Clone ID: PAT_TA_101126
tnncgtggtcgcggccgaggtacacccaaaggaaatgacacatttacagctcagatcaaagttctcattcttgtcaccagggactgcatgctctccagcttgtcggtcagctgcctgatgtcctccgcgcggctctcgtctccggtgctggttagggacgcgcatctggccttggattccgagatgtcgctttgtagcgaagcaattgtcgcttccagggcctctttcaacgccgcatttgaggttgtatgaaacattggagtcctgggagtcctaggggtgcttacgctgccaaaactgttctgcctgctgagcctgccaggcgagaaaatgttgtccatgcctccacttcctaggttcctcagctgttctatggttcccacctgcccgggcggccgctcgaa

SEQ ID NO: 101127 - DNA, 194 bp, Triticum aestivum
  unsure (1)..(194): unsure at all n locations
  Clone ID: PAT_TA_101127
gcggccgcccgggcaggtacgtgctgtttgagtttcatttagtgatttctggatttgatcatttaattcagaaaatanatattgtttgctgttgaaatgtgtaaaattgaaatctgtgattgaaaaagattgaatgttctattggatcgaataatatttgggctctaaaaaggcaatggcccaaaaaaaaaaaa

SEQ ID NO: 101128 - DNA, 293 bp, Triticum aestivum
  unsure (1)..(293): unsure at all n locations
  Clone ID: PAT_TA_101128
taacgtggtcgcggccgaggtccgccgaggtcaanntattaactgggggacattcannnctacccttaccgatgccttaattgatnntctgcaacctattcnnnttctatacgacgagatcatgtctgatccnnnnnanntggacagtgctctgctagatggggcaaggaaagcttctgatatatcatattccaccctcaacaacgtctaccaagccatgggtttcttgcgcagatagcatatgnntaacannncacaagaactacgggtacctgcccgggcggccgctcgaa

SEQ ID NO: 101129 - DNA, 383 bp, Triticum aestivum
  Clone ID: PAT_TA_101129
gcggccgcccgggcaggtacgacagactcaccatcttccggtcagtaaggaaaatcacattgtattccggatgaattgcaaacatctcatacttacaggagccatcctcttggtcacgatccttttcttcattggagtccatttcttcaaagagttttggaacgtcaactgtgtgctttaggatccactctccgctgacataatttttgagcacccacacagagagctcgtaatcatggggatccatataccaaacatgaaggagtccctaagagcaccccaccgaaccataaccaggtgtggcccctagcattccatccgggccatcaatttgcgggaaaagctccccctcaatgtctagtacctcggccgcgaccacgcta

SEQ ID NO: 101130 - DNA, 242 bp, Triticum aestivum
  Clone ID: PAT_TA_101130
tagcgtggtcgcggccgaggtactcctcgccaagcgaatcatccaccagctcgtcgcacctctgctctctccacagctgccacgcatatttcctgagctcgtatgatcttccggataattggtaggaaccgacggcgctcttcccacttatgatctcgagaactaggatgccgaagctgaaaacgtctgaccttgttgagtagacattctgggagtagtacctgcccgggcggccgctcgaa

SEQ ID NO: 101131 - DNA, 543 bp, Triticum aestivum
  unsure (1)..(543): unsure at all n locations
  Clone ID: PAT_TA_101131
tagcgtggtcgcggccgaggtactctatgagatcctcaccggacgacgttctatggataagaaccgccccaagaatgagcagaaactgctggaatgggtaaagcagtatcctgccggaagtaagcagttcagcaagattatagatacaagactcgaaggccgttactctaggcagggaactagagaaattgctaagttggccaacacctgccttgcaaagcgctcaagggaccgtccaaccatgagacaggtggctgacagcctaaagcaagtgatgcagctcaagcagttggatggcgaaagtgtcacatcagggggcaactcgccacctcatgatgtccagggtaagccaacagcagacgatattgccgtggcttcagcaaggcggcggatgcttcaccttgctnntctaggtgaaaatggaaacagcatcgcaaggaggagattcatgttcatgnnnnctgccgctgctccaactccaacgtgatcttctgtaacaattaatgtcctnnnctccatgtacctgccnnngcgggcnnnnng

SEQ ID NO: 101132 - DNA, 288 bp, Triticum aestivum
  Clone ID: PAT_TA_101132
tagcgtggtcgcggccgaggtctggaatgtgggggcttctagcgctatgcctcccaaacggcgataggattcatgtgatgctatcacccggtaatttgtcttcaatttgttaatcttgtaagttttctgggttagggtgaacctcaggacttatcgtgatttctgtttgagttttctgcaggttttagctttttaatcctgtaaaatattctgggttaggcggaattctatagttcaatcttgcattggccagatcatgttcccgtacctgcccgggcggccgctcaa

SEQ ID NO: 101133 - DNA, 269 bp, Triticum aestivum
  unsure (1)..(269): unsure at all n locations
  Clone ID: PAT_TA_101133
tagcgtggtcgcggccgaggtacctgttgatcggtgtcggtgaggtgttcacgtccatcgggcaggctgagttcttctacaaccagtctccggattccatgagaagcctgtgctcggctttcgcccttgtcaccgtgtcgcttggaagctatcttagctcgttcatactgaccctggtgtcgtatcttacgacgcggggggagcagatggggtggattcnnnncaacctgaatgaaggccacctnnnccgcttcttctnnnnnnttgct

SEQ ID NO: 101134 - DNA, 295 bp, Triticum aestivum
  unsure (1)..(295): unsure at all n locations
  Clone ID: PAT_TA_101134
aaccccaaactggcaactttatatatttttacaattttaaacctttgccctttgtaatatggggttttctgacaatttgctctgcattttttacaaggatgctttatttaaaaatcctttttttggaactatcccatccctgatttccttaaaaagggcttatatnnctatcatacatgtcntttgaactgacctccatttttgaatctnnccaatgcaacccccatttttgaatggcacctatggttggataaaactccnntctaacccaanngtgtaccntnccgggcggccn

SEQ ID NO: 101135 - DNA, 531 bp, Triticum aestivum
  Clone ID: PAT_TA_101135
tagcgtggtcgcggccgaggtacctgttcttacccctgggttttcatggatagagatctcctacgccaggccatattctttggagtgtttacagaaagaaggaaatttatcgtcatcacatgctacaaatgataacttcggtccaagtccctgtgggggaacttttgtttatgttggtgatctgtcatcgacagcaagttctgttaagttatccccctacaggccccgatgggcattcttccttcttattgcagatgttccctatatcttggaaaattgtttaagctgtttgcttcatgtgtctgcggcattggctgccgttaactgcctaccggtatactttctagatggggacgtgattttggagactgccttacgctacgttgcttggtttaaccggagacagcagcgggtgattattaaggtctgccgctttctgtggaccgtcctatccatcatcatgttctcaaggttcttatattccatgacagtatattatggctaatgtacctgcccgggcggccgctcgaa

SEQ ID NO: 101136 - DNA, 303 bp, Triticum aestivum
  Clone ID: PAT_TA_101136
tagcgtggtcgcggccgaggtactcttttgggctcggaggaggaggaagaccacagatgaggagtctttacgggttttgcaggaagaggattgcttcgagtggaggccttacctgcacaactctctcaactggactgaacctgggtggttcagcaaggaaaccgtcttggtgagctctagaggtaaggataagcccgagtggttggaggattaccttgcaattataaggcaagcggcgttgactggattgtgcggtgatggcatgtataacacggcaatgtacctgcccgggcggccgctcaa

SEQ ID NO: 101137 - DNA, 212 bp, Triticum aestivum
  Clone ID: PAT_TA_101137
tagcgtggtcgcggccgaggtacaatatctgaaaatatggcttcctgtgctgcgatgctaattgttgagttggtcgatggtttgtctgaatccaccgcgatgttttgaagagatgactcaccctcggcacatctgctgttgtagcttgcactatcctgtagctggagtgcaacctcaaggttccagagtacctgcccgggcggccgctcgaa

SEQ ID NO: 101138 - DNA, 192 bp, Triticum aestivum
  unsure (1)..(192): unsure at all n locations
  Clone ID: PAT_TA_101138
gcggccgcccgggcaggtacatgatgatacattttgcctcacaatttatcccacagatttgggctcacaaacatgctcatctaaagctagatgtcgcaaaatttctagtcctacatggatactagtaaattttgcacatgaaagctgaaancnnntgnncatcaatactatnnatttatcngcannnngctn

SEQ ID NO: 101139 - DNA, 425 bp, Triticum aestivum
  Clone ID: PAT_TA_101139
actacgtgtctcattaataaaataaagattcagttacaagccacataaatatcgatattacaagactgaaaagataggataatcctatgcaaaaaccagcacatgtccctctccaccaaggaaaaggagacatatcacctcttcacacgagctcgacgcagctccatcgctgatcagcagctttacgcacctcaaaaatagtttgcgtgaagcaaaaccattgccgttgaaagaatcagatcggaccaacatgttcccagacatgccatcgaactccagaactgacaccctcgcacgactatgacgtcggaggaggaaaccaggactatcagacttcaacaacaaacccaacacaagatgcgccatcttccagctgtcacttgcgtagacaaccgtttgcgcgtacctcggccgcgaccacgcta

SEQ ID NO: 101140 - DNA, 332 bp, Triticum aestivum
  Clone ID: PAT_TA_101140
gcggccgcccgggcaggtttcgcatttgccactacgaggaaatctttcaaacctgtagtgaactcgccggagagtcggggaccgtacctcatgtaatgtgccttcctggtagttaactctgctacctgaaatagttatacctcattctgtctgtcaatgtgtctggttgttgttgagtttggcatcttgtagacataaacaattggaatatgtggcatagaaacgccttccactctgacgagagatggttgacggcaaaaatcatttttttgaggaacagttggtcactttattgctcaataataaggggtacctcggccgcgaccacgcta

SEQ ID NO: 101141 - DNA, 153 bp, Triticum aestivum
  unsure (1)..(153): unsure at all n locations
  Clone ID: PAT_TA_101141
tagcgtggtcgcggccgaggtacacaagtgcacgataacctcttgtagtgaggttgagatggtatggtatactgctcggtatctcatatgtgtaggggagccctatgttgcattgtatccactcattggttgttccctccttgatcccannng

SEQ ID NO: 101142 - DNA, 564 bp, Triticum aestivum
  unsure (1)..(564): unsure at all n locations
  Clone ID: PAT_TA_101142
tagcgtggtcgcggccgaggtacacgtcgagaagagcctcgttcgtcaggtcgaacaggagcagctcgtcggccgacatgtcggtgaagtcgatggccgcggcggcggcatcgtagtgctggcagtcgtcctcctggagcgcggcgcggttctgcgagcaccaagcttcgaacagcgcctcgtcgcggaagctcgacttgttgaatatgtccttcacgtaggccagctcggcctcgttctttgggtctgctgccgcttcttggagggcgttcaggtcgctgaggttgttctcctgaagtatgttctccagagtcaatgagctagttggtggtttgacagaagtgctagaatcgagatcatcatcactgccaactgaatgatcgtgcacttcatttgaatgggcagttttttccaccagcgatgaatcatccagcatgatatggttctctgaactagcagcaggatggtctgagaaggccacatccagaacagaggttggactttcagtttcttgttcacagtataaatttaactcatcttcagtatctctatnnnnntcagggg

SEQ ID NO: 101143 - DNA, 348 bp, Triticum aestivum
  Clone ID: PAT_TA_101143
tagcgtggtcgcggccgaggtaccatcctcactcatatacagccagggttcttctcttcagaaacaaactaacatttcccgacctagctactactaatccccgagaactgtctacaagcgaggtcgatctcttcctccgtcatctcaattgtatcatcgctgtcatactcagcgtcgtccgtcccagccttcccggggcgctccttgcccttcttgtcaccaccgtccatgtgcgcaagctcggcctggtagattttcttgcatttggttgctagtttggccagctgctctttagacagcgatgagccctctctgtccagccgcaacctgcccgggcggccgctcgaa

SEQ ID NO: 101144 - DNA, 430 bp, Triticum aestivum
  Clone ID: PAT_TA_101144
tagcgtggtcgcggccgaggtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataagtaagaaatccccagacaaccctctgaacaaggcaactgagtgaggatacagtcccagtttcgtacctgcccgggcggccgctcgaa

SEQ ID NO: 101145 - DNA, 413 bp, Triticum aestivum
  unsure (1)..(413): unsure at all n locations
  Clone ID: PAT_TA_101145
gtttttttttttttttttaacatcactttttgccctatgatttcaaagggaaacatatgattatttgcttttggaccaaccaaatggggtttcaactccacatgaaaaataccatgtaggaactgaaacatacatccaagcttacaaaaccaaaaagtcaagcaaaaatttgatagggcatttaagccacaataacattcaatcacgtttgtatgcnntgttggtaaaaccaaatgtgtcaatgccacaataacatccacatgtccaccgtcatgcctccgcgggtcctcctgnaaaccacccccctttaccaagggttgtgccaacaaaaataccctgaccccacggcttacatgtaggttctgcactggccnnngccatggcgtgtccccaccttcctnntcgnnnctgtg

SEQ ID NO: 101146 - DNA, 207 bp, Triticum aestivum
  Clone ID: PAT_TA_101146
ggaccaaaatcacaaacgacctactgattcacaaccttgcagctcagaccagagtaatacacaaacacaagacgggtcaagcataaatctacaggaccaaaaaagttacacgctgcagcgcaaaccgcgcacccgttacgaactttatatctctatgaacagctatacttacagtcacaggcagacctgcccgggcgggcgctcgaa

SEQ ID NO: 101147 - DNA, 275 bp, Triticum aestivum
  Clone ID: PAT_TA_101147
tagcgtggtcgcggccgaggtacagagacggccggcgggacagctcgtcgcgcaggccatgctggccctcgtcgacgtttcctactgattcatgcctcatcgtcaaggtagttggttcttggttgcattcttgagttgttcaggtctccgcgctctggtctggcggagctcctcttcgataggctagtggttagccattttcggtcgagcttgcttgcgcataggcacatagctgttccaaaaaaatattgtacctgcccgggcggccgctcgaa

SEQ ID NO: 101148 - DNA, 363 bp, Triticum aestivum
  unsure (1)..(363): unsure at all n locations
  Clone ID: PAT_TA_101148
cggggttaaaagctaattttttttttttatttttcaaatcaatacaaatggcatttatgttcacaaaacgctgtcacacatttttctttccagctgctttttttgacaaattcgacagggggattaaatatggaccgttttttttaccaatacaaccgccacagcccacaggattggtttaaaaaagcacaacaggcctccttgcacaaaaaaaccagtatgacaggccacaccctttttaccacatcaaacctacagttttgttattttggcggaacacatttgggctagtcatacagccccttttgctcccaaatgtccacgaggaaataaaccatttacctgcccggggggccnntcaaa

SEQ ID NO: 101149 - DNA, 244 bp, Triticum aestivum
  unsure (1)..(244): unsure at all n locations
  Clone ID: PAT_TA_101149
tagcgtggtcgcggccgaggtattttattgaaaaagatcgagcgcgagnnctatttgacactcaggactgggtatccatgccacgagtaataccgggaactacatgtggcattcatgtttggcatatgccanntctgaccgnnntctccggggacgannnnntattacaattggggggaggaactttaggacatgcttggggaaatgcacctggtgcaggaccataatcgagtggctttnnnnn

SEQ ID NO: 101150 - DNA, 416 bp, Triticum aestivum
  Clone ID: PAT_TA_101150
gcggccgcccgggcaggtacatgcatcttttctgcactaggctgggattggaggtccccttattaactttgatggggcatttgttggcatgaaccactatgatggaagtgaagtaactcctttcctgccaaggcgtgggattgttcaaattctgaaaggagagattaattggcgaagacaaagtgggctctccatggacatactgcatggtgttggatataggagtcagatagaccggcgaaggtggcctgtgcctgagccgtattggcaccatgatctacttggtatggacaagtatgatttacacccgcatgttggaagacaactctagtaacgtcatgctgttggagtgctatcgtctggttattctcgtgcttgttttctaacggacctgtacctcggccgcgaccacgcta

SEQ ID NO: 101151 - DNA, 358 bp, Triticum aestivum
  unsure (1)..(358): unsure at all n locations
  Clone ID: PAT_TA_101151
tagcgtggtcgcggccgaggtacaaatgcacttccttttctgcaagttccagatcttggcagtgcaatccatagagccactgaccaaatagtgtttatctcctcgtctgataaaatccaggcagcgcacaccctcaaaatgcccaatcaaagaatattcagggtgctccgaatcaagtctccaaacctgaacataattaagactatatatataacgtcaaagtttgcttgcaaaaagggagaaatccggccagacaaacctttatttcgccatcatcatgaaacccacccgtgaaacatttgtcgtccccannnnnaaatgccactgaccctnnnttattataagtctgaaattcttg

SEQ ID NO: 101152 - DNA, 296 bp, Triticum aestivum
  Clone ID: PAT_TA_101152
gcggccgcccgggcaggtaccaaagaaacctattgatcggggtccttgctgctgaatagccagcaattcctgaaggtaatcgagatctgggagtggcttgtattctggagcatcaactgttgcagtgcctctaacaagagtctctacttgagtaggaatctttgcaccatcgtcatcatctggcccaaacataataggttcgtcttgtccttgagttcctccatcaccttcatgcccatctcttctcatgtatcggcagagaaactgagtggccgacctcggccgcgaccacgcta

SEQ ID NO: 101153 - DNA, 242 bp, Triticum aestivum
  Clone ID: PAT_TA_101153
agggaaatctttcattcttacatattcatcactccctccctaggggaaataaatgaaacaattacagggaaacatgcccccacccatacccacaaggaccccatgggcaaaacataggcggagagcgagcaagcaaattacacccccacccccccttgctcgactccatcaaatcaaaccctcgttattcaagtatacttttacaccatcacacgtacgtacctgcccgggcgggcgctcaa

SEQ ID NO: 101154 - DNA, 536 bp, Triticum aestivum
  Clone ID: PAT_TA_101154
tagcgtggtcgcggccgaggtacccatatttctctctatgccctgatggagtgatgcagtagttgcatttgccaaattaaaaatgcatttattttccatctgcaatgtataactaagatgctgtatccaaataatcatttctatgcatttatgttttgcattcccatcctttcttattgtttagtgtattagtccatttagactagcttcagtttgaaagaggactctgtctacctttcttgttgtgaacagccttgcattggaagattttaagaatgcgcgaattgaggaattatctttaaacccaagccaagaaggtgctctgagcaattttatcaactacttctgggatcggttgtgtgaccataaacaacgatttacatataaacatgaaaagcatacttgccgcctgttagaatttcagagacctaataaacagccaccgagatggatgttgattaaattgatgaaagatgctgcccgagccggtatttacatgagaagtgataatgtacctgcccgggcggccgctcgaa

SEQ ID NO: 101155 - DNA, 340 bp, Triticum aestivum
  Clone ID: PAT_TA_101155
tagcgtggtcgcggccgaggtacacaggcttctaaagccactcgattagctgctgcaccaggtgcatttccccaaggatgtcctaaagttcctccaccaaattgtaatacagaatcgtccccaaagatttcggtcagagctggcatatgccaaacatgaataccacctgaggctaccggtataacacctggcatggatacccagtcctgagtgaaaaagataccgcgagcacgatctttttcaataaaatcatcgcgcaataaatcaacaaaacctaaagtcatttcgcgttccccttctaacttacctactactgtacctgcccgggcggccgctcgaa

SEQ ID NO: 101156 - DNA, 214 bp, Triticum aestivum
  Clone ID: PAT_TA_101156
tagcgtggtcgcggccgaggtgcgtttaggctgccatctcaaagaaaagaaataacagtttgagtaagtcattacaagaaatatgtaccacttggggttggccacctccatgaaggtcatcaggtgcatccgctcgttctccgcctcctccagcagcgcccggatccagccgccgctctgctcgaaccgccacctgcccgggcggccgctcgaa

SEQ ID NO: 101157 - DNA, 321 bp, Triticum aestivum
  Clone ID: PAT_TA_101157
caataatacccacattttattcttcaatcaaaaggaggtaagtgtaaataaaaaaatatgtcatgaccaccataaagaaaaacaattatcaaatgacaagggaaagcgtatttttgcacaaattactattcatgcacctgaaaaatcgacacaaagtaaagccaataaagtattgagtcaataatatcactatcatctcaaggttcttcttctatctccgtccttctcacctcctttccgagcaaacctactgccccatccaaatcaatctcatgtcttcatcgaccacacaaccaaagtacctcggccgcgaccacgcta

SEQ ID NO: 101158 - DNA, 461 bp, Triticum aestivum
  unsure (1)..(461): unsure at all n locations
  Clone ID: PAT_TA_101158
gaaaaaaacccccaaaaaaaaaaaaaacggggggggaaaaccttttgttttttctttgggaacccaaaaaacaacaaaaatttttttttttacgggggcccaaaaccgggaaaaccccctttctaaaaaagttccccaaattgcccccactttttctcccccccaaaaaatccccgggggggaaaaaaaaaaatcaaacaaaggggtcccccccctccccgggggggcggttaaaaaaaaattcccccggcccccctggggggcgggaaaattcaaaatggggccccatttccccttaaagggggggttttaaaaatcccggggcggggttttaaaacncggggaaggggaaaaccccggggttacccaaattaaangccttggaaaaaaaccccctttnnccaagggggggaaaaaaaaaaaagcccccccccaccccccttcnnnnaaatgnnncnnnc

SEQ ID NO: 101159 - DNA, 488 bp, Triticum aestivum
  Clone ID: PAT_TA_101159
tagcgtggtcgcggccgaggtacaaataatacagaaacttcactagatttcttttcatcctcacatgatacctcttgtataatttattcctcatccactgttaagaaaaagaacatcaagtgaatcattgggatctgtttcttgcatatacttgtgaagcccagtggctatcataaaaaaatctggtaacaggagcactttgatttgtagctgctattgtcatatctactacttgtggttccctcaaattatctatatctgctattgtcatatctctattcacatgtaacgctgagatataacgctgccaatttgggaaaatagcgcagtcttaagaagcatgctctcttaattataattgtttttactagaaaacaactgatcttaggatgttaaagacttctgtcatatcattcttcttgaaccatgtgttgctcgtggtgtttatctgatgcatgtacttgtacctgcccgggcggccgctcgaa

SEQ ID NO: 101160 - DNA, 396 bp, Triticum aestivum
  Clone ID: PAT_TA_101160
gcggccgcccgggcaggtacacaccctctcttacataagaggatctaatcataactttctgaagagatcatatatttgaataataactaggatgtctggcccctaactagtgcgtaaaaacactgcaatctaagatgcttggcagttgacaagcatatcatatgatggtaggaaggaaataacttgataaaagcatgcccctgatttgctccactgtgtcaaaggacaccacattctgaacagtaaagcagtacaatcggggaggtaattatttttccttttgtcatgtgaagcccaacactatgctcttaaccaggtatggatctttgagagtatccttcatggtgaatatggagaagtaatgaatatccaagtacctcggccgcgaccacgcta

SEQ ID NO: 101161 - DNA, 355 bp, Triticum aestivum
  Clone ID: PAT_TA_101161
tagcgtggtcgcggccgaggtacagacagcgtagcagcatgttcttgcttattattcacatgatgtactaccatatactcgcaatcatttgtataccttacacttttcatatcattacacatacggatgagccctaccaaccaccactacaaatccacaagtatattatactaattaaatggaaaagaaataagtagtattgcccatactcccaacccacaagtctacctgtcatctaatcatgcacatgcggccatggccgaccagcaaggaacgaagtataatagacgaattaactagtcctccagctcggccttcttgggcacgccgaacacctgcccgggcggccgctcga

SEQ ID NO: 101162 - DNA, 347 bp, Triticum aestivum
  Clone ID: PAT_TA_101162
gcggccgcccgggcaggtaccatagaagagcagaagacagagctaacacagcagatacaaccgctgaggcagcacgctttctgccaggttctccagctccaggagctttaatgaacctatcttgcaagaacaagataaagtttgtgttgatcaaattttttggtggctggacaaggaggataattctactcgcgtgtttgatcacggccatgatacatttgaagctttcttcaatgttaatgtcagcctatgggtcaacaccagttgccttgtctcctccattaacatggatgccactattactattaagtgttgctgcctactgtacctcggccgcgaccacgcta

SEQ ID NO: 101163 - DNA, 318 bp, Triticum aestivum
  Clone ID: PAT_TA_101163
gcggccgcccgggcaggtacaccatcttccttccactgtgataagcccagatatttacaaggatttccaggattcgacaatagcagtgccttttctcaggttgtgatgctccaagcaagcatgaagctggctcggtattgtttccattcaagctatgaagcgaatcaacaaacatcctcgtgaacatgatgaactttaaaaatgacggggtgtgcattacccaactatgaagagtagaccaataatcgccatcattaggcattggcggcagggctgcaacgccctctggtaatccgtacctcggccgcgaccacgcta

SEQ ID NO: 101164 - DNA, 363 bp, Triticum aestivum
  Clone ID: PAT_TA_101164
tagcgtggtcgcggccgaggtacccttttgccccgtaaactatatatactcttctcctacctacgttttagggttagcattagtttaactcatattttgtgtgagagccttgctcatccacttggttacttctcctcggagctcacgacctcttcggagaagatcccccaagcggattcaagaccccttcaagggaagacaatcaagacctcctcacggagaagaacggttctctttgtatcctccccttgttgattttggatcatgtgttaccttgggctttcggtgatctagcccttgtgtgatcgattacttgtcggtttagtgattctcccgtttctccctgtgttgaaaaaaaaaaaa

SEQ ID NO: 101165 - DNA, 359 bp, Triticum aestivum
  Clone ID: PAT_TA_101165
tagcgtggtcgcggccgaggtactacggctacactggtcagtagatagatttactttctgcttggtttgtgatgaagtggaaaagacagaatctagttttcctttgcgtgtcccaggtggtttgttgctagtgtagatgatctgcgtgttgttgctggagaagcgccattgacaatggagtagcaccgatcggagaactgtagcagatcttctcgaaaatacttgcagggcaagagcttgaacttgaaccggagaactggatgcaaatctttctccaggatacttacaggttaagagcttgtattgcgcatcatcatagtgagcacggcgtggttgtacctgcccgggcggccgctcga

SEQ ID NO: 101166 - DNA, 460 bp, Triticum aestivum
  unsure (1)..(460): unsure at all n locations
  Clone ID: PAT_TA_101166
tagcgtggtcgcggccgaggtacgtaatcatttgaggaggaagagattcaccgaggacgacatcgaagtatgcggtctcccccattccgtttagctctgcaatgtcaagtttgtcttcatagaagggatcagattcagagatctccagcgtcagagtatacgagtcccttgacgagttttcttcagtgaacccatagtcaagtgccaattcagcattactcttgtccaggtcatactgaacatatatctgttctccagatttaacctccattggcgttcgcaaagagaacacagtatccctgcctaaaaagccctttcctttgatctcccaacaggattcttttgaggtaatatcaccattgtgatttatcagatcagcaaatggtatgagggcaagcttatctccacggagctcagggaaaacccttgatcttagtacctgcccgggcgnnngctcgaa

SEQ ID NO: 101167 - DNA, 331 bp, Triticum aestivum
  Clone ID: PAT_TA_101167
gcggccgcccgggcaggtactggaagcattttgcggcttctttcaagcacaagttcctgtccttccgagaccagtgcttgctaagctcattaagcttctccctagcatcttttagtaaaatttctgggtcagaatcccatttgtagaactccagcaatctcccatccaaaattttgtcgcacgtctttttaccaatcgccaaccctccagttgtatgagaaaaataaagattgtaataatgggaaaggaaggccggggcactgctcccagccaattcagacagataagctgcatatgttgatccaaaagtacctcggccgcgaccacgcta

SEQ ID NO: 101168 - DNA, 290 bp, Triticum aestivum
  unsure (1)..(290): unsure at all n locations
  Clone ID: PAT_TA_101168
gcggccgcccggcaaggaaagggtcgcccanaaaataaactcccaaggttaattccnnaatgatttcctcaaccaactgcaactgacccttaccaaaactcaaggtggagtgaaaaattacctgccaaanatgaaccaaagccttattcaacaaggctccaatcatattggccctggtggcctatttgctctggtatggttctttggtggctatcttttggcaaaattctctaaaaantnattattctggtaagggaaacccaatccaatcaactgaaatggacctgata

SEQ ID NO: 101169 - DNA, 558 bp, Triticum aestivum
  unsure (1)..(558): unsure at all n locations
  Clone ID: PAT_TA_101169
gcggccgcccgggcaggtacggtggaacaatcaaacccacaatccctttccgcagcttatacctgaggttagcattaaccttgcatgtcatctggcgtctgcagatgatacaaaattcagcactaaacttatccaaacggtctaggtggttcatcagaggcgcccagcactcatccaagtaactggccttgtatcgacggaacatcgcactgagcatactctccagttcttcgtttgaaaaggctgctcctcgaccacgcataatcagcaaaacatcatatgcattgctgaacaggaaaatgtatactctacatttttcaccctgccatatccttcgcgcatccccctccagcttacaggcccagccgtcaagcatctgagagagaaaatcagcggtgcatccgatggcatgtgctgattccagagcttcaacgagatgtctgtttgctanntgaattgtggattcttcgacgtcatctgcgctgagaagtattgtcccaaaaccatccaccatcttctgannnataccagcagnntcaccanntctgtcgaatgtag

SEQ ID NO: 101170 - DNA, 585 bp, Triticum aestivum
  unsure (1)..(585): unsure at all n locations
  Clone ID: PAT_TA_101170
gcggccgcccgggcaggtacattcctcgagaaacgatcccaggaaatgaataacaagatggagcatcaacttctgtaatagaaaaataatacaaaagaataaagctctgaaaaaaaatcttacttgctcacattgagagataaaacgatagtgtgttgttactgtccaggttgacaattatagagtcatcaatagcaagtgtagtcttaatttatagaaggacaatataaatcttgtatatagaactcattcaacaggtttaggagcctaaatgtaagaacatgtattgacatatctttagtattataaatgaagataattttatggtctattgacgccatttgataaattaaaaagaaggttcttacctgccactgggatgtgaactattgtctagaatttcagataaccatgcacaatatttggtcgagtatcggtgtgaactcacacatgcacacacacacaaacaaagaagccctcgtccaacccggaaatgaaatcttgcccacgcactccgcnnncgagctcgtccaatctcactgccactccgtctccctggctnnngtccacctcgnnnnngannac

SEQ ID NO: 101171 - DNA, 232 bp, Triticum aestivum
  Clone ID: PAT_TA_101171
tcgagcggccgcccgggcaggtagaatgagaccgccctcatgttggccgtcgctcaccagccagtgtccatttccctcgacggtagcagcgacgtgttccgctattttggcaccggagtctacggttcggcttcgaagcggctggagcccggcgctcccaacaagccgtgcaataacactgacctcaaccatgcagttacggtagtagggtacctcggccgcgaccacgcta

SEQ ID NO: 101172 - DNA, 267 bp, Triticum aestivum
  Clone ID: PAT_TA_101172
gcggccgcccgggcaggtaccctgacgcctatgtccgcgtcatcggcttcgacaacctacgccaggtgcagtgcgtcagcttcattgccttcaggccaccgggttgcgaggagtctggcaaggcctaaactacgagttgaaacaatggcctatgtatgaaggtcttttgtgaacttcacttttgtccacgactctgctggacgaccagagcatatttttcattctatatggtctgtgtatgtatgtacctcggccgcgaccacgcta

SEQ ID NO: 101173 - DNA, 257 bp, Triticum aestivum
  Clone ID: PAT_TA_101173
gcggccgcccgggcaggtactagtaccgcaccattgctaccaagagtgcttggtggactgtttggaggtaggtcatcatttagtggaacaccatggaacagggtgcgccataatattagagaacctcagagcacacttgtgttaaaccatgtgcctattaggttagcccctgtgaacctacctgtagcaaggccagaactagtagaagagcaaaatatcaaaggcacaggaactgtacctcggccgcgaccacgcta

SEQ ID NO: 101174 - DNA, 424 bp, Triticum aestivum
  unsure (1)..(424): unsure at all n locations
  Clone ID: PAT_TA_101174
tagcgtggtcgcggccgaggtacagcagaacaatagacagggccaacaaattatcacacaagtttgcgctacgctagtcttgttggcagacgaccgcaaacatcacggtatcctagtgcggagctactggatcaagtcgctttgagcttggattgcacagctcaggccattactaattttcatggactcgtcgtgcgtcttgtgcttcttcagaaactgaatggtaatcaagaggagcaaacagcgcctgcgttgaacacaaaacaagctcaattacaaccaagagtcgctataaggtccatccgtccgtcctctcaccctctgcaagatcaaacttgctcccccatctccagcatagattttcttcccttgagcgtcatcttgtaacaacgatgactcccacctgcccgggcgnnngctcgaa

SEQ ID NO: 101175 - DNA, 494 bp, Triticum aestivum
  Clone ID: PAT_TA_101175
tagcgtggtcgcggccgaggtacaagtacaagaacgacgttcaccgccccttgtatggggccctgccatgagccgctgataaagctaaagaccaagcacacaaaacaaagtgctacaagcaaaatgaaacctaaacttatgaccgtcttgtcattcctattcttggcgagcaacccaatgatcatcaaggacgtgtagaaggccattatgttgccggtctggaaaattgcatacctcgagcgagatttgtcacgcatgattggctcaccagcaatgaacttgttgtccttgtcgtcggtggaccagaaaccaccgggtggggtgagccctgcagtgaaggtgacggtggcaaccagggaagccagaagcagcatccaagaacggaaagcctgctccttcttttctttgtcagactcgctgccctcgccgcgattggtgacgacggggtctgctcggagaacgggcccaggtacctgcccgggcggccgctcgaa

SEQ ID NO: 101176 - DNA, 263 bp, Triticum aestivum
  Clone ID: PAT_TA_101176
tagcgtggtcgcggccgaggtacagctgccatttcacaggtctacagcacctagccaaaatctggtaaacccacccatcagaaaaaaaatctggtaaagctgcattggcagtgcaccactgtcccgaattgcaccagctacactttccaacaccggtcacacatgacacgtcaaacattctgccggaagatcttcggtgcgtcaatcgggttattgctgctggtggcgaggcaatccggcacctgcccgggcggccgctcgaa

SEQ ID NO: 101177 - DNA, 241 bp, Triticum aestivum
  Clone ID: PAT_TA_101177
tagcgtggtcgcggccgaggtacagcaccgagttctccggctgcgcgtccatccagcgccggtgctcctcgtcacgggcgctctcccctttgtccggcgcacgtaagattgaaaggccgattggatagattggggagcgaagtaactctgctattgtgttcatggaactgggctcgagctcgtggaatgaggtgaagatgacgcactgcgctttgcgtacctgcccgggcggccgctcgaa

SEQ ID NO: 101178 - DNA, 355 bp, Triticum aestivum
  Clone ID: PAT_TA_101178
gcggccgcccgggcaggtacaattgcaaggcagtaaatatgcaattcaactctatttgtggaggagactgcactgtgcacttagtagggcagcggactggtgcattattcggtgaattatgatgcgacccggccagcagaaagctgttacagatgataatagattagcatgtgaatgtgcaatacacggtccatgaattttactactgacttggatcaattttacgctccgtaattttgatacaggcactaaaccttgttttgttccatagctcataatgtcaatagaatagtctgcattagtttacaagatagggtcacaccaattctgctgtacctcggccgcgaccacgcta

SEQ ID NO: 101179 - DNA, 299 bp, Triticum aestivum
  Clone ID: PAT_TA_101179
tcgagcggccgcccgggcaggtactagaactttattttattgtctaataaacagccgcatatactcctatcattctattaggtaaatagactggcgcgacaatgcgtgccttcaatgatctagttgattagtagaggacatgtttattttttgtaggtagtaaatgacgtggttgatgtttttgaaaaaaagggctccacttttccttaaaaaacgattaagattttttttgtgagattcttttaccccacaaggatttattgcacgttcagattagtacctcggccgcgaccacgcta

SEQ ID NO: 101180 - DNA, 378 bp, Triticum aestivum
  Clone ID: PAT_TA_101180
gcggccgcccgggcaggtacaaaatgtggttgccttgaaccattgctgacacggatcacattttctggccggatatcaccgtgacggattcccgcagatgatgcagcagcaagagcagataaacagtcatggcaacatctcagagcctcctcaacaccaaacaatccattccgtatcagatttgaaatggtctccccaactggtgaggtgacaaggattggagtgctgcacagtggatgaccacaactcccactggagttcggcttgttgcacaggcctggatggcctacacgtccagaagctaccatctgtggtatgtatctgctagaaatgtccctttgcttcatcaaggtcagtacctcggccgcgaccacgcta

SEQ ID NO: 101181 - DNA, 360 bp, Triticum aestivum
  Clone ID: PAT_TA_101181
tatcgtggtcgcggccgaggtacactgactgtaagatcctgttggttgacaagataatttctgatccaagggaacttttaagggtatgctttagtgctgtaaaagaagattttccattgttaataattgctgaggatgtcgaagaagaagcattggctactttgacgagaaacaagctatcagggatgatcaaagtggcagcaattaaggctccttctttcggtgaacaaaaaacccaatgcttagaagacattgcaatcataacaggaggtacttcagtggaatgccagaatggaatgcgaaagtcctccggaggcatggcgatgaatttgaacgtacctgcccgggcggccgctcgaa

SEQ ID NO: 101182 - DNA, 622 bp, Triticum aestivum
  unsure (1)..(622): unsure at all n locations
  Clone ID: PAT_TA_101182
gcggccgcccgggcaggtacatatctcgtgcaagaagcacctcgtcgtggctaaaaccatgtccttccagcctaaggacctcaaggaactcttcatgctccaaggtgtgtgcgagtggcagtataacctgatttcccatgaacccaccagctcttaaacctggaaccgcatatgggctggccctcaaagaggcagcagaataagcatcaacgccaggatcagcccattccgagcgatgctccctcagaaatcgcacaagtaaagcaggagggacatcctgcactagcattgatgcctttgcacacaaaatgccacctccgatagcagaaaagagcggggaggggctgacgtgggatccgacaagcttgtttggcgatgagtttactgtgatggtaatatcctcagcaccatcactcgtcagcaaagaccaaccatcatctggaaatccactcacagcatcgttgaagcctctgctgagcccttgactgaaggttctgagaactgcaggctggcgcccggcaccataggggatttcaccacttgattcatgcgcgatttgcctgatgtgtcgcagtgncgcaatagtcatcttctgtgcaacgatctttggagattcntngnn

SEQ ID NO: 101183 - DNA, 377 bp, Triticum aestivum
  unsure (1)..(377): unsure at all n locations
  Clone ID: PAT_TA_101183
tagcgtggtcgcggccgaggtgaaagttcatgcaagatggacatgtaacactaaagagcgaggtctacagcttcggagctattctcttggaactaattaccatgaggaagaacatatttgatgaaaaccgcatcctcgttgatgagtaccacaccacggagggcgccaactgtcgtggtattctaaggggggcttgcgagtcgacagatgccacaagggcttagtgtgnnnnnaatactgctgctgataggcccgggagcgggtatgngngtnnnnngcgctagnntatccnnnttcggggctctccggnnngataatacccctactcctgcatgtntgagtatatctggggtgtacctgcccgggcgnccnnncga

SEQ ID NO: 101184 - DNA, 269 bp, Triticum aestivum
  Clone ID: PAT_TA_101184
gcggccgcccgggcaggtactggaccacaagaggtttcatctagtgctgagcatatgatcccagaggtgcaggaacctatccaggacactcatggagaatgtcatgtgtcaaatgatgagcttcctaacatgattgtggagaaaagaacagagttagttgacaacaatcataacaatttcacaaatggtgcaccacaagtgatctcatctggtgctgagcagatgatctcagaagtgcaggaacctgtacctcggccgcgaccacgcta

SEQ ID NO: 101185 - DNA, 617 bp, Triticum aestivum
  unsure (1)..(617): unsure at all n locations
  Clone ID: PAT_TA_101185
gcggccgcccgggcaggtggatgcccgggcattgagaaggaaggacgctttcagnggcgaaaggccatggggagagatttttctgtgatccatggatctccgatcgggaaaccgtatccaagctccgtggctagtctgcgctctttggacttttcaaacttagcgaactgaaacatctgagtagctaaaggaaggaaaatcaaccgagaccccgttagtagcggcgagcgagagcggaacaagggttttcatcaaaagaaatccgaagcggtttcattcgatttgttgtggattggatgatggaaaaaccagcaagcagcaagcgtagttagaaaagttgccgtagcgcgccctacggagttgtacctcggcgcgaccacgcttagcggccgcccgggcaggtacccaacatcttaagagtgcagacatcaagccaccaaccgcacataaggggaaatactccgagttctatcaccaaaaggaaagcaactttgaccatggtcatgagatgcttcattccnnnnnngaactgcctgcatagagatggaatggcctctagtattgcagcgatgccataaagtctnnnntagtaaaacgttctccacgggcgtatcgaa

SEQ ID NO: 101186 - DNA, 194 bp, Triticum aestivum
  Clone ID: PAT_TA_101186
ccgaggtacacatggaggttgggttcgttactcgtggtggcaaaaaagatggcacctaccttgtatcttgttggccaagggtaggaagggacactttgcagatggaagggggtgttgtagggcagttactctaaaggaatgaatggaaaaaggcagaggtgtttatcatcgaaaactaaacttgcatgtacctg

SEQ ID NO: 101187 - DNA, 213 bp, Triticum aestivum
  Clone ID: PAT_TA_101187
ccgaggtacaaccacacaatcctcctccaccaccatttcgttgacaaaagcaaaaaagaaaaacggaagcaagcaagcaagccagtcgcgcgttggaatccaggaagagagaggggcagcaaaaatgcagagagcgttcgtggtagtaccacatcttccgggccacgtaatccaccgtatccgactctgacatgctcctgaggtcccgacctg

SEQ ID NO: 101188 - DNA, 407 bp, Triticum aestivum
  unsure (1)..(407): unsure at all n locations
  Clone ID: PAT_TA_101188
acacaggcttctaaagccactcgattagctgctgcaccaggtgcatttccccanggatgtcctaaagttcctccaccaaattgtaatacagaatcgtccccaaaagatttcngtcagagctggcatatgccaaacatgaataccacctgaagctaccggtataacacctggcatggataccccgtcctgagtgaaaaagataccgcgagcacnatctttttcaataaaatcatccgcgcaataaatcaacaaaacctaaagtcaatttcgcgtttccctttctaacttacctactaactgtacctngccccggncgggccgctccnaaattcgaatttccccgccgggccgccaatgnnggggcggggganncaattncaaacttccngggcccnatttccccccta

SEQ ID NO: 101189 - DNA, 208 bp, Triticum aestivum
  Clone ID: PAT_TA_101189
cgagcggccgcccgggcaggtgcgcctgccggcctgcgtgcgtgcgtggagtccatttccttaccagccgcttatcttaatcaattgtattattatttttccccgccagcgctggctagcgccgtgaagcatctgatggtttcaaattttcaataatatttttggcttttcaactttgagaggagagggaggagtggctgtacctcgg

SEQ ID NO: 101190 - DNA, 413 bp, Triticum aestivum
  unsure (1)..(413): unsure at all n locations
  Clone ID: PAT_TA_101190
ccgaggtacaagcttttttttttttttttttttttttttttgttttttttttttttttttttttttttttttttttttttttttttttttttttttttttttttttttccnaaaaaaaaaaaaaccacccananccnaaaaanggacnacnaaacttgttnaacttaccnctttaaanttggaaannaaanggggggccttggaaantttttnaaaaattngggggaattcntanntcccccaaacgttaaacaacntagggntttgaaacnaaaacccgcccgggnggccngcccaaaancaaatcccccccggccccnaaggggggccgggancaangcaaantcggggcccaaattcccccaaaaggnggngtcgtattncaatttcacggggccgnnctttttnaaaac

SEQ ID NO: 101191 - DNA, 421 bp, Triticum aestivum
  unsure (1)..(421): unsure at all n locations
  Clone ID: PAT_TA_101191
acatgagcatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgncnttttttttttttttttttttttttttacnaaaccttctcttctttatctttagttttatctacttatcaataagtatctaccgggtcnaactcgaatttgatngncttcaaactttaactcggncgccaacacgctaatccnattccccccggccccaatggggggccgggancaatgccaactccggg

SEQ ID NO: 101192 - DNA, 204 bp, Triticum aestivum
  Clone ID: PAT_TA_101192
ccgaggtactgcagagggtcaagcatgaagaccattgttaggaatagcttcatactgcagagggacagcgtttttcttttttctttttttgtcctcctttggtcgttgtttgcaagctagaaaccaaggaatctctgttataaactgtttctcaaactaaacagatcataaattcttatcagttataaatagttttgacacctg

SEQ ID NO: 101193 - DNA, 198 bp, Triticum aestivum
  unsure (1)..(198): unsure at all n locations
  Clone ID: PAT_TA_101193
ccgaggtgtacaagcntttttttttttttttttttttttttttttttttttttttttcagncccaatnnggtcngattctgatccggncnagtctcancaatccaaaccgatgggtngtgngccgctngaaannggaaaaagcaaatgttctttagggccgtanttcnaangccatgnacccantgangaaatagctc

SEQ ID NO: 101194 - DNA, 560 bp, Triticum aestivum
  unsure (1)..(560): unsure at all n locations
  Clone ID: PAT_TA_101194
actgtttggatatattaattgctgcaattatcttcacatttaaatccggtgtgcctaatatactggtatgaaatgggcaatgttgacttcctggatgaacggtaactgaatagcttgtttgctttgtacaacctttccaaggaaagaagcaattctctgttgcagtaagtttgttgcagtggttctaaggctggacatgataatatgtattttanatnacaggctgtgctaaaaattttggaggtctggtgtgggggcaattgtccncatcttttacaatttcacaattcggagttatcaattgtgacgctcccacgactttcaattnacgaanccaatgttggaaggatgttnacncaaggaacatcaatttgacaataccccccccgttcccgaaataattgtcctggggtttggccaaaataccaaaggttccaaaacctaattttaatggctnaaaaanccccntntccnaaacaaatctaanaanaaattaattccggnacngggggggaatnnttaatcctancctaaagngagcccccggtnatttttttggg

SEQ ID NO: 101195 - DNA, 576 bp, Triticum aestivum
  unsure (1)..(576): unsure at all n locations
  Clone ID: PAT_TA_101195
ccgaggtcagcagtggggaatcttggacaatgggcgaaagcccgatccagcaatatcgcgtgagtgaagaagggcaatgccgcttgtaaagctctttcgtcgagtgcgcgatcatgacaggactcgaggaagaagccccggctaactccgtgccagcagccgcggtaagacggggggggcaagtgttcttcggaatgactgggcgtaaagggcacgtaggcggtgaatcgggttgaaagtgaaagtcgccaaaaagtggcgggaatgctctcgaaaccaattcacttgagtgagacaaaggagaatggaatttcgtgtgtaggggtgaaatccgtagatctacgaagggaacgccaaaaagcgaaaggcanctcctctggggttccctnaccgaacgcnngggtgcgaaaagcatngggggaaccaaacaagganttaaantacccctgggtaagtccaatncccgttaaacgaatganttnttncgccctttgggtccancncgggatnaagggggcccaaacctaaccccttgaaacaanccccccctggggganttacttcccccgggcggcc

SEQ ID NO: 101196 - DNA, 209 bp, Triticum aestivum
  Clone ID: PAT_TA_101196
gccgtgatggttgatgatgttaatgcattccttgttttaggcattggctattctgctggctggagcaactgaccaacttccgctgtaagagtgtgtaagaatgttctgaaacatcgatagggataattatgtaattatgtttgtcattactctgctggtataattggggcatggcaatattttgtacctgcccggggcggccgctccga

SEQ ID NO: 101197 - DNA, 263 bp, Triticum aestivum
  Clone ID: PAT_TA_101197
tagcgtggtcgcggccgaggtactattaaaccaaaattgggattatccgcaaaaaattatggtagagcgtgttatgagtgtctacgtggtggacttgattttaccaaagatgatgaaaacgtaaactcacaaccatttatgcgctggagagaccgttttgtcttttgtgccgaagctatttataaatcacaggccgaaaccggtgaaatcaaggggcattacttgaatgcgactgcgggtacctgcccgggcggccgctcgaa

SEQ ID NO: 101198 - DNA, 188 bp, Triticum aestivum
  Clone ID: PAT_TA_101198
tagcgtggtcgcggccgaggtacgcgcacctgctgccattcccgttcgaccccccttcctcctcccatggccaacacagagacgcgtgaacgctctgtgaacgaactgaagcatgattattatgaactgtatataaaacagtcgaattattcagcctcgctatgtacctgcccgggcggccgctcgaa

SEQ ID NO: 101199 - DNA, 215 bp, Triticum aestivum
  unsure (1)..(215): unsure at all n locations
  Clone ID: PAT_TA_101199
tccngcgggcggccgggccaggactgcgagnccagcggctccctgnnnnnngaccccgccgggatgtccttcccgaaagnngatggaattccttgtctccttcctaaagacggcctgtcgctcgaggaccaccngagggaatcaggacatgataccatctctcgggattactctgatagaatccaccttggagtgcctcggccgggacnacgcnn

SEQ ID NO: 101200 - DNA, 243 bp, Triticum aestivum
  Clone ID: PAT_TA_101200
gcggccgcccgggcaggtacccgctgctctcatgctcaggtttatggatctggaaccttagccgaggaaacaagtctggagtaaaatcatgttttcagcgcagccgtgggatggagcacagcatgcaaatcctggagggaacccctttagattcaagctaacaatcttagattcttagcccattgttcatcttcatagattttatagcctagcagtctctgtacctcggccgcgaccacgcta

SEQ ID NO: 101201 - DNA, 239 bp, Triticum aestivum
  Clone ID: PAT_TA_101201
tagcgtggtcgcggccgaggtacatattttccttttaacgaaaatgcaacgctcctgccagttcaaaaaaaatttacgtcgttttctgcagagcctcaaagaaggaggaagcagaggaacgccaccatggcgaggaacacccatatctgccgcaacctgcgcgccacccgcctctgctggcgcgccatcctccagccctcgccgtcgcggtacaagacctgcccgggcggccgctcgaa

SEQ ID NO: 101202 - DNA, 317 bp, Triticum aestivum
  Clone ID: PAT_TA_101202
gattcctccattaaattcataaatgtttgaccaaaattcacgtgataaaggttgatacattaatcagactgtaggagcctcgacgaccaaatttttggtccgtctgtttctagtctgcgcactggctaaggcgcctgctaggcgtcatccggctgataacttgcagttatcagccgccttatctactgtccgatgtgattaatcgaggccatcagtttgtatccccagattgcagcgcgcccgcagccccgcagcattagcagagacaacaccgctccatagcagacgctaccgtacctgcccgggcgccgctcgaa

SEQ ID NO: 101203 - DNA, 258 bp, Triticum aestivum
  Clone ID: PAT_TA_101203
gcggccgcccgggcaggtactattaaaccaaaattgggattatccgcaaaaaattatggtagagcgtgttatgagtgtctacgtggtggacttgattttaccaaagatgatgaaaacgtaaactcacaaccatttatgcgctggagagaccgttttgtcttttgtgccgaagctatttataaatcacaggccgaaaccggtgaaatcaaggggcattacttgaatgcgactgcgggtacctcggccgcgaccacgcta

SEQ ID NO: 101204 - DNA, 174 bp, Triticum aestivum
  Clone ID: PAT_TA_101204
tagcgtggtcgcggccgaggtacctcttagaataaagatatatgccaaacaaagttcattagagcatcttaagcacatcggacatagctatgcgcggcttgcacaaagactcaaatggaacggccttgggcataacaaattcttctgctctacctgcccgggcggccgctcgaa

SEQ ID NO: 101205 - DNA, 264 bp, Triticum aestivum
  Clone ID: PAT_TA_101205
aaacatagttttccactaaaggacacactaattttttttgcactttttattttggaaaataagtaagcaacataaagacctatcccttgagctaggaaacaggtaacatagcactcgaagtccataagtaaataactgttttccttttttttcttgtttttcctccaagcaagaactaagctcaaggaatgaggatcaggtggtcctgaagctggtgacatggttaacatcgaagccttcagtacctcggccgcgaccacgcta

SEQ ID NO: 101206 - DNA, 401 bp, Triticum aestivum
  unsure (1)..(401): unsure at all n locations
  Clone ID: PAT_TA_101206
cacaacagaagttgaaacttctactactaacaggaacttgcaaagacgaaaacgcaggtttatacataatgacatatcctaacacgacgatcgacatggaaaacatggaaaattactgaatcaccttatgaaaatgtcgtttgcttccactcaaggacgcaaactgcctaccaacctatattattaagcacagaatagatgtaaaattgcaaagcttgcaatgtcagcaagcactaatgcggtaatggctcacttcctccgggcctcgagtgccttcttcagctcctcgctggcatcattcggtccactggccaccagctccttcccatttccatggagntcaggcttcacgggnnnnaggattttgcacctgnncgggcggccnnncaatnnnnnnnnnn

SEQ ID NO: 101207 - DNA, 300 bp, Triticum aestivum
  Clone ID: PAT_TA_101207
tagcgtggtcgcggccgaggtactacaacgctacactacacgatagctcgcatccttctcttcttacgacggagataatctcgctagtatattagttttatttccaataaacatgtgagagatgaacacattttgattattttttaaaaaataatcaacgcgaataattttagaataatgaataaatttatgaattttggaacatttattaaatcctgtaaatttataaaaaaatacaaaataatctgaaaaatgaaaaaaaaatattaacttttgaaaatagaaaaattaaaaggagag

SEQ ID NO: 101208 - DNA, 328 bp, Triticum aestivum
  unsure (1)..(328): unsure at all n locations
  Clone ID: PAT_TA_101208
atttataccttctcttctttatctttagttttatctacttatcagtagtatctaccgggtcgaactggaatttgatcgccttccatactnnncaagctggggctnnnncaggactccatttgcaagctgctcggataatntcattaccttcgcgagcaagatcgcgcccttcgttacgagcttgtacacaggcttctaaagccactcgattngctgctgcaccaggtgcatttccccaaggatnncctaaagttcctccaccaaattgtaatacagaattntccccaaagatttcnnnnnnagctggcatatgcnnaacatgaatncn

SEQ ID NO: 101209 - DNA, 251 bp, Triticum aestivum
  Clone ID: PAT_TA_101209
atcaaacagaaggcaccattttttttaaatctcaagccgatcaccattttacacaacactcaaaccaacaaagaaatccgcatcacccccaaactataaaagaacactcaaaaaccgaatggagataaatatacacgtggatcgatcatatggagacgctgttgggtatccctttccccgtgagccccttctcctggccggccacatccgggaacaagagcgtgtacggcacctcggccgcgaccacgcta

SEQ ID NO: 101210 - DNA, 231 bp, Triticum aestivum
  Clone ID: PAT_TA_101210
gcggccgcccgggcaggtactagccccaagtgcttgtgggtgcagtgccctaattgcagaaaaataccatgtgcaagtgtggtgctggttctctcctttggtattggttctctcctttggctccttgtaatatgtgttggatatgtgttcatggatatgtgttggatatatatgtgttcatgactattggtaacatgtgttggatatgtgttcatggctaaaaaaaaaaaa

SEQ ID NO: 101211 - DNA, 339 bp, Triticum aestivum
  Clone ID: PAT_TA_101211
tagcgtggtcgcggccgaggtacagattgatatatccatgtcgatatgatccagtcgtttcaaaccccagttttgcaaatatttcaaccaaaaagcatccatgttttcagtcattgcatccagaccagaccacgcagcacccagcaaaggagcatcctggtgaagcacacgcaccttctcactggtagtcctttggaacgaactccaagtcgacatggctcatctccaagcagccctaagcaatcctcagacgtttcaatcccgcaaccatgagtgagcatcatatctctggagagcgcccgccatctcccaacgtacctgcccgggcggccgctcgaa

SEQ ID NO: 101212 - DNA, 252 bp, Triticum aestivum
  Clone ID: PAT_TA_101212
tagcgtggtcgcggccgaggtctcgcggtatctttttcactcaggactgggtatccatgccaggtgttataccggtagcttcaggtggtattcatgtttggcatatgccagctctgaccgaaatctttggggacgattctgtattacaatttggtggaggaactttaggacatccttggggaaatgcacctggtgcagcagctaatcgagtggctttagaagcctgtgtacctgcccgggcggccgctcgaa

SEQ ID NO: 101213 - DNA, 230 bp, Triticum aestivum
  Clone ID: PAT_TA_101213
gcggccgcccgggcaggtaccggagtggatatgatctcccccagacatacgcaatgctttagctaatacacggaaatgcataccatgatttttctgtctatcaataactgcatgcattgcacggtgaatgtgaagaagtaggccattgtcgcggcaataatgagccaaagtagtatttgcggtgaatcccccagttaagtagtcatgcaacctcggccgcgaccacgcta

SEQ ID NO: 101214 - DNA, 245 bp, Triticum aestivum
  Clone ID: PAT_TA_101214
gcggccgcccgggcaggtcgcggtatctttttcactcaggactgggtatccatgccaggtgttataccggtagcttcaggtggtattcatgtttggcatatgccagctctgaccgaaatctttggggacgattctgtattacaatttggtggaggaactttaggacatccttggggaaatgcacctggtgcagcagctaatcgagtggctttagaagcctgtgtacctcggccgcgaccacgcta

SEQ ID NO: 101215 - DNA, 197 bp, Triticum aestivum
  Clone ID: PAT_TA_101215
gcggccgcccgggcaggtacaaggttataaacatggatcaatggatgggatttcttcggttctgcaatgagataagcttcccatcacttgacaattacgatgcagaccaagcttggcctttaattttagacaattttgttgaatggttaagagcaagtgaaaattagctctgttgtacctcggccgcgaccacgcta

SEQ ID NO: 101216 - DNA, 154 bp, Triticum aestivum
  Clone ID: PAT_TA_101216
tagcgtggtcgcggccgaggtctctttctggaattctgttgggtggtgctcttcttgtctacaatactagtgcattggcttcttgaagcctgtgcggcaaaccaaaatatgcaccaaacgatgtgtattgtacctgcccgggcggccgctcgaa

SEQ ID NO: 101217 - DNA, 154 bp, Triticum aestivum; identical to SEQ ID NO: 101216
  Clone ID: PAT_TA_101217

SEQ ID NO: 101218 - DNA, 233 bp, Triticum aestivum
  Clone ID: PAT_TA_101218
accacaaaactaccttgcataaaaaaatcaactatttccttacaggacgtggatttcaccctccaatttctcaacaaacagaaaaaccataaaccaaactatcattgcaagcaaaacaaaaagtcgcatcttcaccatcttggttgccgttcctttttgcatgactcccttctttctcaccggcgaccatcttgcagcaagccagcagcagcacctcggccgcgaccacgcta

SEQ ID NO: 101219 - DNA, 190 bp, Triticum aestivum
  Clone ID: PAT_TA_101219
gggaggcgggaaagcaacattacattacaagcaagcgaacgggtcccaactcccgtcttataatataacccaataaaaaaatttaaccctgataagggagctgcaggttacagttgtcgacacgggtcaaaaaaacccgcagctcatttgggaaatgggccgctataaaaactcgggcgggaccacgcta

SEQ ID NO: 101220 - DNA, 365 bp, Triticum aestivum
  Clone ID: PAT_TA_101220
tagcgtggtcgcggccgaggtacctctccaacctccccgcgtctcgacacctcaatctaaaagaaaatgttctcacttctactactccatttcttttgttgcaaactcaactatctagcacaagtttccttctccttggggcattctctggcaaagtgccctgctccattacaactaaaacaattacttctgacaagtatcgaggtttcctttttgggcaactgttgaggtagtgccctgactccttgcacctgtaacaggtgatatgactcaggtccttcctggaatccaatctgcttctcttcctggacctttccatgccaatcatggcttctatttcttacctgcccgggcggccgctcgaa

SEQ ID NO: 101221 - DNA, 413 bp, Triticum aestivum
  unsure (1)..(413): unsure at all n locations
  Clone ID: PAT_TA_101221
gccctgnagggggtattggctttacccaagggggggaaaaattgaaaaaaacccccccccccccccaaaaaatttacccccccctggggcttaaacaaaaaaaaaacaaaccccccttacttccttacatggcgggaacatacccagcccaaaaaaaaaaagtacaaaccctaataaaaantaatacccgcccgggggggcgcttaaaaaaaaaatcccccggcccccatggggggcgggaacattcaaaattgggcccaaattcccctaaaagganngggnataaaaatcnctgggcgngggtttaaaaaggggggaaggggaaaaacccgggggtacccaaattaaaagccttggaaaaaaaaccccttttcccaagtgggggaaaaaaaaaaaaggccccacccannccc

SEQ ID NO: 101222 - DNA, 298 bp, Triticum aestivum
  unsure (1)..(298): unsure at all n locations
  Clone ID: PAT_TA_101222
ttccagcggccgcccgggcaggtctggaccctgatgnnnnctccgaaaggtnngcgcccccatacctagttgccgaatgtgacttccatggnnnntatatatggtnnnggctcncctagcattgaacgaggagcgttaaaatctatgccgtcgtgacgtgtcnnnnntaccttattagtatccgctgttagtgccccatttcattatttatgctttacannnngaacccgtaattctcttgcgaatacnnctctcttaatcatttcttcacatgtacctgcccgggcggtcgttcaaa

SEQ ID NO: 101223 - DNA, 253 bp, Triticum aestivum
  Clone ID: PAT_TA_101223
aattaaacctttttttttttaattttaattttaattacttaacaaaaatatttaccgggttaaacccaaatttgaaccccttccatactttaaaaactgggggtaattcaagaatccatttgcaagctggtcggaaaatttcattacctttcgaaacaaaaaccccccctttgttaaaaacttggacctggccgggggggcggttaaaaataaattccccggggccccatggggggcgggaacatgccaactc

SEQ ID NO: 101224 - DNA, 183 bp, Triticum aestivum
  Clone ID: PAT_TA_101224
gcggccgcccgggcaggtacaactctgcttgctgctcttcttcctccaacaacacttactcacacttgatcgacttgtatatgtgccgaacaaagaacagggcggcacggaagcccaccatacccagcatcaggaagaatgcatagcagatgcacgccatgtacctcggccgcgaccacgcta

SEQ ID NO: 101225 - DNA, 190 bp, Triticum aestivum
  Clone ID: PAT_TA_101225
acttaacatctatgaaacgttttctataatactccagcaaaatcgttgggtttaattcttacaaatcacggtgtattcctgtgctcaaaatctgcctcatcattacgatagacggcattatttttacagaaccacgcagagaaagccaaacaggcttgattaatcagtacctgcccgggcggccgctcga

SEQ ID NO: 101226 - DNA, 258 bp, Triticum aestivum; identical to SEQ ID NO: 101203
  Clone ID: PAT_TA_101226

SEQ ID NO: 101227 - DNA, 230 bp, Triticum aestivum; identical to SEQ ID NO: 101213
  Clone ID: PAT_TA_101227

SEQ ID NO: 101228 - DNA, 197 bp, Triticum aestivum
  Clone ID: PAT_TA_101228
gcggccgcccgggcaggtacaaggttataaacatggatcaatggatgggatttcttcggttctgcaatgagataaacttcccatcacttgacaattacgatgcagaccaagcttggcctttaattttagacaattttgttgaatggttaagagcaagtgaaaattagctctgttgtacctcggccgcgaccacgcta

SEQ ID NO: 101229 - DNA, 312 bp, Triticum aestivum
  Clone ID: PAT_TA_101229
tagcgtggtcgcggccgaggtacgtgctcaaaaacaaaagccttctttctagatacaaacacattaactaaactatacggggcgaccaactaccaaaatgcgcacgcagtggcaccagctgcaaaacaacatatgatgtcgaaccgctgccgaactacaccatgcgaaatgccgcatcgcgtgcctgcagaaactgagctgcacgggacaagctgaggaacagctgtcgaaactgcatgccgacggactccaagaaccttctgtgcatagtcgagtaaaacgcacgacgcacctgcccgggcggccgctcga

SEQ ID NO: 101230 - DNA, 224 bp, Triticum aestivum
  Clone ID: PAT_TA_101230
gcacttttttcctctctttttttttgctccgcaacaattttttttcaaaaaagtctacaaatggtctaaaaactgcctagccagaatttcccagacttagtttttttttgagtttggaactatttctctactgcgggtagcacggaacttggggagtccttctttgtcacgaatcggagtattgcgtgatctggaaatccaaaacctcggccgcgaccacgcta

SEQ ID NO: 101231 - DNA, 230 bp, Triticum aestivum; identical to SEQ ID NO: 101213
  Clone ID: PAT_TA_101231

SEQ ID NO: 101232 - DNA, 583 bp, Triticum aestivum
  unsure (1)..(583): unsure at all n locations
  Clone ID: PAT_TA_101232
gcggccgcccgggcaggtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttgtttgttcctaagaatatgtgtatgtccatgttcatgtacttaggctagcagtatgaccggatgcgaggacctgctcactgaccaggacaatctatgagctcccagcgcctctgatacaaggtgcgttagggccaacctcttccggaagaaggccacacttgtagcccctctggatcaaaattggtatcccttcctgcctccttttggattcacatgattttgcctcatggattgatggatgtgtctgtaattgtaaagtctggtccttgtttactttctataatttattgcatgcttgatgaggctatgtcaagtgtctaaattttgaatgcatgcgctaaggcatttttgannnnnnaa

SEQ ID NO: 101233 - DNA, 200 bp, Triticum aestivum
  unsure (1)..(200): unsure at all n locations
  Clone ID: PAT_TA_101233
tagcgtggtcgcggccgaggtacatgaaatnnnnnnnnntgccacataatgaatctnnnctttataccgacaccgatctccttatgacaccttcctcacgcgcaactactccaagaagctcctttgcttgcaaccactccaaactggctccaccaccacctgacatgtggttcataacatcagccgctcccaccttctca

SEQ ID NO: 101234 - DNA, 200 bp, Triticum aestivum
  Clone ID: PAT_TA_101234
gcggccgcccgggcaggtcgccgaccaccgccggcaccaacggcagcagcaagggggaggtctcggtggtgtccgaccacaagtgaagtgaatgaatgaaatacttgaacagaacctagttttttcgcaaccaaatttcacttggattggattgtgattgtggactaatttcaacgagtacctcggccgcgaccacgcta

SEQ ID NO: 101235 - DNA, 185 bp, Triticum aestivum
  unsure (1)..(185): unsure at all n locations
  Clone ID: PAT_TA_101235
aattttatctacttatcannaatatctaccggctcaaactcaaatttgatccccttccatacttanaaaactgggggtaattcaagactccatttgcaaactgctcggataatttcattaccttcccaaacaaaaaccccccctttgttacaaacttgtacctgcccgggcggcccctcaaatta

SEQ ID NO: 101236 - DNA, 401 bp, Triticum aestivum
  unsure (1)..(401): unsure at all n locations
  Clone ID: PAT_TA_101236
ggaaaattaacctttttttttgttggaaaaacaaaaaaaattttgttaattttctttatggaaaccttgccggggggggcgttaaaaattaatttccccgggcccctttgggggggggaaaatttcaaattgggccccatttccccttttagggggtttttttaaaattaagggggcggttttttaaaacggggggatgggaaaaaccttgggtttaccaaatttaanggctttgaaaaaaatcccctttttcccannggggttaaaaaaaaaaaggccccccccattccccttttcaaaaatttgcccaccttaaaggggaaagggaccccccttttnnggggcntttaaagggggggggggggggggtttcccccnangggacctttnnntttgcaagg

SEQ ID NO: 101237 - DNA, 205 bp, Triticum aestivum
  unsure (1)..(205): unsure at all n locations
  Clone ID: PAT_TA_101237
gcggccgcccgggcaggtactttaaccttcttcccagtcaatctcatcttcctcgtcgtcgccggattctggggcctcagcattcaagtccacaaacttatatggctcctccgatgtattccctgcaggttgctcctcttcccattcaacaccctcatcctcaccattctcatcctcacgtttggctttcatnnnnacctgccgc

SEQ ID NO: 101238 - DNA, 265 bp, Triticum aestivum
  Clone ID: PAT_TA_101238
gcggccgcccgggcaggtggagggtctcacctggggtgcatctaagcttatgcctgtgggttatggcatcaagaagctccagatcatgctgacgatcatcgacgaccttgtgtctgtcgacacccttattgaggaagtgctctgtgaggcgcccatcaacgagtatgtccagtcgtgtgacatcgttgccttcaacaagatctagaatctttgttcgcccacctgttgctgctggattcttggtacctcggccgcgaccacgcta

SEQ ID NO: 101239 - DNA, 370 bp, Triticum aestivum
  Clone ID: PAT_TA_101239
gcggccgcccgggcaggtactcggctttgatcttctttagcgtcacgaccacgtcgcgcattgtcatcctctgccgtggagagtcactggaacatcgcaaacccaacctcaaagaccgatgcaagaattccatcgtccaacctgcaacttgaaagagaggagccttgcagaagctgaccatcgacgactcggacaagctcagcaggaaatgaatgatgaacccactgcctaagggttagttgtgtgccgaacatgacatcggtgggccttcttccggtgaagacttcaaggagcatgattccgtaactaaacacgtcgctcttccttgaggcttttccaagtgatccgtacctcggccgcgaccacgcta

SEQ ID NO: 101240 - DNA, 164 bp, Triticum aestivum
  Clone ID: PAT_TA_101240
tagcgtggtcgcggccgaggtactcttcaatggttacagctccacaaattttcctggcgacaactatgtcaaactgccaaagaatatgagcatctccagacagtctcatatcacatgcaatccggatattcgagtggttgtacctgcccgggcggccgctcgaa

SEQ ID NO: 101241 - DNA, 297 bp, Triticum aestivum
  Clone ID: PAT_TA_101241
gcggccgcccgggcaggtacatgaatcatacgtgagacacaccgcaggaccggttctccatgtttgaggaccgtattgagatgatattctcatgttctgagactctattgaagccgtttctacgtttgggaactcagaaactgcttctgcggcacgctctccatccaacccgacggccgctcacaccgttcgtaaataaagagtctcagcgaagagactcgtttatttctggctggcccaatgggacggcagcccggcccagtccaatccatatgtacctcggccgcgaccacgcta

SEQ ID NO: 101242 - DNA, 238 bp, Triticum aestivum
  Clone ID: PAT_TA_101242
tagcgtggtcgcggccgaggtctcgcctggggctccatcggccacatcgtcgcctactacatcctcgccaccaccagcaacggatacgacccacccttcttcggctgatccctcccatgtctgcctgcctgcgtgccgaccggaccggcttgctgttgtaatccgccgtgttttcattagttctctatacgctgatggtgtgctatcatgttagtacctgcccgggcggccgctcgaa

SEQ ID NO: 101243 - DNA, 218 bp, Triticum aestivum
  Clone ID: PAT_TA_101243
tagcgtggtcgcggccgaggtcatgccaggtgttataccggtagcttcaggtggtattcatgtttggcatatgccagctctgaccgaaatctttggggacgattctgtattacaatttggtggaggaactttaggacatccttggggaaatgcacctggtgcagcagctaatcgagtggctttagaagtctgtgtacctgcccgggcggccgctcgaa

SEQ ID NO: 101244 - DNA, 220 bp, Triticum aestivum
  Clone ID: PAT_TA_101244
tagcgtggtcgcggccgaggtacttaactgcaatgccaatttgttgtgaacatcccaaaatagacagtgttacattagtaaagaaaaacaactttcttatggttactgaaaccaatccgtttaatatttagaagctcacgcaacatgtcccgcagcaacgcgcggggtatccatctagtatatacatggatgtgcgtacctgcccgggcggccgctcgaa

SEQ ID NO: 101245 - DNA, 210 bp, Triticum aestivum
  Clone ID: PAT_TA_101245
tagcgtggtcgcggccgaggtactgaatgtgaaataagttgattacttgtcctcctgaaaaataatgttgcgcagttgcctgtggaaaaccatatggttacttgctgtgattgtgaacatgagcaaccgagaggaaacctgcaaaaaattattgaatttcagagcaccaattccttttgaacatggtacctgcccgggcggccgctcgaa

SEQ ID NO: 101246 - DNA, 197 bp, Triticum aestivum; identical to SEQ ID NO: 101228
  Clone ID: PAT_TA_101246

SEQ ID NO: 101247 - DNA, 182 bp, Triticum aestivum
  Clone ID: PAT_TA_101247
tagcgtggtcgcggccgaggtacatctagccatctaggccaaacaacatcacatactcctacagataagccgtcgtaaggctcaagacatgatacaactgcatatatgcattctacgacacggaacatatgtgaacttcagagtgaaagtaatatatgtacctgcccgggcggccgctcgaa

SEQ ID NO: 101248 - DNA, 293 bp, Triticum aestivum
  unsure (1)..(293): unsure at all n locations
  Clone ID: PAT_TA_101248
ggatcttaaaacaaacatccttttttgtgctatgaaaaattattacagacagacacagaccaagcaagataagtttaaaaaaggaaaaaaggaggcaaagagttatttataacagcggcgggtcaactcaagtggggaggaggaatcaaccggacagggcgtcggcgccagcgacgattttaaggatctctccggggatcttggcctggcgttcgcggtngtaaaccatggaaagatttttccggaggtncatggcattgtctgtggcacctcgggcgcgaacannntaattt

SEQ ID NO: 101249 - DNA, 189 bp, Triticum aestivum
  Clone ID: PAT_TA_101249
tagcgtggtcgcggccgaggtacgagcgtttattactgcacatctgagctctctcatctgatggaaacaaccagtcttaccatctgcaatgtagctgttcgacctcacaagggaacactttagcagataactgaaaaacaaaaacaaataacaaagacctgcccggacctgcccgggcggccgctcgaa

SEQ ID NO: 101250 - DNA, 234 bp, Triticum aestivum
  Clone ID: PAT_TA_101250
tcgagcggccgcccgggcaggtaccggagtggatatgatctcccccagacatacgcaatgctttagctaatacacggaaatgcataccatgatttttctgtctatcaataactgcatgcattgcacggtgaatgtgaagaagtaggccattgtcgcggcaataatgagccaaagtagtatttgcggtgaatcccccagttaagtagtcatgcaacctcggccgcgaccacgcta

SEQ ID NO: 101251 - DNA, 214 bp, Triticum aestivum
  Clone ID: PAT_TA_101251
tagcgtggtcgcggccgaggtctctgttgtcatattctgaaggtcatggataatattagcatgacagaagtagcagagagccacatagtgaaaaggtggtcgaaagatgcaagagatattttgccggatcacttgaagcactactagcgggaccagatcaatagcacgttcctaacttatacttgcgagcggaaagcagggggagatatcccgc

SEQ ID NO: 101252 - DNA, 253 bp, Triticum aestivum
  unsure (1)..(253): unsure at all n locations
  Clone ID: PAT_TA_101252
tagcgtggtcgcggccgaggtacaaccacacaatcctcctccaccaccatttcgttgacaaaagcaaaaaagaaaaacggaagcaagcaagcaagccagtcgcgcgttggaatccaggaagagagaggggcagcaaaaatgcagagagcgttcgtggtagtaccacatcttccgagccacgtaatccaccgtatccgactctgacatgctcctgaggtcccgacctgcccgggcggccgctcgaaatcnannn

SEQ ID NO: 101253 - DNA, 230 bp, Triticum aestivum; identical to SEQ ID NO: 101213
  Clone ID: PAT_TA_101253

SEQ ID NO: 101254 - DNA, 245 bp, Triticum aestivum; identical to SEQ ID NO: 101214
  Clone ID: PAT_TA_101254

SEQ ID NO: 101255 - DNA, 230 bp, Triticum aestivum; identical to SEQ ID NO: 101213
  Clone ID: PAT_TA_101255

SEQ ID NO: 101256 - DNA, 215 bp, Triticum aestivum
  Clone ID: PAT_TA_101256
gcggccgcccgggcaggtacaagctcgtaacgaagggcgcgatcttgctcgcgaaggtaatgaaattatccgagcagcctgcaaatggagtcctgaactagccgcagcttgtgaagtatggaaggcgatcaaattcgagttcgagccggtagatactattgataagtagataaaactaaagataaagaagagaaggtataaataaaaaaaaaaaa

SEQ ID NO: 101257 - DNA, 230 bp, Triticum aestivum
  Clone ID: PAT_TA_101257
tagcgtggtcgcggccgaggtttttttttggatcacaaaaattcatatatttgatttacaaattcctttacatttacaaatagacataatacattaaactctctaatcgtttcccacccactagtccagcctattcttagatggcatcttctgaacatacttaagttacatcggctgcatctagaaaacagaggagacaaggatgagtacctgcccgggcggccgctcga

SEQ ID NO: 101258 - DNA, 174 bp, Triticum aestivum
  Clone ID: PAT_TA_101258
tcgagcggccgcccgggcaggtcctactactacttggaggccgccgacgaccaggagtagttaggaggctcccaggcaggaggccttgccttttcgatcgttgttgcttttgtgctagccttcttaaggcaaaattgtctaactcatgtctgtacctcggccgcgaccacgcta

SEQ ID NO: 101259 - DNA, 250 bp, Triticum aestivum
  unsure (1)..(250): unsure at all n locations
  Clone ID: PAT_TA_101259
tcctccaccaaattgtaatacnnnntcgtccccaaagatttcggtcannnctggcatatgccaaacatgaataccacctgaagctaccggtataacacctggcatggatacccagtcctgagtgaaaaagataccgcgagcacgatctttttcaataaaatcatcgcgcaataaatcaacaaaacctaaagtcatttcgcgttccccttctaacttacctactactgtacctgcccgggcgnnngctcga

SEQ ID NO: 101260 - DNA, 239 bp, Triticum aestivum
  Clone ID: PAT_TA_101260
gcggccgcccgggcaggtacttagctcgcttgtctttttcacttcaccatgggatcagaaatgcacaacgtatacaaacattaacacaaggatcaattgggcaaacaaaagaacacaaaactaaatatataaatatgcatacacaaaagcaacatctttccaatgggcaatgatgtaggcatcgctgccggcaaaacttggcgcaacggagaacctgtacctcggccgcgaccacgcta

SEQ ID NO: 101261 - DNA, 234 bp, Triticum aestivum; identical to SEQ ID NO: 101250
  Clone ID: PAT_TA_101261

SEQ ID NO: 101262 - DNA, 179 bp, Triticum aestivum
  Clone ID: PAT_TA_101262
gcggccgcccgggcaggtacaaatcctggtggtatatgtgcgtttcgcacaaaaaaactgaacactgctacgtctatgaacccccctaacattggagctgttgttagacttacacaatgtaggtcttcttcagggctttcctgccacgcttcctgttcacctcggccgcgaccacgcta

SEQ ID NO: 101263 - DNA, 159 bp, Triticum aestivum
  Clone ID: PAT_TA_101263
gcggccgcccgggcaggtacatcccaataaaggacgaccatacttgttcaacttatctctttcaacttggataccatgaggcgggccttggaaagtttttgaataagtagggggaattcgtagatcctccaaacgtagacctcggccgcgaccacgcta

SEQ ID NO: 101264 - DNA, 196 bp, Triticum aestivum
  unsure (1)..(196): unsure at all n locations
  Clone ID: PAT_TA_101264
gcgaacaaaccttgctctgatttttcatttcattcctaacccacggggaccgaaccgggaaccccgaacgggggcggggtcacatttaacgggggcccaaacctttcggaacccaccccaaggagccaaaccttccccggcgggccctcaaatntaattcccccggcccccctgggggcccggaacctgccacntc

SEQ ID NO: 101265 - DNA, 308 bp, Triticum aestivum
  unsure (1)..(308): unsure at all n locations
  Clone ID: PAT_TA_101265
aaaaggccagggggaattgttaaattttttttttcgcaagaacaacaaatttcccaaactggcccctcaaaagcattttttttaaggcccgaattttttaggccaaaaacccccccggggtaaaattgtccccacccgttttaagggcggagaaaaaatacccaaacttgcccccccaaccccgtttttgttttggggaaccgggggtnctttcctaaaaactcccggaatttcgccctttaaaactgccccctggcggggggggggtttaaaattaaattccnnnnggcccccnnggggggggggaa

SEQ ID NO: 101266 - DNA, 214 bp, Triticum aestivum
  unsure (1)..(214): unsure at all n locations
  Clone ID: PAT_TA_101266
aaaaggaaaacccataactgaaagggcagggattttaatctaggtccgttataaaaaattaatcggccagttgaattttcgggaccagaaattaaatcgtccaaatttttttctggtttaataattttttaagaagccttatagaagnctaaaatttttnnttttgataaccctcgttttaaaacctcggccgacctcggccgcaaccacccta

SEQ ID NO: 101267 - DNA, 189 bp, Triticum aestivum
  Clone ID: PAT_TA_101267
gcggccgcccgggcaggtacagtggaacatctctgctggatatttgctgattaggaccttgtaacagcagatgtgggcagcttttatttccattttgtgtgtcccatgccctaactaactaaatcttactggagtgccacaaacatggcatatcttgctcttaactagtaaatcttactggagtgctac

SEQ ID NO: 101268 - DNA, 210 bp, Triticum aestivum
  Clone ID: PAT_TA_101268
tcgagcggccgcccgggcaggtacagatccttgttcgcggctcctttagtcttcatagtgagattgaaatgagcgtaagatctataaatgcaatctttcccgtcaaaacatgctttgtgcctcacaatatcttctagttcatatgcaagatctccgacaagaccattgtcctcgttgtatttgtcgagtacctcggccgcgaccacgcta

SEQ ID NO: 101269 - DNA, 295 bp, Triticum aestivum
  Clone ID: PAT_TA_101269
gcggccgcccgggcaggtggctaatatgtggccctttttttgcgggtaaggccctggtagaaggcatagaaaacgggggtgtctagacgtgcccaagttgttgcatgtctaagtggcttaatcaagtagaaaaaagaaaaagaaaaagaaaagggaaaaaaaataaactgccgacaagaatctccttgcaaggtcaatgcatatgacttaaatgtgcaatatttatgtaacatctagacgtgctttagtaaaactgaagaaaatttacccttgtacctcggccgcgaccacgcta

SEQ ID NO: 101270 - DNA, 487 bp, Triticum aestivum
  Clone ID: PAT_TA_101270
gcggccgcccgggcaggtacagactctctgaatttgcacactcgccttcagagtcacaagcagcagggtcatgctcgccgtatccctcatctgcactacctccaccttgctccccatgtgggacggccagctcctctacctcctctgcatcactaagatcgccagcgccggtaacctgaagaaatttaaatggcgtaacatgcatatatacaatgttgtctccacggaaaacccttggtttgcataatcacctgcagggacagagaggaaatccctgaatccccactcctcacatgcgcacgctcatctgcctggttaactgatgtttcagaactagctggatcaaaccattgcacccctttgagtattcttcaatttctatcactgaagaaccaccccgagaaagctcccatgaggcacctctcacttcagtttgagaggtgcatccccatggtgttgtttcggtacctcggccgcgaccacgcta

SEQ ID NO: 101271 - DNA, 279 bp, Triticum aestivum
  Clone ID: PAT_TA_101271
tagcgtggtcgcggccgaggtacatctccgcagtctgggcacatagtcccttcgtgcccctgtcgccggaaaatggtgcagaatgtggtcttcttgctcaggccatagtaagtcactttctctctgttggtcgtagacctgcccatctccttccttttaatttgccggtggcaatggtcctgcaattcagttcccagagtcatttgctgaattaacatcatcgttgcaacaagtgccccttcagtctgaatttggtacctgcccgggcggccgctcgaa

SEQ ID NO: 101272 - DNA, 258 bp, Triticum aestivum; identical to SEQ ID NO: 101203
  Clone ID: PAT_TA_101272

SEQ ID NO: 101273 - DNA, 304 bp, Triticum aestivum
  Clone ID: PAT_TA_101273
gcggccgcccgggcaggtacaacaacaacaccaacccatcatctcaacccacttacaacacagcagcaaaagcaaccgccagcccggccaccatcgtcatgaccgcaacctcccgtccattcgccgcgcccttcttattccctccattcccagatgaaccattattgttattctgctgcccatcaacatcactctcactcgtcgtcacaccattactcaagtccggctccgtctcggactgtccaccggcagtctgcgatccatcacccgcaagtcccaccgcacctcggccgcgaccacgcta

SEQ ID NO: 101274 - DNA, 174 bp, Triticum aestivum
  unsure (1)..(174): unsure at all n locations
  Clone ID: PAT_TA_101274
ggggcttgttgacatattatcaacagggaagttancttgccggcttccaaatatgaacaaacataaaaggcctgaaagcaacacggccattatgcggatccatctaacctaacttggcgaggacatcgccaaaaacggtcttggtctctccgacctgcccgggcggccgctcga

SEQ ID NO: 101275 - DNA, 383 bp, Triticum aestivum
  Clone ID: PAT_TA_101275
aggtcgagtacctcgcagccgaggtgctggagctggccgggaacgccgccaaggacaacaagaagacccgcatcgtgccgaggcacctgctgctggccatccgcaacgaccaggagctcgggaggctgctgtccggcgtcaccatcgcccacggcggcgtgatccccaacatcaacccggtgctgctccccaagaaggccgccgagaaggctgagaaggccggcaccgccgccaagtcgcccaagaaggccaccaagtcccccaagaaggccaccaaggcctagatcctagtagtgtgcgaccgtgcctgtggtgctccggcagccctcgtgtgcctagtgtctgtgttaattaagttagctgtggtgtgttccagagagtgc

SEQ ID NO: 101276 - DNA, 383 bp, Triticum aestivum; identical to SEQ ID NO: 101275
  Clone ID: PAT_TA_101276

SEQ ID NO: 101277 - DNA, 383 bp, Triticum aestivum
  Clone ID: PAT_TA_101277
aggtcgagtacctcgcagccgaggtgctggagctggccgggaacgccgccaaggacaacaagaagacccgcatcgtgccgaggcacctgctgctggccatccgcaacgaccaggagctcgggaggctgctgtccggcgtcaccatcgcccacggtggcgtgatccccaacatcaacccggtgctgctccccaagaaggccgccgagaaggctgagaaggccggcaccgccgccaagtcgcccaagaaggccaccaagtcccccaagaaggccaccaaggcctagatcctagtagtgtgcgaccgtgcctgtggtgctccggcagccctcgtgtgcctagtgtctgtgttaattaagttagctgtggtgtgttccagagagtgc

SEQ ID NO: 101278 - DNA, 432 bp, Triticum aestivum
  unsure (1)..(432): unsure at all n locations
  Clone ID: PAT_TA_101278
atcgggcgctacctcaagnaggccgctacgcccagcgcgtcggctccggcgcccccgtctacctcgccgccgtcctcgagtacctcggccgcaccggccgcgtctggaacgtcaccaagcgcgccatcggcgccgagatcaacaagcaggtcggcaacaggatcatcaagaagaggatccatgtgcgtgtggagcacgtgcagccatccaggtgcaacgaggagttcctccagnngaaactcaacaatgacaagctgannncggaggccaaggcgcgtggcgaggtcatcagcacgaagaggcagccagcagggcccaagcctgggttcatggtggagggcaccaccatcgagacngtcacccccatcccgtatgacgtcgtcaacgatctcannnntggctactagagcgcttgcttcctgagctgaannc

SEQ ID NO: 101279 - DNA, 383 bp, Triticum aestivum; identical to SEQ ID NO: 101277
  Clone ID: PAT_TA_101279

SEQ ID NO: 101280 - DNA, 214 bp, Triticum aestivum
  Clone ID: PAT_TA_101280
ccgggcaggtacacgtccgatgcgaagtggttgacgtcgcggtggtgagcctcgtcggcgcgcaccacggtgaccacgtccttgagggtggcgttggcagggaggcgccagtagtcgatggcgatggccggggcggggacgttgtcgatcttgccgtcgtcgaggtccttgaggaactccgtgtaggagtggacggcctcctcctcgaggtgta

SEQ ID NO: 101281 - DNA, 404 bp, Triticum aestivum
  unsure (1)..(404): unsure at all n locations
  Clone ID: PAT_TA_101281
ccaaaaaaaatccaaattttattcataaataaactggnccataaacccacatttcatggatctaaacaaacccagggcaaaaaaaaattacctcgaataaatccccacaaaaaagggggaaaactttgttttgaaacccaaaaagaaaaaaaaacccttttacctaaaaacttgggccccgtgggtttaaagaaaccccctcacccttcttcgaaaaggctttggggtttatgtaaaacccctccatgatcgatcccccccccgggggggctccttaaaaggccccaaaaggggatctcggggatacaaaaagttacggggggaaaattagggtttgggccccctttctaatatttggggggggaccccggaggttgccgctggcttnnccggtcaaggtnnnt

SEQ ID NO: 101282 - DNA, 268 bp, Triticum aestivum
  Clone ID: PAT_TA_101282
ccgggcaggtactggctgaccaagctcgaccgcagtccaagtctcatcaggatcatcagatagcctcgcaaaataaatgcagttactctttcctccccatctttccgggctgatgcagcagaatgtagggtccctcctatcaagactaacaaacaacgcatgattttccaacttctctaacttcacccactttgccggttcaatagaaaaattgaggcgatagaccttaaaggttgagttgaataagacatctgattcgctggagctt

SEQ ID NO: 101283 - DNA, 383 bp, Triticum aestivum; identical to SEQ ID NO: 101275
  Clone ID: PAT_TA_101283

SEQ ID NO: 101284 - DNA, 383 bp, Triticum aestivum; identical to SEQ ID NO: 101275
  Clone ID: PAT_TA_101284

SEQ ID NO: 101285 - DNA, 204 bp, Triticum aestivum
  unsure (1)..(204): unsure at all n locations
  Clone ID: PAT_TA_101285
agtgccacgcgnngcggagcatgagcggggagcaattcttctcggcgatgagggcgcggagcttctgcctggccttctcgacggcctcctggtctggaaacaacatttgatacatatgtgggtcgctgaaggattcattcatgaaaaacaagggcgaagtcgatatgaaataggtgagagttattttaacgagctcattaatag

SEQ ID NO: 101286 - DNA, 383 bp, Triticum aestivum
  Clone ID: PAT_TA_101286
aggtcgagtacctcgcagccgaggtgctggagctggccgggaacgccgccaaggacaacaagaagacccgcatcgtgccgaggcacctgctgctggccatccgcaacgaccaggagctcgggaggctgctgtccggcgtcaccatcgcccacggcggcgtgatccccaacatcaacccggtgctgctccccaagaaggccgccgagaagactgagaaggccggcaccgccgccaagtcgcccaagaaggccaccaagtcccccaagaaggccaccaaggcctagatcctagtagtgtgcgaccgtgcctgtggtgctccggcagccctcgtgtgcctagtgtctgtgttaattaagttagctgtggtgtgttccagagagtgc

SEQ ID NO: 101287 - DNA, 383 bp, Triticum aestivum; identical to SEQ ID NO: 101275
  Clone ID: PAT_TA_101287

SEQ ID NO: 101288 - DNA, 227 bp, Triticum aestivum
  Clone ID: PAT_TA_101288
aaaaaaacagcaattattccccccccaaatcaaaatacaataccccgaggggatcaagggcccaaaaccaacaaagttgcagcaaacaaaaaggggtctgagggcttaaacaaaaacatacctttgcttctttgcaaaccaaaaggaacctcccatttcaaggggggtcgttttacccatacccaacaaccattttttttttacccaaaatcttttttatcccccca

SEQ ID NO: 101289 - DNA, 335 bp, Triticum aestivum
  Clone ID: PAT_TA_101289
accggtcgcgtctggaacgtcaccaagcgcgccatcggcgccgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtatgacgtcgtcaacgatctcaagggtggctactagagcgcttgcttcctgagctg

SEQ ID NO: 101290 - DNA, 383 bp, Triticum aestivum; identical to SEQ ID NO: 101275
  Clone ID: PAT_TA_101290

SEQ ID NO: 101291 - DNA, 342 bp, Triticum aestivum
  Clone ID: PAT_TA_101291
acagggaactggagcccggccttgacggaccgcgtcaccgacttcttcctggggccgccagccttgcgtccggccgaggtactccttgatcttatcggcatggtcatatgagtagtctgtctccaaagcaaccgcaagaacattcttgtatgcgttgaggaacatgtgcggcgcagcagccatggtggggtatgagatcgccagggacagtgaggcaaccatggaaacaccagaagcaaacttgtccatcaggtcttcctcagtaaggtcaagaacctcagggctgaagacagacccactgtcatagacattgcagatgaccagtccatatgagaaggggcg

SEQ ID NO: 101292 - DNA, 353 bp, Triticum aestivum
  Clone ID: PAT_TA_101292
aggtactcataacaccaacatttgataaatataaggtgatagctactagttcctcattcctcttcctcgtcaccacctgcatcgccaccaccacttgccttcttctggttctttctcttcacccggcctgcagggcccccgccgaatggacttgtcagtgagaagtcgatgtgcttctcggattcaaccctcaccatgaacgacgggacattgacgatctgcctgccaaccctgatgtggcgttgcctgatcaagacacgggcatggtggatggattttgccatgccagccttgaagacaagagtctgaaggcgccttgcaaggaagttctcagcagtcagggcaaggacgta

SEQ ID NO: 101293 - DNA, 383 bp, Triticum aestivum; identical to SEQ ID NO: 101275
  Clone ID: PAT_TA_101293

SEQ ID NO: 101294 - DNA, 383 bp, Triticum aestivum; identical to SEQ ID NO: 101275
  Clone ID: PAT_TA_101294

SEQ ID NO: 101295 - DNA, 383 bp, Triticum aestivum; identical to SEQ ID NO: 101275
  Clone ID: PAT_TA_101295

SEQ ID NO: 101296 - DNA, 383 bp, Triticum aestivum; identical to SEQ ID NO: 101275
  Clone ID: PAT_TA_101296

SEQ ID NO: 101297 - DNA, 177 bp, Triticum aestivum
  unsure (1)..(177): unsure at all n locations
  Clone ID: PAT_TA_101297
aggtacacaattctcttcnaggannnattacgaaaagcactcnngtgttttgttgctctgcggaaggcctgtataanantaacaggagccggnnnaatataaccagtttgtgattaaacttttcgttggcggccttgcctgggctactgatgaccattnnntgntngntgcgtttca

SEQ ID NO: 101298 - DNA, 519 bp, Triticum aestivum
  Clone ID: PAT_TA_101298
gcacgaggccgattcgaacctcccccaaatccgcagcagtccacaggaggcgaagccaccgcgatggcccgtacgaagcagaccgcccgcaagtccaccggcggcaaggcgccccgcaagcagctcgccaccaaggcggcgaggaagtcggcgccgaccaccggcggagtgaagaagccccaccgctacaggcccgggaccgtcgccctccgggagatccgcaagtaccagaagagcacggagctgctgatccgcaagctgccgttccagcgcctggtccgcgagatcgcgcaggacttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagccgtcctccccgtcaacgccgttagtggatcggaagtggaatgt

SEQ ID NO: 101299 - DNA, 532 bp, Triticum aestivum
  unsure (1)..(532): unsure at all n locations
  Clone ID: PAT_TA_101299
gcacgagggtttaaaaaaaaatccgaaagcctaccacgaggcctcccaagtcgctccccaggcgactccgggggcgcaaccgcgcagccgtccagaagcccccctccagtgctccctctccgccgctgccgccggcatctgcgccgcggtggcggcgggcccccgctgccaaacggcgccgggggcggctccttctcgtggtggcgccggcggccgccggactcggctgggggcggtgatggcggctggccggcgcgggcatgccggggcggcggccccggggacgcggaggcgggggagtgcggtggccggcggttcccggcatgggggctgcggggtggcctcgtttcgggggtccgtgctctcccggatctggccaggacggtggcttccatggcgggcctccgcgcttggcgggcgggccggggcgtggctgctccggctggcgtctgcggatccgtggtggtggcggtgtgccacggatcgacgggggcggcgcggcagctcctnnntngcggcgcggcggcgcnnn

SEQ ID NO: 101300 - DNA, 525 bp, Triticum aestivum
  unsure (1)..(525): unsure at all n locations
  Clone ID: PAT_TA_101300
gcacgaggatccccaccactgtatccacctactcgaagcgcgacgcgagcgagagtacggggggagatgccagggggaccggaccgcagaccacgcgtgcggagggttcggcggctgcatctggcggcgccgccagcccttgcacctccggtccgggtccccgtggagcagctgccggagatcaactctgcctcgccggaagcgcgagcggagatgctgcgggtggtaatggggcgcttccccgaccgctcagagtggcccgaccgatgcatccaggtcattcagacctcgacgttcgcggaacgagctccattcaccggcgacgatggcggggtggaatacaagctgctattctgggcgattcaggaggcggaatcgacagtcccggtcaccgcacgcaggtgggcgaggttcaagacgacgagcccgtccaggctgaacatcaggccgccccccgtggtgcagctcgccaacattccacgcgagttcctgccgccgggggagagnnacccagaggccctngnn

SEQ ID NO: 101301 - DNA, 527 bp, Triticum aestivum
  unsure (1)..(527): unsure at all n locations
  Clone ID: PAT_TA_101301
gccggcagccgctgcgggcagaaggggaactgcgtaggagacatcgtcggtgtcggcgtcccagggacagggcacggcggcacgcactgcgggcccatgcacaggcacatcgtgcctttgccgccgtccgccagcacgccactagccgacaggagcagccacagccacgcggccacgacaagcaggaccgccgatgacgggttcgtgcagtcccgcgaggaccgggccatgtgggatgccgagacgacgttgccgaagaaggagtctccgactacctcacgaccgccgctggcctgcacatcaggtcgccgagcccgttcaccggtgtgagcagtctgggctgccgggtgctcaccgtccggcagcacaccaccgcgcgacacgcggtggtggaggccgagctcacccaggtcgagaccatacggtggcagtaggaggagactgaacaccatggtggtgtgggcgccgattgaaaatcaccagctagtcctacttcaactgcgatgcaatataatttgatcgaaaan

SEQ ID NO: 101302 - DNA, 534 bp, Triticum aestivum
  unsure (1)..(534): unsure at all n locations
  Clone ID: PAT_TA_101302
gcacgaggttctccttctgtcccgcaaacccccgagannnacactatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccagatcaaggacgaggagggcaaccccgcctttgccatcgtcaacaaggccactggcctcgccgtcaagcactcgctcggccagtcccacccggtgaagctcgtgccattcaacccggagtacctcgacgagtccgtgatgtggacggagagcagcgacgtcggcaagggcttccgctgcattcgcatggtgaacaacatccgcctcaacttcgacgccctcaacggcgacaaggaccacggcggcgtgcacgacggcaccaccgtcgtcctctgggag

SEQ ID NO: 101303 - DNA, 527 bp, Triticum aestivum
  Clone ID: PAT_TA_101303
gcacgagggtgaaatgccctgccgtttgtttaatggcggcacggcttcgcaacaaaagggtccaaatgcccttcacatgcgcttgttccttgtgatcctcggtcctccccgtccctttctgctgctcgtcttgagcgaattgcccgcataaacaacaaactttgatttgatggatcatcatctctcacccaccgctagctaaggctttggctgcccggccggatataaagcacgccggagcgaaggtttatcagctagctactagcttcttctcagctcgcagctagctcctctaagacaccatgaagaagaagaagccagtgctgtttcttgcgttggacgcgctactagtcgctgctctgcttcttcccggccagtgccaggggtctcaaggagccaacctcacggtgaccggcaccgtgttctgcgacgcctgctcctccagctccttctccaaccacagctacttcctgccagatgtgaaggtgagaatcgactgcgcgatcagagtgagctcggcttccaat

SEQ ID NO: 101304 - DNA, 511 bp, Triticum aestivum
  Clone ID: PAT_TA_101304
gcacgagggtgtcatagggagtcagtggatcctgaacttctgtttacacaagaagtggtctattgggcgttgcaacagatttatgcatgacgatgaagggaagctgcaacttgaagatgtttgcttacatgtttcatacaacaaaagaggttatcttcaggaactttggaacattcctttggattcatgtgttgatgcctcacctttgcttgtcctgaacaatgggatgataaacatatttattgggtcccattcacatttatttctctgcatcgatggttgcaatggttcagtgaggtggagtgtcaaattggaaggacgtgtggagtgttctgctgctattactggtgatttttcagaggttgtggttggatgttataaagggaaaatttactttcatgatatgttgactggtaaactatcttggacagttcaaacagatggggaggtaaaaatgcaaccagttgttgacaggacaaggaatttaatatggtgtggctcttatgatcat

SEQ ID NO: 101305 - DNA, 531 bp, Triticum aestivum
  unsure (1)..(531): unsure at all n locations
  Clone ID: PAT_TA_101305
gcacgaggctgctctgctcagcgcctctactgcttcccctccgtccaccgatcgagtgaaaaagctctccgttcgcnnngaagatccacgaccatggcgggcacggccaactgcatcgacatcatcctcgccatcatcctcccgcccctcggcgtcttcctcaagttcggatgcggggtaagcatcggcaccagattctttcctctttctctcttctttcgtcttcccttttctggctcgatccacaggttgatagatgcataggtagataataagatagacagggacatgtatagatggaattctgatgggagagtgcatagaaggttctgattactgataatcgtttcttggtttctctcttgcagcacgagttctggatctgcctcttgctgaccttcctcgggtacatcccgggtatcatctacgccatctacgccatcaccaagtaaactagcaagccgtcccgagtgttccgcgacacaatattttcaggatgatttgatctgtctagtccctccttgcctgtga

SEQ ID NO: 101306 - DNA, 531 bp, Triticum aestivum
  Clone ID: PAT_TA_101306
gcacgaggtccgacccggccttcctccgtctcaaaatcccccaaaacatggacggctacaggcgggctccgccgccggcggcggccgccgcatcggcggcatcagtgctcggcgacgacgatctcctccgcgagatcttcatccgcctcggcttccccaactgcctcgtccgcgccgccctcgtctcccagcggtggctcctcaacgcctccgacccggccttcctccgccgcttccgcgagcgcaacccgccccgcgtcctcggcgtctgcgccggctactcggtgagaccgttcaagttcgtgccgctcccacagcccccggagctcgccgccctctcgcggcgcgcggcctcctcctgcgcctacgcctttgcccgaggaggccagcgcatcgagcactgccggaacggccgcctcatcgtcgagtccctccgcaagggaacattcaagcactccgtcctcgcgccgctgctctacggggagcccgaggcggtcctcccaccgatcccgccgccccgccgtcatccga

SEQ ID NO: 101307 - DNA, 532 bp, Triticum aestivum
  Clone ID: PAT_TA_101307
gcacgaggctcaccggagcctcgctcctcccagctagctagctgccgccaacccgagcccagcaccgcatttcattaatccacagcccgccatcgtcgtcgccatcatcacccctttccttccctgagccccctcgcaccacgcggccggctgcgcgcgggcgctccttctccccctacattactgcgagacgttgacattggcgagtggcatgccccctcccccctccgcttccccaccgctcccccttcccgcggagtcctgacccggggcggcgcgatggcggcgacggccggggcggcggcggagatcgtgcgggagatcgcggccgtgggcgccgccgacctggccgccgcgccggagccgctgcgggccgactgcctccgcctcgcgcggaaggtgtccctgctcacgcacctcgtcgccgaggtcgccgaggcggcgggggaggacggcgcggcggggcccgaggcggccgcgtgggtggccgacctgctacgggcgctccaggccgccaggaggttcgtcgcgc

SEQ ID NO: 101308 - DNA, 504 bp, Triticum aestivum
  Clone ID: PAT_TA_101308
ccgggcgccgggccggcggcggcggccccaagaagaatccgtctcgcgctccgtcaaggccggcctccagttccccgtgggccgcatcgggcgctacctcaagcacgggcgctacgccaagcgcgtcggctccggcgcccccgtctacctcgccgccgtcctcgagtacctcgccgccgagctcctcgagctggcggggaacgcggcgcgggacaacaagaagaaccggatcatcccgcggcacgtgctgctcgcgatccgcaacgacgaggagctcgggaagctgctggccggggtcaccatcgcctacggaggcgtcctgcccaacatcaaccctgtgctgctgcccaagaaggccgctgcggcggctaccaaggagcccaaggcgggcacgaccaagtctcccaggaagtcccccgccaagaaggcggccgacgcttaggcccggcactcgctatgccggtgccccgtcccaccctctccctcctctctgtttgtctctgt

SEQ ID NO: 101309 - DNA, 523 bp, Triticum aestivum
  unsure (1)..(523): unsure at all n locations
  Clone ID: PAT_TA_101309
gcacgaggcaagagcgccgtcgagaccgtcactcttgaggttgagagctcggacactcttcagagtgtcaaggcgaagattttcgaccagacgtgtatgcccccaggcgggcatcgcctcttcttgtctggcaagctgctggaggacagctgcaccttggctgactacaacatcgaaaatgattccatccttgattctgacgttcgctccccctggccgagcgaaatgttgcgcttgtcggtcaagacaccgacaagcatgtcttcgagcatgtgtgcatgcgctcggagacggtccacgatctcaaggcaaaggtttatgttgagttgggcattcccccgaatgagcagcgcctcttgtcgggtggggtcgacggagtcccgcttgaggatggggaacccctgttaggggagggcacctctatctgcaggtcttctgacttgctgctggtggtcgaccggtgatatggatgctcgatattcagaatacccccagttgtcttctaatgatgttatgtctgaan

SEQ ID NO: 101310 - DNA, 509 bp, Triticum aestivum
  unsure (1)..(509): unsure at all n locations
  Clone ID: PAT_TA_101310
gcacgagggccccgtcctccccttccttccaccgcccacctctcccctcgcctctgccacccacctctcccactggtctgcaccctccccttccctcccctacggccagaatcatcgctcccgccttctacccctccccccgtggctagctagggttttggccaccacccctaacttcgctgggatccaccacttccggcgacggcgaggctagatcaccgccgccaactccatcgggcggagctttccaccatcctcatcctcgcccttcatcaccgcatcgccactccgtccccactcctctcgatcccttccccttcctctcctccgtcttctcctcgcgacgccccaccctccacgcgctcgcccgcctctgcggctccgtcgacaccgagatctcccagtgcgtcgagaaagcggaggcagcgaagcaggaggccacggtcgtcacgctcaacgccganntncgccgcgccaaggccaagctcctcgaggaggacctgcccaag

SEQ ID NO: 101311 - DNA, 412 bp, Triticum aestivum
  Clone ID: PAT_TA_101311
gcacgagggagagagagagagtactgcggccgcagctggaacaggcaccgcgccgtgctcgctcacgactacttcagcaacccgtggacgagcatgtccgccgccgccgccgtgctcctgctcgtcctcaccgtcgtgcagaccgtgtacaccgtgctgccgtattaccacccttaatcattgatccatcatcctgcattcatgcatgcaccgagtagtcacaatcttggagtactcccagcgaaatagtaactggtgaacgttcgccagggggaaactcccagcgaacgtcttagctgccacacgatcttattatgtaaacctttcagcttgagccgattctcctgtcaatttgcgttgctgttcatatatatacgacatacgagtgcttcctactttgaaaaaaaaaaaa

SEQ ID NO: 101312 - DNA, 494 bp, Triticum aestivum
  unsure (1)..(494): unsure at all n locations
  Clone ID: PAT_TA_101312
gcacgaggcagcagtcaagcaatccccactcacatctctccacttcccgaatcctttgtccagctcgccatggacgcctcagccaccgtagccaccnnnnaaggggaagaagggcgtggccgggcgcaaggcgggcggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggccgtcctcgagtacctcgccgccgagctgctggagctcgcgggcaacgccgccaaggacaacaagaagagccggatcatcccccgccacctgctgctcgccatcaggaacgacgaggagctcggcaagctgctcgccggcatcaccatcgcgcacggcggcgtgattcccaacatcaacccggtgctgctccccaagaagacggccgagaagtccccaaggagcc

SEQ ID NO: 101313 - DNA, 361 bp, Triticum aestivum
  unsure (1)..(361): unsure at all n locations
  Clone ID: PAT_TA_101313
ntnggcacgagggtcacgcatggnnnnnggaggcatggcgctgcagcatgaaggaggaggccggagcctggcgccgctcgtcgccggctatgcagcgcaacacgggaaggccggaagcgggcgccgcccatcgtcggaggaagtcgtgtccccatggatctcgccacagcggcggagctacaatacatcacaannngcgccccgnccccgtggagctcgccggtggnngtactgctcggctnnaagggagctctcgccggcggctactattgttgcgttgcagtgctcgccccggttgtcgaagttgcagtgcatcannnnnnnatctgntgtgctgctcgncggcnangnagcttcaacg

SEQ ID NO: 101314 - DNA, 512 bp, Triticum aestivum
  unsure (1)..(512): unsure at all n locations
  Clone ID: PAT_TA_101314
gcacgaggctttgctgacctcccaccnnngagaatgggctttgaatatagccattgtggaggcagaaggcaggctgggcatgtttggtatctttcatgaaactgcaggtgatctctgttattacgtcaagggaaacaaaggtgagagttctcagtggcagatcgacaagacaatctcaataggttctgggcaccggcattatatcaaagctgcatccaagaggtacttgctcctcggaaagtatgtagtccggcggaatgtatcaccatcggtgagtgattctactagcattttgccacctctggatatgccaggcgaggaatgcatttcaatagatatcaagacgctgcagcttgagagggtttgtgtcagatctttcgggtttggtaggtacggaatgcacatatataccaacttcccaccatcgttgctgtctgcaccaacaatatgaagtgagccaatcgacgaagtcatagttagacgagcatttcgtcctcggaaccccaagctga

SEQ ID NO: 101315 - DNA, 520 bp, Triticum aestivum
  Clone ID: PAT_TA_101315
gcacgagggaaggaagtgaaggcgcgggacatgttgccggtgtggataaacccgtcacttgttcagaacctcaccagtttatggttcaatctgaaggaagtgaaggcgcgggatatggagatccttgggagtttcccagagctcgttactctacggttgactgatatgcttctggggttgagcgagtcgcaggactttctcccagacgtcatgggggggttattccccaagttgaggtactttagtacacctgcaccgctgaggtttctggagggagcgatgccgagccttgaatcccttgtgtactcttatctccaagtggatcagttcaagcgtgacagcagctttgtgtttgagttcggtagctgggagaacctccattcactccacaaagtgcaagctcatttccgtccaggtgcacctcaagagaatgaggacgaagctgtggttgcgctggagctcgcagccaaccaacatcccaaccgtcctaaccttgaagtcctgagtcccatagggaagc

SEQ ID NO: 101316 - DNA, 534 bp, Triticum aestivum
  unsure (1)..(534): unsure at all n locations
  Clone ID: PAT_TA_101316
gcacgaggacatctttttctccaagtcaggaggaggtccgtgcggtgcgggagagcggcacggcggcggagaaacctcggcgacccgacgacggcgcaggttggctccagttcggcgtggtgaatctgcagcggcggtcagatcaaggaaaggatgggtcggaaagctgggttgtacataaacccaaagaagtttggcggcatcgttaagccttgcatgatggagatgacggccttcctcaactgcctcgccttgaacaagcagatcgatgaaaagtgcacgaggcagaaggagctcttgatcacctgtacccaggctcagaaggggaggccgaagaacgcggccaagaccatcaattaccatcttcagaggctcgggcgcgacaagttccactagtttcggtggaaccgagaccatcgttatcctttctatctcttatgtccggacagcaataatcttccaagtagctttgctgaatgagcagtagacttgtaaggcatcagcataatatcgataccgatttctcctcctgnn

SEQ ID NO: 101317 - DNA, 497 bp, Triticum aestivum
  unsure (1)..(497): unsure at all n locations
  Clone ID: PAT_TA_101317
gcacgaggtctacgaccacgtccgcgacgagcacgcgctggcgccggcgcccaactgtgacacaggcggcctgctccggggcgcgagcgtcactctgcggcgggacgagcctgctgtccacgcgctccttcacggcgacagggtgagcgtgatcctcctgctcaacggcggcgacgtcctggctgggcgctcgctgtcgctggtccgcatctgcccacatcccaagcccggccaagaagacgaggaagttgagtacaggatggtggtgacgcgcgacgagcctgagcctgggactgggtcgccctcgctggcggcgtcggggaaagtgcagtacgtccgccggctggaggggtaccggccccgacacttcctattcgtgccggacgctttctggggctcttccggcagcgtcgtcgtcaccgtcaccactaccgtcaccgtgcatctctgatccacgccgacgcgtgtgtgttgtgctctgctctctgaagtgaacn

SEQ ID NO: 101318 - DNA, 496 bp, Triticum aestivum
  unsure (1)..(496): unsure at all n locations
  Clone ID: PAT_TA_101318
gcacgagggaatccaccgccacacaccctgccccaccccaccctcgccggagaagaaggatccatcccatccaatccggacaccagcccagcccatggccgacgccgccgcgctcgtcgccgtgccgccgacgccgcagcagcggcacccgctgagccagatcgcggcgagcgggacgcaccggctgctgctcaagcagtggctcaaggaggaggacctgctggcgcgccgcgtcgcgctgcgggaggcccgcctcgacggcgcgcgcaaggagatcgccttcctctactgcgccttcttcgccttccacgccgcctccgtcctcgtcctcttcctctccgcctccatcccctcccccggcccgtactcctcctcctgccgccgctcctggatcccctgcctcgtctcgctgctcgcctccctggccatgctctgggcgctgcggtacaaggcggacacggaggccgtgctggagcgggtgctggcgcgggagcan

SEQ ID NO: 101319 - DNA, 510 bp, Triticum aestivum
  Clone ID: PAT_TA_101319
gcacgaggatctaccctagcctttcaactccgatcttttgtccgtgtggagctggtggcaggcgtacggccaaggagacgaagcaacggcggcgtgccaccgccacctccgatgcacagcagacacggcaccaccggcacaagattcgcttggggagcacagccgtcgagcaagagaggcccaccggccatggctgaccggacagattagaggcgaggtggattctgccggcaaggccctcttccttttctcatgttctgcgtgatctgaggcgggaggcgctgaatccttcccgattggccttcttcctcctcgatttggcccttctttccggcctccgctcatctccggcccgttatcgttcggttcccgtgacccgtccacccatggaagaccgcggccccgcatcctctgaatgtcgcagttcttctccacaaagactgtgcccttcatagtccgacggggcttcgtgctcttcctgcacgaggaaaatagcatatggtgtcgtcc

SEQ ID NO: 101320 - DNA, 538 bp, Triticum aestivum
  unsure (1)..(538): unsure at all n locations
  Clone ID: PAT_TA_101320
gcacgaggatgaaactcatgtacaaggtcggagaatatggtccacctcccagtggtgtcattcatgctatatctcctcgtctttatcagagtaccatggagcaactcgccgctgctggagcagtagacgttttgcacaataaggtgccgcaagtcatcaaagcacagacagagggactccatgagggctgctctgcccagaggttggccggacaagtctcaacgaagttcatgcggctgctggacccacaggtgggttctagcgccgcagctgagggcgatctggacgggaggctggatgaggaggcgatagacaatttgctgaatggggagggcatggaggacattgtcaaaacatcgataccaaaagcttattccaaggagattctttatgacttaatagtggagtgtgttgcacaataccgaaagtggctgttggataacagagacaagttagataaggaaaaatacaagcagtgcctgaagcagcttctacccatggcgaaacttacttcggtttatgataagnagcctgagnn

SEQ ID NO: 101321 - DNA, 520 bp, Triticum aestivum
  unsure (1)..(520): unsure at all n locations
  Clone ID: PAT_TA_101321
gctcgaggccagcacctcatactcttcgttgctttcctaactttggttcnnntctcgggagaagctaattaaccatcacctcatactccgccgatgcctccttcgcctcttgccgtccgcgaagaaccatgaactacaccgggagcgccctctccctcctcgtccccaaagccaccaaggacatgtcccgcctgcaccaaggctacgaccgtggctagctccggctagctactagtacttgcagtataccttttctgtttagatccttccccgttgtcagttgatagtttctcacaccgatcagccatgaaggaggtgggtcagaagaagaacatcctggccaagacgctccagaagtgccggtcgttgggccaccggaggcagccggcagcctacggcggtggcggcagcgccagtgccccggcgtcgccacgcgcggccgatggcnnnncggcggcgtgggccgtgccggcggggtacttcgnngtgctcgtggggccggagaaagagcgnttcgcgg

SEQ ID NO: 101322 - DNA, 540 bp, Triticum aestivum
  unsure (1)..(540): unsure at all n locations
  Clone ID: PAT_TA_101322
gcacgaggatgacaagggcgcagctgtccccaacctctgccttagggttcttgggtcgccattaacgcgcttgcagatccgcggtggagcaaaaataggcggcgctctttgcgatggagttcctgctgcaaccgattaggagcacatcggtgatggaagaagtcaatgacagccagcttccaatggagccgctgcacttcccggctatggcgaccgaggctgagcagctaccacccatggcgagtggtagcgttgatggggggagggctgcaggcgaagtggatactgaaccgcaagcttctgaacaatctattggacagattgatccgtagacaccaggctggactcacgtaacttacatgccattgttgattgcagtgcaggctcgtgggttgatttttgtgtgtgttgtagatggtatataagttgtgcttaattttcagatatttgtggggagagnnngtcctcgaaaaatgaaatgtagtgctagaattgttgttgcatcaatttgtagcagcgcttttnnngtaagaacaaata

SEQ ID NO: 101323 - DNA, 543 bp, Triticum aestivum
  unsure (1)..(543): unsure at all n locations
  Clone ID: PAT_TA_101323
gcacgaggtggtcttctcagattactatgctacgggcaagcttgatgtcgatcttgcagagaaggttattaagggaattctggatggatgcgaacaatcaggccgtaatctgataggaggagagacagcagagatgcctggtttctatgcggaaggtgaatatgatctaggtggttttgccatgggtgttgtggacaaggataagctcatcgacggtaaaaatatcgtggagggagatatcctcattggtcttccttcaaatggagttcattcaaacgggttctctctcgttagaagagtattggacaaaagtggactctccttgactgatcagttcccaggaaacgatggcaaaacaactaccttcggtgaaactctcatgacaccaactatcatctatgttaagcaggtgcttgagatcatcagcaagggtggtgtgaaaggactagcccatatcaccggtggtggcttcactgataacatcccgagagtatttcctnctggactgggggcgaannnttcactggannntgggaagtgcca

SEQ ID NO: 101324 - DNA, 554 bp, Triticum aestivum
  unsure (1)..(554): unsure at all n locations
  Clone ID: PAT_TA_101324
gcacgaggtctccnnnnggtgaaaagcagcagcatccatggcccccaaggcggagaagaagccggtggaggagaaggccgagaagaccacggcnnnngaagaagaccaaggcnnnagaagaggccgccggcgtccaaggagggcggtgctgacaagaagggcaagaagaaggccaagaagagcgtggggacgtacaagatctacatcttcaaggtgctgaagcaggtgcacccggacatcggcatctcctccaaggccatgtccatcatgaactccttcatcaacgacatcttcgagaagctcgccgccgagtccgccaagctcgcgaggtacaacaagaagcccaccatcacgtcccgggagatccagacctccgtccgcctcgtcctccccggcgagctcgccaagcacgccgtctccgagggcaccaaggccgtcaccaagttcacctcctcttaggctaggttgttccctgtcttcttggtcgatcgatggttctctgtagttagcttgctgttcgtactctgttatcctgtaacttatgtgctggttnn

SEQ ID NO: 101325 - DNA, 527 bp, Triticum aestivum
  unsure (1)..(527): unsure at all n locations
  Clone ID: PAT_TA_101325
gcacgagggagagagaactagcacatggaagcggcgttcaaagaaaacggcaccaggtggggccatctgaaggacctgcaccatgctttgaggttgtgcaagaatgctctcctctttgggaccccctccacgcagccattgggcaagctctacgaggcgcgggtgttcgagatcccggagcagaaggtgtgcgtggcgttcctgtccaaccacaacaccaaggaggacgggacggtgacgttccgcgggcagaactacttcgtgccccggcggtctgtcagcatcctgggcgactgcaagacggtggtgttcagcacgcaatacgtgaacgcgcagcacaaccagcgcaccttccacttcacggaccagacggtgcagaacaatgtgtgggagatgtacacggagggggacaaggtgcccacctacaagttcagcaccgaccggagcgagaanccctcgaggcctacaacatgaccaaggacaagaccgactacctctggtacaccaccagcttcctgctggacccn

SEQ ID NO: 101326 - DNA, 533 bp, Triticum aestivum
  unsure (1)..(533): unsure at all n locations
  Clone ID: PAT_TA_101326
cacgcgctcctccaccttcttccccgtcggggccatcgtgccaccagaaccaccgctcccccaccttcttctctgccggggcccccgcgccaccagaaaccccgctccccaccttcttcctggcaccgacgccgccagatctctcgcgccccggccaccgtggctccaaccaccgtctccccgctctgccccccctggccaccagcacttccttcgtgcaacaagggtagccgagcaccgcatccggccgtgggttcacgacgagaacccaccggatccggcctcccagatggctgcggccgtggggcgtcgaggtcaccgtggccctctcctccccagatccgaaaccgatgaaaaggattcctgggctagtgctcatcagtcttgggtgactagttttgcgcacgtaggagtgcagcttgaccaacgggacgtgcaatttggcccatggcgtcgacggttttccggtgaactcgcgtgtgcacgggcagttcccttggactatgcacacgtggtcgtttttatgaggggnn

SEQ ID NO: 101327 - DNA, 546 bp, Triticum aestivum
  unsure (1)..(546): unsure at all n locations
  Clone ID: PAT_TA_101327
gcacgagggggagctgaggttatgctggaactatcaaactccaacgggtggtgcgtggccgtgaagttacatggtgtcaccagagtctctcttaagccttcggagcagaggttctatgtcgtcaaccggcacacccatgcctacgtctgggcagtcgaagatggatggaagctcgagttccccgacaaatgggactggcttttgttcaaagaactgcatatcgagggacgggagcgcaattcccagggaaagattatcccgattccaggtgtgcatgaggtttccgatggcatgggagggactgtagcagatccattctcacgccctgtgccagactacatcagaacggcggatgatgaggttgcgcgggccctctcgagagactcagcttatgacatggactcggaggatgaagagtggctcattcagctgaagcacggggcctctgatagaagaccanccgcctgagccagatttcctacgaagatttcgagaagttaataaccgtgttcgagaaggacgcctacaataatcctgaggaagnnn

SEQ ID NO: 101328 - DNA, 525 bp, Triticum aestivum
  unsure (1)..(525): unsure at all n locations
  Clone ID: PAT_TA_101328
cgcggccaagtcatagtcggtacttgagatggagagaagggacaactcatactacgctcgattcaccgaaccaagatgtacaatgcaatgcataggtaaatgcactgaaatatgctacaaggatccggtgttggaagatcgtcagtggagtgcttatatcgatcggtcaccaggagaggacagttactccttggagtgcttcaacgcgtgcatctctgggtgtggatacaggtttgacataccggcggagaaagtggggctcatcaagccgaacaggccatccaagccaccgccgcctcctgtggtcgagcgggccaagcctggctcggggcctcctgcagcggccggtgaagacgtgcccggcacatcggcgtagcccatgatgatgccaaattttcgtgtaaactgttagtaagcgtcgtcgccgaattacccgccgttgttcaccttggttgtgatggatgttgtatgtgtttgggatgtttggtccaactccaacctcaccctgttgggtgaggagtagnn

SEQ ID NO: 101329 - DNA, 553 bp, Triticum aestivum
  unsure (1)..(553): unsure at all n locations
  Clone ID: PAT_TA_101329
gcacgagggaagaactcaacgnnntggagaaatgcattagagagtgctttagcgcaggcaccaagtgtagcgagtacagtggggcaaaatccaatatttaacgctgatggaacagaatcttctgaagcttcaactgaacagtcggaggataaatcatctgttattgggagacctgcacagtttgcacttgtagaggctgatggtagtccagctttcctggagaaggccttgaggttcattgaagattatggttgcaagggagaaggaatcctccgtcaatctgctgatgttgaagaagtcaaacgcagatttcgtgattatgaaaagggaaagaaagagttctccccagatgaggatgggcatgttattggtgactgtattaagactattcttcgagagatgccagcttcgccagttcctgcagcatgttgcaccgcgctggttacagcttaccgaactgacaagacaaaaagacttgatgctttaaataaagttgtatatgaagtnttnnncggaaccaaatcggcaattactgcagagnatccttaagatg

SEQ ID NO: 101330 - DNA, 480 bp, Triticum aestivum
  unsure (1)..(480): unsure at all n locations
  Clone ID: PAT_TA_101330
aaaatgagatgtggtaaacacatagaacatgtcattcttcccagatgaaatccggtactttatttatattatcagtccattacataatataaacacacctactaataattacacaagtcctaacatagaataaatctagaacaggactaaaatgtaagtagtagtcaacctaagtactaaacagtactaaacatagactaaaattgcacaaatacaataattagtactaatgttaagaaaacagagaaagaaaagaaaaaaatccacacttctggccggcccacccgccacagcactgcacagggggaaccatgggcgcctgggcctgggcctgcccggcctttggccggcccacacgccgccgcaccgcacaagacaggggggagcgggcggatcagataagggtcggagtatctcgaaccccgcaccaccacctctgctcgatccccattgtcacacggcggcgccggcgggagcnnn

SEQ ID NO: 101331 - DNA, 270 bp, Triticum aestivum
  unsure (1)..(270): unsure at all n locations
  Clone ID: PAT_TA_101331
gcacgagggagagagagagagagagaactnntctccagttttttttttttggactgnnnggtgggcgatcgaccggtgttcgttggacttgcattcttgttcgattcttcnnntaatttgttgttggtggtggtgttgttagtaagtaggtagtgagtggattggcaaatatgttctgtaagctaataactggatttgataaagtgtgatccatacatggttaaatctataaagggtgattggttagcaacgnnnnncaaaaaaaaaaaa

SEQ ID NO: 101332 - DNA, 523 bp, Triticum aestivum
  unsure (1)..(523): unsure at all n locations
  Clone ID: PAT_TA_101332
gcacgaggaannaatggcgcttttgtcgaacaatttcaaatattttatagcgaactaaaagacttctttaatgccggcagcctgtttgaacaactggaatccatcaaggaatctttgaatgattctggcttagaagcactgtcatcatttgtcaaaaccaaacagagtttggaccaagtggatgctgcgaacattcaagttgtgatgaagaccttgcagtcattgtcttcattgagatcagttctaatgaagggccttgaaagtggccttagaaatgatgcgactgatgccggtatagcaatgcgacaaaagtggcgcctttgtgagattggtcttgaggattattcttttgttttgttaagcagatatatcaatggtcttgaagcttcaggtggatcagcttcacttgcacaatgtgtggctggaaatacaagtgtatgggacgatacccttgatgcccttattattggcgtcaatcaagttagcttttcaggttggaagccagaggaatgcattgctatnn

SEQ ID NO: 101333 - DNA, 300 bp, Triticum aestivum
  unsure (1)..(300): unsure at all n locations
  Clone ID: PAT_TA_101333
ctttcaaaaatcaatttttccaaactccatcacaaaaaagtgaatgtagacaacaattgatatttctcctccacacaacagtaaagaaaattgtaaaaaacaatgcggctgacagtaaattcatatgttacaaactattgaaacataccaccagcagatctatctccaccttctgcatctacgtcgtcacatttannnccaccnnncacattctcctcctcaccannnnnntcatcgctgtcacaatcaccatcaaatttatgcacagggagggggagaaaaatacatgcatttctccta

SEQ ID NO: 101334 - DNA, 453 bp, Triticum aestivum
  unsure (1)..(453): unsure at all n locations
  Clone ID: PAT_TA_101334
gcacgaggcacacgaccacacgcagccgactcaagacaaacgggttagccttcgcgttcaagccagtgcaatggtggtagccagcaaggagccgttcccggcggtgcgcaagtgcgacgcgtcgcgccgtggcgaccacaccgtggtgtcggacctggacggcacgctgctccggtcgcggagcgccttcccgtactacgcgctcgtcgccttcgaggccggcggcgtgccgcgcctcgcgctcctcctgctcctggcgccgctggccgggttgctgtaccacgcggtgtccgagtcggccggcgtgcggatgctggtgttcgcggccaccgctggcgcgcgcgtggcggacatcgagtccgcagcccgcgccgtgcttcccaggttctacgcggacgacgtgcacccggacgcgtggcgcgtgttcnnnncgtgcgggcggagntgggtggt

SEQ ID NO: 101335 - DNA, 543 bp, Triticum aestivum
  unsure (1)..(543): unsure at all n locations
  Clone ID: PAT_TA_101335
gcacgaggagccaaggcgatgcgaggcgcgcgattcaatctaccggagttgcaggtgcgcgatgggatcggccgggggcacccactaccactcatatcctcgtcggcttctcccttccctcaggccttccatgccctcatccgcccatccacccccggcggctccaggaggagcaccacaaccgcaggcatcggcggcggcacgccatccacaccgcgctcgcgctccaccggcggccccttcagtcccgagcccaacttgccgccgtcggctgcggcggccaggccgtgcctctccttccacctaggctgcttccaccggtcccgagatccgccgacatcaacccgtcgtccagcaccgggtgcctaagatcggcacgcctcctaccgataatcaactgctagagatttcagaaattgttcaactgcgtagtttttggttatgtctttttcgatcagcgacccggaccagtgccatggcaacgagtgtgtccccctaccacgaccttcaacttgagtggcagatnccaccatgacttggcag

SEQ ID NO: 101336 - DNA, 612 bp, Triticum aestivum
  unsure (1)..(612): unsure at all n locations
  Clone ID: PAT_TA_101336
gcacgagggaagcccccaggccattttcaaggacccgttcaggaggggtgacaacctccttgtaagtcgttgctactactttttatcttccttgtttctttcaaactttttgtgcaccatagatgctggatgccataaagtaggaaaagtaagatgcagatgggcatggtctttgaaaaaactacaggaaaacattgttttctgggcacttttacgttttaaccttgtcaagatactattgtttaccgtcgcaaaattataccgttgctaattatcaggggcttaatttttaaaataaaaactgaattttgtggctgtttgatgtgcttggacatatgtgtgatttggtagacaaaatagccaggtgcttgtgccctgctgtataaacaccccaaaattccaccagttgacctacttggctcataattaattgcttatgagaccgtctcttcagaaaaacaacttggcctttcagaaacagtaggtcaactgtttgactaacacaaatcttaaatacttgaactgaaaaataaataagcttgagctaaatcnnnnnccangtttctactgtatttggtgcaanntcgttgggnntgnngatctnnnntctgn

SEQ ID NO: 101337 - DNA, 621 bp, Triticum aestivum
  unsure (1)..(621): unsure at all n locations
  Clone ID: PAT_TA_101337
gcgcgaggggttagcgaccgggaggccgccacctctcctgacctcctcccaggttcccgatctggagcagcgaggccaacccccctccccttcacacgcagagctcgggctggagcgctcatggggtgacggattcaagggctggagctctcacggaatggaggtgctcagactagaggcagcggaggacgccctatgagcgagctggaggtggaggcgagaggatgggaagaggcctggagtggctcggggcagtgaaggggaatagagatgaggaggcgcggagtgaagagccgggaaggaggagggttcggaagagagaagagaagagtgtgtcgaccatgcgcttgtatggaacaccatcagccgatccacactctgctctgccaaccttgcttcatttggcctctgcagatacccacacaccttcaccccctcttggttcttcgtttggctggattgtaggtggccttttgcaagaagagtttcagtgctcagcatattgcagtcattgcagcagcgagttctatgaagcacatcaatcannngtacatagtcaatgacaatccctcccatttaattagatggtttgccagtttcttcatgtagatagtatcatnn

SEQ ID NO: 101338 - DNA, 363 bp, Triticum aestivum
  unsure (1)..(363): unsure at all n locations
  Clone ID: PAT_TA_101338
atatgannngtaattcattcacctcctctgtacatactacaggcttcatcatcacttttgtttttgctaaatacatgtctcatcatcactaattaagcaaccagcaaaaataaacatgaagctcaataactatccatagacaggaggggagcagccagagaaagccacgaagaaacagtagcagcagctgaaggtggaccagggctcgccgccggagagtaagcgggaggtgcggttcgcgtnnnagttcgacggcatcagctgcttcaagtccatgatctccttctgagcagctgaccctcctgtctatggatagtttttnagcctcatgtttatttttnnctggttgnnnactttgtgann

SEQ ID NO: 101339 - DNA, 624 bp, Triticum aestivum
  unsure (1)..(624): unsure at all n locations
  Clone ID: PAT_TA_101339
gcacgagggacaagcgccgttcacaacccctagccaccaccattttcatctccctacccgtctccaccaccatagtgctctctcacctagttcatacttgtaatcatgcatctcacaaggcatccactgtaagacatattagaatcaatcaatcccaagatgtgttcttcaatatttccctcttgcaatctgatctccatgtgtgagtagttcagtaaggtatggggtgaggcatgagccttgaaactccaggtatttggtgaagggatcaatggaagtctttgacacaatgtctcgtatgtgtgaaataaaattgtttcgtgaagtatctcttgtcttgtctgcgaccttcatccctacaggtacctaagatcatggagattgggcaccggtgaggctaggagcaaggggaccaagaagtattataccgaacactggtgacagtaaggtttagtagggtaacatggatcatatccttggggattcatgnnntgtagtccttaaacgcccaatgcttttgtctgatattattatcttaattatcnnnncaaccccatgagnnngatagggcctttggtnnnncaactaattcttgatgcnnnngcatgccggtcangnnnntat

SEQ ID NO: 101340 - DNA, 621 bp, Triticum aestivum
  unsure (1)..(621): unsure at all n locations
  Clone ID: PAT_TA_101340
gcacgaggcacggttgctgttttcttcatcgggggtctaattatcgttggacaatgtcgtcctgagccagagaacatctatgatgagggcaaactgacattgaaatggtgtcttcaaaaggattgcaagaccaaaggtgacccatggacctggaaaagggagtgcatctgctgcgtcactcttcctgatgtaccttgttatcattcccaaaatgagtgccaaaagaactgcccaataaggtgaaatccaatgcggccgatcttaccttatttacatttactaatttgtggcaccagctgagctttttgagttaataacacttttagtacataaacttgcacagtgcgtacaaattcatacacaaagttgaaaaatgacacaaagtagtccaacaacttgtgtttgaagtacatttacatacatttccgcccctagtcgttatctccctgttaactctgcgtggtctctaagtatgtggcccacctgtaagtgggaaatgttctaaaaaaattgtaagtgggaaaagaggaagaaaaaataagaagagttgtgcgttgctcccgcaagactngaactcgagnnnccgcgacacnnacgtgatcgactnnncagtgagctaca

SEQ ID NO: 101341 - DNA, 363 bp, Triticum aestivum
  Clone ID: PAT_TA_101341
gcacgagggaagatatttctgatgtatggattggcttatctgaaactctttttcctctctttgctgactgcttcttgttttttcttttttggactgcattttgcttaccacctttgctcagagggagttcatggcttatatctttctaaaagagttttgcacaatgtagtgcaaccatgctgttaacatccaagaccatgtagaaatatggatgtagtagtagacacaagaattatcttcacctttgttagctgtttttagtgtcatctctggatgatatgatgtcaattgtctctagtttgtatatgcaggaagtcccttgtcgtatgataaaattatcgtactatgtttaaaaaaaaaaaa

SEQ ID NO: 101342 - DNA, 411 bp, Triticum aestivum
  unsure (1)..(411): unsure at all n locations
  Clone ID: PAT_TA_101342
gagagagagagagagagagaactagcagcgatttgttttgtaatagatttgttttgttccccgtaggaggttaggctgctgttagatttatctgattttactgtcactgttttgctgttgagtgatgcagtgcggttgcagacctgaccataagtgtacaaagctatttatttttcttgagctcttgtgactctcgagatggatattcacgctagcagccgtatctgatccattctcaagtttttgagatggatggtgtctcctgtatgatggattcatcttattttatttgttctccaccatttttcagccaatggactgattttattttgttccctctcaacacttagcacactggattgatcttattgtataactttttttcataatcattatatgaactgccatgnn

SEQ ID NO: 101343 - DNA, 347 bp, Triticum aestivum
  unsure (1)..(347): unsure at all n locations
  Clone ID: PAT_TA_101343
gggcatgctttaccacaattttttttttaacatantcaaccatttgggtaatacaggggggacgggtaattctcttcatttacttggtctaccacatttactttcactttgatgacgtaattcctacttttggtccaacacataactttgtgggaaatattacattgatgattctgacactaaatttgatctgaattattgacaggggatgcaaatgccgacctttnaccgcgttttgatttttggggtgcccacaattcttctcattatgaacaccatatgggttgcaaaaatcttgagnnngcttaaaaagacccttacccaaanngggtgaaaannagaaaaat

SEQ ID NO: 101344 - DNA, 616 bp, Triticum aestivum
  unsure (1)..(616): unsure at all n locations
  Clone ID: PAT_TA_101344
gcacgaggcgtcgatgtagcattgctgatcgcagacttgaccgagatcgcaaccctaataaaccatggcaacctgtcgaactgccacgacgtagacgctagtacgatacggatccaagagcgcccatccccaagactagctgagagaacatgagcgccttgatcaggaatctgcgccccgcgctgtccgggctactccggcccaagcccgccgcccgaacgactgttccgccgccgcccaccgccaggcgctactaccacgcgccttcaacgcggcgatctcacgaggccctgaaatcgcccggccgtgactctctcgtccgtcgaccaccgccgtcgccgcaggcaccagcggtcccacgcccacggtactactcctccaggcgaccaagaagttctaacgaggtgaaagtccagatagtcatcgcgggggtcgtcatcgtcggcggtgtgggtggtcacgatctgctacggcaccttcgagaccgtgccctacacnnnaccgccgccacttcgtcgtcctcacgcactcgggagagcttaagctcggcnnnncgcagttcaacgacgagaagannnnngctgggcgacnnnnnnctccctccctcccaccccaa

SEQ ID NO: 101345 - DNA, 623 bp, Triticum aestivum
  unsure (1)..(623): unsure at all n locations
  Clone ID: PAT_TA_101345
gcacgaggcacgcagcgtcgaccaaccggaggggccgagcttaattagccgcacgtacccaccaccaccaccccttgctcccttttcgcgcgccaattaagctaggccgtcgccgccgtcgtttccgccgccggctggccgggcaagatgccgggggccgtgatcgtgcaccaccacaacaggtacaagacgtaccccggcgatgtcaccggcttcgtcttctactcctgcctcgtcgcctccgtcggcggctgcatcttcggctacgacatcggcatggccgccagtttgacgtcgacggagtcgttcctgctcttgttcttcccggacatctaccagcagcagaaggatcaggtgatcacgaaccagtactgcaagttcgacagccaggagctgtccctcttcggctcctcccttttcctgtccgcggcgacggcgtccctcttcgcgagccccatggcccgcgccttcggcaggaagtggacgctcttctacgccgccgtcgcctacatcaccggcgcctgcatgggcggcattgccaccaccttcgccgtgctcatcaccggccgcttgctcctcggcgnnnnnnggtcggcctctgcatccacgcctcgcctctnnac

SEQ ID NO: 101346 - DNA, 527 bp, Triticum aestivum
  unsure (1)..(527): unsure at all n locations
  Clone ID: PAT_TA_101346
gcacgagggagagaactaaaccataacaagattagggaggtgattgttgaaactaatcttgttattagtattaagcatttaagattaggtcatgtttaatttgttgcatgtaatagccacgtaaagatgcattagtcagccaagtacaaagaaaattgcatgctcggcaacatggcgtagcggccggatcagcagcacagagatagagcgagtgcacgcgagcagatcggcaagccaggagatgagtggtcgtagtcatgtacgtgtgtattaggtgaccaagtgatcagtgcatgtaaagagatgtggcatgcgtgcacatgtattagtgcggtcagatgtgtcgtatgaggctacatgcatgataaaatggccaagtcgtgtggccgttgcgtgaaccttgcgtgtagccaaagtagttagttaagataagcagagttgtgtgggcagctagctacgcatgtggatcaagctattagtggcttgaccacgatagctatttgtacgtatgtgcatgctnnnangtg

SEQ ID NO: 101347 - DNA, 627 bp, Triticum aestivum
  unsure (1)..(627): unsure at all n locations
  Clone ID: PAT_TA_101347
gcacgaggcaccgccggccaggatcgaaacaacccacgccgcccgccgcggagctcgggcaaaatccagccgtgagggaagtagatcccgccaggtcaagcgaccaacaaacgcgaggaccacccgcggcgccagatccgttggtgtacacacggccacaacggtctcgagccgaagcctcgaggcggctgggagcaccttccacggcagcgccgcccaccgtaccccaaccactcacgctttcgacgagcagtgcactgcgccgccaccaattcggagcgccgcaatggccgtatcggcctatccaagccggccgggcacgaggaggaagacccgccgtcaccatctaccgagtgggctttgaccggcggcagtgagggagcaagacgaaggaaggagctcggagagtagcggccaaaattgtcgacggaagcaacggggatgttgcagtggattcctaccatctttacaaggaagatgtgcgcctcatgaaggatatgggaatggatgcatacaggttctccatatcatggacaaggattcttccagatgggactctgagnnntggagtgaacagnnnnnncgtcgagtattacaacaacttgattaatgagctattatcnagan

SEQ ID NO: 101348 - DNA, 637 bp, Triticum aestivum
  unsure (1)..(637): unsure at all n locations
  Clone ID: PAT_TA_101348
gcacgaggcggcgaccccacgacgagcgcgagaggacggcgaggagaggtcgggaacggactcgtccgaccgctcctctagcgacgaagcggaggacggggggcaacagaggtggcgggtggagcctgtcgagggcccgacgaggtgaggtcctggccggtgacggactcgcccaaccactcccccgaagacggaacgggaggtcgtcggcgtccacatcgtcgtcgtccgtgatgcttggnggatgggctcgcctccgttgcgccgccctccgcacaaggaggtccacagcgacgcgacctgcacggcgcgccatccccggcgacgcgctctacgcccgttcctcttggcaggaccggcggccgcagcggcccacgaagctcgtcccttgcgactccattcctgtacatggtcgatagccgtcaggcagaatcaccgggggctgggacgcatcggcctgcgcgacgacgccatgagctgcccggcttgcgtgtnnnnnnttgctcactggcgactagctcgatggggcagcagcaacacggatnnnntgtgttgcacgcacnnnnnngctgcgannnggatctgcacactgtcgtcnnnntcgacgggaagcaccagcaccggcagcagtgcgtgn

SEQ ID NO: 101349 - DNA, 626 bp, Triticum aestivum
  unsure (1)..(626): unsure at all n locations
  Clone ID: PAT_TA_101349
gcacgaggctcactttcccctttctccagtcttgtgttcttgtcttctcgggagctcccatgagggaagccggtccagcttcgatccaccgcgtgtgaggactgatctgatgctcccctcatttccttcttgatcgtcctcacctgcacgcaccccacgtcaagggtaagtggtacggccacgctgtggctttctacaacagctggtttggatccccccgtgcctcgtggtcgtggatctctcgggccagtgaacggcgacggaggggttgcaggtcccgaatagccgttgcgcgagggaggaggcgagctcgtcgaagtcgattgccgttgcagtcggcctccatggaggcgatgagggtgtcgatctcgtcccccgcagctagcttggatcctgcgcgagtgtgaggtttcctggnnncgttgtcatccagaagcgccgaaccggacgcgtcgttgttgtcccaaagcgagacagcttatcacgctgtcttcattcttgatagctgcagcccggctctggcgttgcgttcttccacctgcagagtctggatgttgccgggattaattgacttgctgcccnnnnncgctgaacttagcttcatcctacttcttggcnnnnntcgn

SEQ ID NO: 101350 - DNA, 620 bp, Triticum aestivum
  unsure (1)..(620): unsure at all n locations
  Clone ID: PAT_TA_101350
gcacgaggctcgacgcagcctgcagccagagagtcccaaaccctagcctcgccggaatgagccgcccctcgccggcgcccgcgctggacggcggggtcctcctcgaagagatcctcctccgcctccctccgcagccctcctccctcccgcgcgcatccctcgtgtgcacgcgctggcgccgcatcctctccgaccccggcttccgccgccgcttccgcgagcaccacggccggaacaacccaccgccactgctcggcttcttcgaaaaggaattccgcgtagacaagccgcccatcttcaacaccacggcgacgggcgagcgggaccgcatcccacccgcgcgcttctccgcgccatggagcctgggcgagggctgggagtttctcggctgccgccacggcctcgccctcctcatctgccgggcgcgccgcgaggcaatcgtgtgggatcccctcacgggccaccgtcgccgcgtcgcgtttccacnnnntngaagtccgtccagaacgccgcggtgatgtgcgccgccgccggccaagatgggcatgtgcacggtgactgccggttctccccatttannnngnccttggtgcgnnngggngttctaacggcacacgcca

SEQ ID NO: 101351 - DNA, 225 bp, Triticum aestivum
  Clone ID: PAT_TA_101351
gcacgaggagagagagagagagagaactagtctcgagttctgataggttgtgaagttgtgataggtttagatgctcggtaagtagctattttcacaccttggtatgaaaatgatccttgctagataaggccacattaggttaattctgcaggactggccatggatttgttgtccccaatacctgaataaacatgtaaataatcttttttatacaaaaaaaaaaaa

SEQ ID NO: 101352 - DNA, 643 bp, Triticum aestivum
  unsure (1)..(643): unsure at all n locations
  Clone ID: PAT_TA_101352
gcacgaggctttccacggccattacccattcacctctcattttctcctgcaatttttgttcttcttgcattctgtgcgccttcacatccttctcatccagagattcagttgggcggatggtgcaagaagcttggtggcaatgagggtgtcgatggactcataaagaacacacatgctacagagatctaaaacaacagaagcaagtcatacagaagaaacaatagacctgaggcaaacaatgggtctgtcgatctcatacccaccggatgactacttgccagcagatgatgacaactcggacaggctattcgtccggtccttaagcttacacaacctcggcagccttgagacccctgattcgccaccggaaatatccgatgccgtgagctctacgaagcctgcaagaaaagggtccttaaatgccaggagaaaagagggtcctccattacatgtcgatactacgaaacccagggcgagtcctaaacctgacacggaatgttgtacccataagcacaaccacagccttccaaaatatggcgcaaattacctgccaccaaattctccggtggtcgggatggtcagcccgcagcaccaggccgcagcagtaagggtgcagnnnntatacangagcttcagnacangn

SEQ ID NO: 101353 - DNA, 533 bp, Triticum aestivum
  unsure (1)..(533): unsure at all n locations
  Clone ID: PAT_TA_101353
gcacgaggggcgatgtcaatggcggaggagcagtactacgggggcccgcgcggggcgccgcacgggctgctgctggcggtggtggtggggctggtggtggcgggcccgctcttcctgggcgacggcggcgaggcggtcaccgacgccatcgccgagctgctcagccccgtgggcctgctcctcctccccgtgggcctgctcctcctcatccgcctcctctcctccgaccgcggcgccgcggcgctcgccgacgtgttcgccttcggcggctcgcccgacgccgtgcaccgcgtcgggggctcccccatcggcgtggcgctcatgctgctcctcatcctcgccctcctctactaccgctccgcgctcttcggcggcggcggagacgacgacgagtaggcgactgccagtaggtagtttccgtctgatctcggggttgttttgctagtttccgtttcatggctgggcctnnntgtaaaagagcggtgtaaattaactgttagctactcgccgtgttggtttgctctgcgtnnnnn

SEQ ID NO: 101354 - DNA, 609 bp, Triticum aestivum
  unsure (1)..(609): unsure at all n locations
  Clone ID: PAT_TA_101354
gcacgaggcactctctccgccttcgaagtgataaaggatttgctaccggatgttgtcatatatcagtttgcacctcttgactgtcctgacgcaatagaaagtttcattggatactggaagccaagtttgatacttctcatggaaagtgaattgtggccaaacctcatcatgtctgcagcagagaaagggattgcagtggctcttttaaatgcccgcatgtcactgaagtcgttcaaccgttggtctgtgcctctagggttaccattagtctctctgatgctctctaaactatcacttgttatcccactgagtaccatccaggctgttcgttttcagttgctccatacaccaccgtacaaaatccatttcgctggcgatttaaaatatgctgtcggtgatgttgaggttcgggagaaagagttgaatacaatcaaagatctgcagcggcagttcaatgataggcccatctggatggcagcttcaattcacagnnntgaagnnnaagtccttctccgcgttcatgacgagttaatcaaggcgtatgcttcgctacttttaatnctcgtgcnnngacatcctcnnnacatcaagaatgtttctttggcactg

SEQ ID NO: 101355 - DNA, 630 bp, Triticum aestivum
  unsure (1)..(630): unsure at all n locations
  Clone ID: PAT_TA_101355
gcacgagggagaaggccactcaccgccgttggcccatccctcacccccatctgccacccctcccctctggatctcctcggcgcttcttcatccatctttccctcacgcagcagcaaccaaaaaagcggcggcaacactgcagccacggtcggggcaaaaggtgggcagcgacgacgacggcgacgacgcagtcctcatcgtcctgagctcttctcctggatgcgtgcctcccttatccacatccttgtcctgtggtgtccatcccctgccgcccgtcctctcctctctctccataaggaggcctgggaaggagccgacgctggggctgcgtgcttatggacgggatggcggcctggacggaggtctagtgaaataggttgatgattccttaatttctgcccatgcacgaggggctgaaaagaagtaagtccacattccatggtatcacattcttctctattttgaccacaatgtacattagaatattttcccaccgataatttagggcctatccagtaaaggatatatattttgaatgtctgcatatcggaattttcggttgtttgaatgtcgatcttcataattatatgctttaaatgaagtttccttcttaagtctgtatgtgatnnn

SEQ ID NO: 101356 - DNA, 622 bp, Triticum aestivum
  unsure (1)..(622): unsure at all n locations
  Clone ID: PAT_TA_101356
gcacgagggcggagcaggtggcgatccccagtcgggctacatagggccgacgacgatctggacaggggcggtttgaggcgctcgcgcacggagtggatccagcagcagccgcgtcctgcatcaaagatgcggctaggaatcagaggagagatgggagggaggaggaagggaccggggatgggctcagcgatgcgacgacccttgtggaggctggctggcggctgagtcacacggcaacggcggcgcgcgtgtggcatcctccctggtggggcgagcaggaaggaggaggtgcacgggaggcgtaggcgctgtggcctatctgcagaggtggacgacagtaataggagaactggaacaagcgccggaagcggccgtgaacatagatgcacagttctgcaaggaagaaaccagggtgtacagaggaagggagatctcaccccaggtctccgagctattgactgggaagatgaaccccaggcagccgggctggactggtttaaaagtaacccgtaaaacttactaattttaattcacttggtacacgtcatcagtgattcagtacgtgatatcggtattgagtgtactagcagtctacagatagnnnngcgtctgtatgctgagc

SEQ ID NO: 101357 - DNA, 182 bp, Triticum aestivum
  Clone ID: PAT_TA_101357
aaacacaggtcgatgtttgtctggcgagccttgcaccccggagcgggcgcaggaaacaccgcaccactttaagttaatacccagttgatatatatttatgcttcctaatacaaatatctgaaaacaaaaaattggcaaactaccaacgggtgaattattctgaatgtacaaataaaaaaaaa

SEQ ID NO: 101358 - DNA, 594 bp, Triticum aestivum
  unsure (1)..(594): unsure at all n locations
  Clone ID: PAT_TA_101358
gcacgaggcctccatctccatcaaggttcaagccatctgatgacgctcttgcaatggaagacgaacttaatagcgagtctgacagcgaaagtggtggggaagtgcacccatggaacgaacaagatttagttgttgttgatgatgatgatagtcatagcaacagacttgagcactccacttctgctcctgacgaatctattatacaggctgataacttcagcaggttgccttcaatgaagactttcaatagatcccataacatagtaagttttaaagattacacctctcttttggaagagccgatcaaccaaaagatgttaaccaaaacactcagtcactcagaaaggcttggaatgatttggccagaacaaccattggatatgttggctcagtgtcttccagacagcacaccaccatttgcttccgggaaggcactaaaaacatatttgtcttccaaatcagttaatgaagnttcatgtgcttttccagnnnatagtgcacttcatggtttaaacattggaagtgtggtagctaaaggaaaaagaccatactttgtaaggataataagcaagcagatggtcggggtatttctnn

SEQ ID NO: 101359 - DNA, 541 bp, Triticum aestivum
  unsure (1)..(541): unsure at all n locations
  Clone ID: PAT_TA_101359
gcacgagggccgcacgcacgcaccatggcgcccccgaagctctccttgctggtgctcctcgtcctcctcctcccggcggccggcagcgccggcgccaacgacgtggccgccgacgcgcccccggtcggggccgccggcggcggcggcttcaacgtctcggagatcctggccaagttcccggagttcaccctcttcaactacctcatcagcaagacgcgcgtggccaaggacatcaacagccgcaactccgtcaccgtgctcgcccccgtcaacgccgacgtcgactggctgctccgccgcagcgcgcgcctgccgcgggccgccttcctcgagctcctctccgtccacgtcgtcctcgactactacgacgccgccaagctggctgccctgccccgcggccgcggcgccaagcccgtcgtcgccaccacgctctaccagnccttcggccccgccaacggcgacaagtccggcttcctcaccatcacccccgcgcccgnnnnnnncgccgtcttcgcctcggnnnnncccggcgcgctcgtca

SEQ ID NO: 101360 - DNA, 657 bp, Triticum aestivum
  unsure (1)..(657): unsure at all n locations
  Clone ID: PAT_TA_101360
gcacgagggagagggagagagaagggaggagaggtgtatctctgcccggccacccaagccaagcccctcccgaatctctctctcctcccctaccattgccttgccccccgctccccctcccccacgcacacgcacagatccatccgcggccatggcccccgcaatgaggccggagcaggaggcgagctgcaaggccaccgaggaccaccgctccgagttcgacgccgccaagccgccgcccttccgcatcggcgacgtccgcgccgccgtgccggcccactgctggcgcaagagccccctgcgctccctctcctacgtcgcccgcgacgtcgccgtcgnnnnnnnnnntggccgccgccgcgtgggcgggccgacagctgggccctctggccgctctactgggccgtccagggcaccatgttctgggcgctcttcgtcctcggacacgactgtggtcacgggagcttctcggacagcggcacgctcaacagcgtcgtcggccacctgctgcacacatttattctcgtcccgnnnntggctnnnnnatcagccacagaacgcaccatcagaaccatggccacatcgaaannnannngtcatggcacccgatcactgnnnnnnnntaccnnnaattggaaccacggacnannnnnctgc

SEQ ID NO: 101361 - DNA, 650 bp, Triticum aestivum
  unsure (1)..(650): unsure at all n locations
  Clone ID: PAT_TA_101361
gcacgagggtgagacacaggccatcctgccagaggtttttaaagctctttctgggtttgaaatgggaagcgaattctcagaagaaatggtgtcaaaattaagggattatggtcaaagcattgtggaaaataaggctaaagaagaagctagcaaaattttgatgcatatgaaggaaaggttcacagtggtgtttagtcatgacaaggactcaatgccaaggacctggacaggaaaggaagatgtccgtgcaatagcaaaggaggctcgatctgctgctctcaaacttctgtctgtattagccgtcattcgctgggatgacaagccagataggattgaaaacattctgatttccaaacttctagatggttctgttgcgtcaaagagttcaagtgcttcttctggtgacccgcttgcttcaactaactgggaagnnnttcatccaaagcatacgcttattaccccagctcagtgcaagtcagtgtggaagcagttccaatcagaaactgagttcaccattacacaagcagtatcaacgcagcaagctcacaggcgcggtaatggcagactgcctcctccttgggcgctggttgctatggcagttcttggnnnngatganntcatgatgcttctgnnnnnnntannnacgtgtt

SEQ ID NO: 101362 - DNA, 366 bp, Triticum aestivum
  unsure (1)..(366): unsure at all n locations
  Clone ID: PAT_TA_101362
aacttaaaaattttttttttttttttgaaaaaaaaaattttaacaattggaggattttatggcattaataaactnncaaccttcaaaaaaatttaaaaaaaaggggggaaaaaaaaaaggaacggttttaaaatcccctgcatttaccatttttggccggggaacaaattattttaaaaccattcaacagttttttttattcaataacaacgggggggggggtttcttctttattttgcaagcttttgnattnnncaaaaaaaacctttcacccaccagggcacattaaacctttaggagggtttttttcaattttggcccttttttaaaaaaaaaaaaaaaaaaaaaaaaaaaaaaaaannttgg

SEQ ID NO: 101363 - DNA, 275 bp, Triticum aestivum
  unsure (1)..(275): unsure at all n locations
  Clone ID: PAT_TA_101363
gcacgagggtcaagtgattgcgcatatctggagtatataggaattttttggtttttgttcatgaactcgttgagccgtttgagactttcggctcaagaatttcatgggatatagaggataaaaagctggtatacggaaatccatttttgtactttatattgtaaaaaaatggtgcatcgaacgctgtgttcttcgtgcccacagacagtatatggaaatatatatgacactctagtcgcccagttttctgctgtnnnaaaaaaaaaaaaaaaaaa

SEQ ID NO: 101364 - DNA, 545 bp, Triticum aestivum
  unsure (1)..(545): unsure at all n locations
  Clone ID: PAT_TA_101364
gcacgaggtttcaaagtagctccttcttcaaactggcgagattttatcaagcagacccctgtgaactacattctctggaaggttttctggtacaagctgataccaaatttcaacacccttccttatttcaacttgttgggaagcattataaagtaccatcgccatcttgttcatcatggtcctgaccatgccagggatggcaaggtgacaacaatgtcgagcacagatgacagcgagttacttgctgcagcgcatgaccaggattgcctcgcagagtgcatcaagaaccttctgcaacagaagaaagtgaccagcgacgtcagtgttgtgcttgacgcttacgctgtgacatgggagctgtgattatgcttgcagcattaacgcttaacatgtggcgaaggactaacaacgaggctttaggacattgttgcacagagacgtgactgtgtgagtacagggtagtgttgatgcgaccttcagggggctgtatgtagtgttggtannnnntgtgntnnnnnggtgctcggatgcactttaattgctgt

SEQ ID NO: 101365 - DNA, 620 bp, Triticum aestivum
  unsure (1)..(620): unsure at all n locations
  Clone ID: PAT_TA_101365
gcacgaggctgggaccactccgccttcgtgcgcgcctacgcgctctacctcgacgaccgcgtccgcttcctcctcgccctcctccccgcgccccgcacagtccgcttcgccgaccacgacgggtacgcctacggtggccgcgccgccgggggcgcctcgccgcctccggacatgacggtctcggtgcacgacatggacgtggaggggctcctggcgcgcgggcagcagctgcgccagctcatcgaccgcttcctcgcctgccgccccaccggggccgccaggcgcagccgcgtcgtgctcgccacgctctggcccgtcgtcaaggagagcggccggctctacgaggacgtcgccgtcgtgctcgccgtcctgctcgaccgcttcttcgacatggagtaccccgagtgcgtcaaggccttcgaggcgcacgtcagcaccgccaggctcgtcgacgacctcctcgccttctactcgtggtgcgacgacgctggcgtcgcgcgctcctctgacttcccgganntcaagcgcatcgacgacaagctcctcgagacgctcgagcagttcgtgcgggagcgcggcnnnncnnnnnnnnactcgccgccnnngcgacanncgcagca

SEQ ID NO: 101366 - DNA, 234 bp, Triticum aestivum
  unsure (1)..(234): unsure at all n locations
  Clone ID: PAT_TA_101366
accactttgattccatttttgaataattgattcatttaacctgcaaccaaggaaatctgaccttttccttatttttttttggggtttttcaaaaatgatttgctgctgttgttgtttcattaattggaaaagggttttnnaaggaatgaaaaaaaattttttacccccttttggccggtgattgccaccgtttttttaaaaaaaaaaaaaaaaaaaaaaaaaaaaannnntggg

SEQ ID NO: 101367 - DNA, 631 bp, Triticum aestivum
  unsure (1)..(631): unsure at all n locations
  Clone ID: PAT_TA_101367
cggcacgagggagagagagctgagagagagagagcagctaggccaggcttggcaacaacatttggtatcatgagttggttcatcttgggcatcgttcttcttgccggaggcgtgccggcggtggcggagttcggcggcggctgcgcgatgctctgggccgtgtgtcggcctatggaggttcgcggcgcggcgaggaggccacggtggctgcggcggcacgttgaggaggccgcggaggacctgcgtggtggcggcttcaacgacgacgacggcgcggcgagcgcgtcgtggcggctcggcgcgacaacggtggaggtgcgtggcacagagccgcggcgctcgtgttggatgcgtcaggcgcgtgtatgggcgcgcgccgggcgtgtcaggcgcggcgggaccgtggtgtnnngtggtcgttggcgagcggggatgtgcccgttgagctggtccatcgcgggctcgccgcgcccagncgtgtgcgtgcatgtcggagggggcgcgggcagnncgggtgngnacgggcgctcgacgtgggctgagncgtnnnnngcgtgcccggcgcatccctgggtataaaaccnnngtgtacgttgtaatggcagtgcccgganncgagnttgagctcgnn

SEQ ID NO: 101368 - DNA, 391 bp, Triticum aestivum
  unsure (1)..(391): unsure at all n locations
  Clone ID: PAT_TA_101368
gcacgagggctccctcgatctcctcccgtccaaaaatgtggcgccgccacctcctccgccgcctcctaccatctccggccaccgccggcaccccctccccgttggttcgccacctcttcacgacccccaccntcttctccaccaccgataccacctccatcgccttctccctctccgcggcggtcaccaagctctcatccaccnnngcccccgccnnnttcccggacgcctacttctacctccacttctgcgannnncgccctaccaacgcgctcctcgccgagacgctcnnnctctcccctcccgccacctctcgcgccgacnntgacctcttccnnnnnctcgtccgacgctcgctccacccctccgacnntgctctagctctggtcgt

SEQ ID NO: 101369 - DNA, 646 bp, Triticum aestivum
  unsure (1)..(646): unsure at all n locations
  Clone ID: PAT_TA_101369
gcacgaggcgacaacccaaagaccagcagcgacaggcccggtggagctgccattgggttcaacgctgcagagaatcagcagacaaggcttgcgcttgttagaaccaagacacccgtgggagttgaaagggacatggagatgcttgggaaatggatgctgacagctgaggggccggcagagaccattgcacagcaacttccaagcaatagcaccgttgtccctgtggaagaacctaatgcagatccaacaaaccatggtgtgctatgcatagtcggattggcaggggtgggcaagaccacaatagccagatcattatatcaaaacttcagtgatcagtttgaccgcagggcgatggtcacagtgtcacagaaatctgatgtagaggcagtactaaggagtatactctaccagatcatgccacaggtcagagaaggtaccaggcagcagcggtggtgggacacatctcatggcagtattnnnngcagcaccttgaagaaagcacgtgatnnnntacaaacattgaaacttcaaaaactcannnnngagcttannnagcacttagagaaatacagttacctgctcgtgctggatgatgtttggtctactgatatgttggagctgatnannaagtcactgcctaaaagtn

SEQ ID NO: 101370 - DNA, 667 bp, Triticum aestivum
  unsure (1)..(667): unsure at all n locations
  Clone ID: PAT_TA_101370
ctctgggccaggtccaggatccatcgagatagtcattcgtcgaggtcatatcgttgaagatggatataggcagttgaattgtcttagatctaagctgaaatcttgcattcatgtgtcgtttgtcagtgaatgtggcctccctgaagctggtttggactatggtggtctatcaaaggagttcttaactgatctgtccaaggctgccttcagtccagaatatggactgtttacacaaacatcaacatctgatagtagcataattccaagcagttctgctaagcttttggacaatggcattgatatgattgaatttcttggtcgagttgtcggcaaagcactctatgaggggatcctcttggactactgtttttcacaagtatttgtgcaaaaacttctagggcgctatagttttttggatgaattatcaacacttgattctgaactttatagaagtctaatgcaactcaagcactatgacggggacgtcgaagaactttgtttggattttactctgactgaagagttaggcgggaaaagaatcgtgcatgaactgagaccgagtggcaaaaatatctctgtcacaaatgaaaataaattgcactatgttcatgcgatggcagactacaagcttaaccgccagatnncnnccgtttncaaatgcatttta

SEQ ID NO: 101371 - DNA, 564 bp, Triticum aestivum
  unsure (1)..(564): unsure at all n locations
  Clone ID: PAT_TA_101371
gcacgagggagagagagagagagaactagcaggagcacgccattgtcaagcggctgttcgcggcggtcccggatcgcttcctgccgataatcgggacaatcgagcaattgggcgacgtcaagaagatgtcggtcgccgaggccattgggcggctgcgggcgttcgaggagaacgagtccgggcggcgccaagaccgcagcgacgacggcgagaagctgatgctggtctcgcgtgcagagctggaggccctaatccagaaagaaaagaagaagggagaagggtccagcagcagcggcaaggacggtgatgggcgcggtggtggccgcgaccgggacgacgacaggaagaaggttcgcggcaagttcgacaagtccaagattacctgcttcaagtgcggggagaaaggacacttcaagtctgagtgtgaggcgtggaagaaagagaaggcgctcctagttgctgccgacgtctacgacgagccggcgctgctcatggctatggcatgtgagcttgcgcctnnnnnggatggcaccgcnnnngtcnnngagcctacnnngatgnnnn

SEQ ID NO: 101372 - DNA, 600 bp, Triticum aestivum
  unsure (1)..(600): unsure at all n locations
  Clone ID: PAT_TA_101372
gcacgaggagatgcccnnnnntctcgtgctcctactcctgctcgtcctccgcgcagtcaccggagacgncnccggcgattctgcagacccctgcgcgggccgcnnnatccacatccgggacttgccgccgcgcttcaacacgcacctctttcgccactgcgacgcnnccttcccgctcgccgacccgtcctcgnnngccacctccacgccgacctgcgagtcgctcgccaaccacgggctaggcccgcgcacccacgcccgcagctgctnntggtaccgcacggacgcgcgcctcctcgagcccttcttnnaccgccgactcctcnngcgccgatncctcgnnnncgaccctggcctcgccgacgccgtcttcctcccgtactacgcggcgctcgactctatcccctacgtgctcgacccctcgctcctcaactgctncgcgcnnnncnnagcgtcccttgcccagttcctggcgcgcgaccggccccagatcctggcgcgtcggcatgggcacgaccannnnntggtcctcggcgggtccgcgtgggaccactcgcagccgccgcgcgcgnagnnccggctgctnnnnnccacgtcgnn

SEQ ID NO: 101373 - DNA, 601 bp, Triticum aestivum
  unsure (1)..(601): unsure at all n locations
  Clone ID: PAT_TA_101373
gcacgaggctatgccgcaattgactaaaactccatgatctaatctaacatgtccctgacctccttctgttcaacctctccatgagccaatccaaaaaatttctgtcttaagcagattcgtggatcaatctaaaggtcggcggtgcagcagaggtgcatggagggcactttcaagcagatggcacggccaccatcgtgtgtgtagatgttgcgtggagagctatagcggactggcggtgcaaagggtgacttccacaacctcactcccaaggcgaaattcgacacaaaccaaatcacaaaggaggcacggactgctgcaaggggcgcatggcctgcaagcagaagacggccaccatggatgttctacagcgactttgtcgtcaacaacatgacgaggaacaaatcgacccccagctgcatgtgttaccgttctagatcattgtggagaattgcagttggaaaaaagctcacaatatatccttcatggaaaaaaatgctaaagatttgtttagaagatgccatatgcagatccttttgtctgcaagtttctctctggcacatcgttgagtgtcatcctgtgcttccttcctgtagaatacatn

SEQ ID NO: 101374 - DNA, 407 bp, Triticum aestivum
  unsure (1)..(407): unsure at all n locations
  Clone ID: PAT_TA_101374
ggaaacaatttaatttaaaaaaaacccggttttgggnnnnnaaatttgggatggaaatcctcccaaagcttggggaaattaaacccgccgaaagtaattaataaaagttttacggggcgttttaacttttaaaggaaaaaatcccccccttaaaagctttaaaccctggggggaaaaacccgggaaacaaaagccngncaaggggaaatggcccttnnncggaatttgggggttgtttgccccttggaggggaagggaagggaaaatctttttttaaaaggggggncaaaaaaaaagggtggggcatttgcttggggtactgaaaaaaaattttggaagtttttgagggggaaanntncctttnntcanngaaaaggcttttaaannntntccaaaaaaaaaaaaaa

SEQ ID NO: 101375 - DNA, 664 bp, Triticum aestivum
  unsure (1)..(664): unsure at all n locations
  Clone ID: PAT_TA_101375
gcacgaggctcggaggtggccgagctccgcactccacgaccgaattaggtctccttagattgattgatccgtaaaacaagggacgcgcaccaaaccggagatccatcagcatggaagtctcgaggaaggcgaagcgtgccggcggcggcttcgacgaccggctgagcgatctgccggactgcctcctccatgacatcctgtcgcgcctcaaggcccggcaggtcgttcagacgtgcgtgctgtcgccggcggtggcagcacctctggcccacgtccccgtgcctcgacgtcgatatccgcgagttccgccccgatgcgactctaggtccccgccggtggccgctgagccccgcccagctcgctgactacgggaaggagccggccgagctcgccgacttcgaggatttcgtcgacagccttctggtccatcggattcggagcgccggagctgcgcccctgcaaaccctgcggctgcgcatcccgccgtggtggttgnnnnnntgagcgtcgtgccgatctatggcagcgagatccacgcggccnnnncacgnnnnggggtgcgtcgcggcctccagtgctccccggcggcgctcgacgtgcnnnnctccgtcaagctgccccctctagcctcctccggtacccaccgctnnnnnnnnctgcgcnn

SEQ ID NO: 101376 - DNA, 369 bp, Triticum aestivum
  unsure (1)..(369): unsure at all n locations
  Clone ID: PAT_TA_101376
gaagcacctaccaattaccacagagtaaacaatgtcaaaacctgagtcaggtgttataagaaattgatctgaagtgattacttggcatcatgtttaggacttcaattgcgtatcaagggatctgtatttaaatcaaaaactggcatttaaaaaatattgcatatgatgaaaacattggttgataaataatttcttgatctttcaagtgtggactggttgtttctnntctataataccaaagtctgcattttcactacatcagcttcttactcatttaaacaaacattatgtgcaattatccctggtagggaattttctctcctggannnnnntcatagtnnntatttactnntgattccttggacactg

SEQ ID NO: 101377 - DNA, 484 bp, Triticum aestivum
  unsure (1)..(484): unsure at all n locations
  Clone ID: PAT_TA_101377
ggatgatgaagcggcggcgagcgtcagctgcagatactatttgctatccactgtggtcgatcaaggggtggacttttagcagtgtataaggatgcaatcaagatctcagaggatattgttcaacaatggcatgatatgtgtacggaagatgtgagagaaacttcatccaatcgaagagcaccatgtcctattcgatcaaattatttcgcgtactagtcaatctggtgtaggcatgccagatcagaagatgcatataactagatcaggctagcacgcttcaaannnttttccctcacacttgtacactcatagaatagtttatttgttggtagtttttcaattattttaaggaaatcataaattcatttgattttttttcctatttttgttttanntttaattgtaacaaaaaggatacctctnnnngtattttataaacatgcaatatatcnnncntttttnnnnngnnnnnaaaaaaaaaaaa

SEQ ID NO: 101378 - DNA, 620 bp, Triticum aestivum
  unsure (1)..(620): unsure at all n locations
  Clone ID: PAT_TA_101378
gcacgaggcgcacgcagcagccgatggcgcacagcacttgaccgccggcggccgcgccctccgctgccgctagtccatgccgtgacccgcccttccccgccccgctcgccctcgtcctccgccgtcagcgaccgccttccctgccgcgaatcgagctcctccgccgcgattcgaccaccgaagcacgcaggctgcgtcgattctctgcctccccgaccacctcttccgaattttggaagccccggctcccttgccgaatcgatcactgagatggaagccaaccaaaccccaagaagcatgcccatggtgccgacgatgcgcccccgcctcccttggcgagtccatcaccgagacggaggcgctcttttggccggcctagccaaccaaaccctaagaagctcggtcatggcgccaaccacgcgggaagaggtgtcgggatccatggaggcccaaccggaagccgcaccgccatcgcagcgaggcaagnnnaagaaaacctccgcggattcgtcgcccgcagcatctcaaccaggcaagagtgaagccttggagccgtccgnnnnngagaggcggaagagaacccacaagagcgacgacgagangnnngccaccacgagcnn

SEQ ID NO: 101379 - DNA, 429 bp, Triticum aestivum
  unsure (1)..(429): unsure at all n locations
  Clone ID: PAT_TA_101379
gcacgaggctcgaggacacagcgccgccctcatgcgatctcagaggtcacagcgccgcctcccctctatcgccaactccgacgtacgatcttgccgccaccgacctcctagaggagacgtcgcccgcggacgtccgggatcgccgccgcggacttaagggatcaacgtcgccgacctcccagaggagacgccgccgccgccgacctctgaggggagacgccgccgccacctccgctaaaccctaggcatccaccaccgtgctcccgccgtcgggttccgcctgcgttcgccaccatgcgatcgccttcctccctcagctcgttttctctatgctctgtcaggctgcaacagcctaagtttctattttctatctgggctccactggcagtagtnnnntgctcattggnnncccaagatgtgtgctgctgn

SEQ ID NO: 101380 - DNA, 631 bp, Triticum aestivum
  unsure (1)..(631): unsure at all n locations
  Clone ID: PAT_TA_101380
gcacgagggtgatccaattccacccccgaaaatggcagccctcgcctcccttctccgccgccgcagccgccgccgcgccgacgtcctcctccgcacgctctgcgccaccaccactgcgccccccctcacgtcctcggccgccaagacccgcctccgccgcgagtacgacgccgaccgcgccgtctccctcctcgaggccatcgacaccgcctccctctccgccggctctacgcgccatgcgctctcccttgccgcacgccgcctcacccgcgccggacggcatgctgatgccgaggcgctcctctcctcccacatcccagcttccccaaccgagccgcatctctcggccatcctctgctcatacgcctccgccggcctccctgagaaggccctcgaagccttccgctccgccgcgccgtccctcccgtcccccatctccccgatgcccttcaacgccctcctatcggccttcgtccggtgccgccgccaccgccgcgtcccggtcctcttcgannagctctccannnagttctccatcacccccaacgccacctcctacgccatactggtgannnctcactgtatggtccgccatgacgccnnnnctcacgaagtgatagcccggatgcgt

SEQ ID NO: 101381 - DNA, 616 bp, Triticum aestivum
  unsure (1)..(616): unsure at all n locations
  Clone ID: PAT_TA_101381
gcacgaggctaaattccactccctcagatccatattaattggttgtgctgagtcggaatgatgatacacttatccgacggtacatggtacttctttataaacaaggtacaaactgtaagaaagctcatagaaaattttaaacttattagttagtgatatcataatacctgacaaagaggttgctgagctcagccatgggtggcactgctcagtctctatttttagtagtgaagctaccactattttttgtttttagtttgaaaactccaaattccccaaaacgtattttatttattattatattttttgtttgtgctaaatactgctccctccgatccaacataagtgccgtagttttagtacttgattcatgtttcttgctttccaaggtttgtaatatgaagcaaacacctggcgtgtttatgttgcttgaatatttcagaccaagatagaagtaaaatcaagtgtggttcacagtacttctggatggttgcagctaaaatgatagcttgactgtgtagactacttcaagaatttctgaccgcccaatgttgtttataaacaatagnnnctcagtggcctatacacaactcnnncatgttgttcccgcnnnaaa

SEQ ID NO: 101382 - DNA, 613 bp, Triticum aestivum
  unsure (1)..(613): unsure at all n locations
  Clone ID: PAT_TA_101382
gcacgagggtgaatcccgcccactttacgttaatcgaccatgcacgccgatcaactagtaccggcggtcgtcgccgccgtggccgtggtgtgcctgctcatcgccggccgcgccgacggccaattggagtacgtgcctgccgcggcgagccaggtggtggagccgctggccacgaaccagcagccgttcctcccgcagccggaggtgatgccagtgcccaacaatctgctcgctaggccggaatacgtctcgcagtcgcagacggggttctccctaccggagccctccctagccggggcgttcaccggcggctacttcccgcagcaaccgacgacagagccgcagccacagccggagtcgcaggcgaccaagtgggtgccggagacgcagacgaccaagtgggtgccggagccgacgtggcaaaagccggcgacgccgtctgtgcccgcgcagccgagtaccagcggcggatcgtacgctggcgggggcgccaacaagcagctggacgacgacggggagccggtggacgggctgagccccannnccatcgagaacatcctcannnagcacaacgcattccgcgccannnagcatgtgccccctctcacgtgga

SEQ ID NO: 101383 - DNA, 338 bp, Triticum aestivum
  unsure (1)..(338): unsure at all n locations
  Clone ID: PAT_TA_101383
ggtccctcaattttccgtttctcgtaaaaaaagccnnnnnccgnnnccagattttttattacacaaagcgcttcacccggggggggcgctttttggtggaaaatttttaccgggnnccgcgatgggcccaggggttccgaaaaccaaacccaaaggnnaatgccaaaggggagggggcttaaaaccctctggttgggtccctctaaattccttcccccccccggggagggcccccacggggcttgcccctnnccgggggcgaccccacggggcgaattttttttttttttttccttnnntcgtcccttaatccnnnccctcaggnnngggggcggggg

SEQ ID NO: 101384 - DNA, 369 bp, Triticum aestivum
  unsure (1)..(369): unsure at all n locations
  Clone ID: PAT_TA_101384
aaaaccccaaggnttgcccaatgttcccttttttccttatataaatcaactggggggccggacttttccattattgnnntaaacccttaaaagggaaaacattttttttcgaaaccccaaaagccgtcccaacttacagcaaaacctttttttggggaggaaccgatccctttttcccaaggggggatacctccaccatttcccaagactccaannttttttcctcaatttccgtttgataaagtgcaacctcggaaatctcaaactggagcccaaaaatttcactgcccatttcctttactttcttccttgggggttccttttcttggnnngttaaatccccatacaggaaacttacatgtggcannn

SEQ ID NO: 101385 - DNA, 405 bp, Triticum aestivum
  unsure (1)..(405): unsure at all n locations
  Clone ID: PAT_TA_101385
ntttaaaaatttctcaaaaaatcttttttttaaatgtgctccggtacataaaactgaacgtacatacacgtatgcttcttcttttttatgagaaaatgcatacacgtatgcttgggatgtaaaacacaggaggatgcttgagaaactctcgacgaattctgagaaagatagaaacggtggatacagccgagcaaaggaaggctcgacgaacagcagcatgtgtacgtcctagcgaacgaaggctgcagcactacacaacaacacacacactatgtacaattcatcgtgtcgcggctccacacgcactacacaccacttctgacggccacaaagccggccggagctacctggcgtccnnnnnnnncaaaangtcggcgtccgnnnnggcgatcangnnntacgacc

SEQ ID NO: 101386 - DNA, 627 bp, Triticum aestivum
  unsure (1)..(627): unsure at all n locations
  Clone ID: PAT_TA_101386
gcacgaggcaacagactaccatcgatcgagcaagcaccacgacaagacctcgcgccctccactcttccacctccgcctccaccggccattgctagaaaatggaacataacagagagacgccggcggtctccggcaaggaagaagtcgacatcgaggccgtcgcgggcctgagaggagatggttctggtgtcagctcgcaggatcctgcatggaaacggtttctgcgccacattggaccaggcttcatggtctccttggcctacctcgatcctggaaacttggaaacggatctccaagccggcgccaaccacagatacgagctcctttgggtgattctaatcggcctaatcttcgcgctaattatacagtcgctatcagctaatcttggcgtggtgacagggagacacctcgccgagctgtgcaagtcagagtatcccgtatgggtcaagatctgcttatggttacttgcagaggtggctgtgattgctgcagacatcccagaagtgataggaacggcattcgctttcaacctcttgttcaatatcccggtatggnntcgnnnttctcattgctggctctagcacgctgcttcttctcggcntnnnagatacggggtacggaagctgg

SEQ ID NO: 101387 - DNA, 570 bp, Triticum aestivum
  unsure (1)..(570): unsure at all n locations
  Clone ID: PAT_TA_101387
gcacgaggggcgcgctgacgaccatggacgagcagatcaagcacgccacggggccggaccaggaggacgagctggccacgcagatacacagcgagtacgaggccaaggtcgccgccaagaggatcttccagaacgtcgccaagcctggatccaagcacatatacctgtcggacctgatgcgcttcatgaggcaggaggaggccctgaaggccatggacctcttcgagggggcgcaggagcagaacagggtgagcaagcggtcgctcaagaactgggtggtgaacgcgttccgggagcgcaaggccctcgccctcacgctcaacgacaccaagacggccgtcaacaagctccaccacatggccaacgtcgtggtggcgctcatcgtgttcgcgctctggctcctcatcctcggcttcgccaccaccaagaccttcgtcttcctcagctcgcagctcctcgtcgccgccttcatcttcggcaacaccctcaagaccatcttcgnnnccatcatcttcctcttcgtcatgcacccnnncgacgtcggcgatcgatgcnnnntcgacgggatgc

SEQ ID NO: 101388 - DNA, 641 bp, Triticum aestivum
  unsure (1)..(641): unsure at all n locations
  Clone ID: PAT_TA_101388
gcacgaggcgttgtcgtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttgggntgttgccaacccagcaaacaccaatgctctcatcctgannnagtttgctccatctatccctgagaagaacatcagttntttgacccgcctagaccacaacagggcactcggtcagatttctgagagacttggtgtnnnngtttctgacgtgaagaatgctattatctggggtantn

SEQ ID NO: 101389 - DNA, 416 bp, Triticum aestivum
  unsure (1)..(416): unsure at all n locations
  Clone ID: PAT_TA_101389
gcacgaggaaggaggcagcggtgacgccttacagcccaaggaagggcaggacagcagtccggccgcccacccccagcccccgtgcagttggcgtggtgcgtccggtgcagtgcggaacgcgtgtgcgtgggtgcgcagttctggcgaggtcaaagaactccctcttcctcgtcccatggccgatccaaggtgctccacgtcgacgtacaggaaaacaatgggagcgacggcgaggatggtcttttggttcactgattttgttttttgcggttgaaaatcgtcagggccttatcatactgtagtttacttttcctcaaggtgctnnnccgccgacgtactgcggtttgctatgagttgttcttccggttgaatttgcagggtttttccagtgaatttttaaaaggaaaaaaaaaaaa

SEQ ID NO: 101390 - DNA, 635 bp, Triticum aestivum
  unsure (1)..(635): unsure at all n locations
  Clone ID: PAT_TA_101390
gcacgaggctgaatctcgattcgattcgattcccgcctccgttcggatcggcaaatcttgaggcttcccctgttcctggattcccaaaccgtcgcatcgagagatcttctcccttctttcgtccgttcgccggagagcagagaggcctgttcaatggcggcggtgaatcttggagcgtggctctgcgcgctgctggcggcggtggcgggcgtcctcccggcggcggacgcgctggggatgaactggggcacgcaggccacgcacccgctctcgcccaggatcgtcgtgcagatgctcaaggacaacggcatcaagaaggtcaagctcttcgacgccgaccagggcaccctcaacgcgctcgccggctccgacatcgaggtcatggtcgccatccccaacaacctgctcgacctcatgaacgacaaggacaacgccagggactgggtgcgccacaacgtctcccgctaccacttcgacggcggcgtcaacatcaagtacgtnnnnngtcggcaatgagccctttttggcctcctacaacggcaccttcgacaaggtcaccttcccggcgctgcagaacatccagaacgcgctcaacgacgccggatncngcgagntcnngnnnaccgtgccgcnnn

SEQ ID NO: 101391 - DNA, 450 bp, Triticum aestivum
  unsure (1)..(450): unsure at all n locations
  Clone ID: PAT_TA_101391
gaaaaaaaaatctgcaatatcacctatattgcaaatggtttctgcaacatgagctctattgcgaagagctctgcaatactacatttgttacaatgctgaagacgatgatggcgtcagatctaatggtcgtcgaggcggcagaatttttgaaaagacctgcaatgcccgatcagccgacagatctccagtgtttgattagtcaggtccggtggcttgacttccgactgagcagtctggacgatcgacgttgcttccttcgttttcacagttaatgaaaggcccagccaattcaaacatgaagacctgcaatgcccgatcagccnncagatcttttcaaaaattctgccgcctcnnngaccattnnntctgacgccatcatcgtcttcagcattgtaacaaatgtagtnnngcagagntcttcnnnnnagagnnnatgttgcnnannnnntt

SEQ ID NO: 101392 - DNA, 614 bp, Triticum aestivum
  unsure (1)..(614): unsure at all n locations
  Clone ID: PAT_TA_101392
gcacgaggggcataagaaccgaaaaacaaaatcagaagcgtccccccgcgtcgcctgcgtctggcgacacgggggaaagacctcgccgccgctcgaaggccacctccaccaccgtgccccgctacgccgttgccggagggccgggcggtgaagccgcgccgcgcccgaggatggtgacggcggggcggcctcgtcctcctcccctcgccagatccctgccaaccctcgatctggcctggggctcctccaccaacgccccctcctgcgccgcttccagtgggccgatcggcgaggcgtcgccgcgtccggagctggtgcctgtgaggtctcgccccgcccccgaaccccctcccctcatgtcgaagcgccaccaccaccacccctcggatctgatctggcgctccgtggtcgcgcacctccaccaactgctgcggttcgtctgctcgtctgatgtggcagcgcagccacgcccgtggctggcctggccggggnnnnngtcctgctcagncgctgaccacccttcgtctctgacggcgcctcctccgnnngncggtggcgnnntctacgcatgtttggtcatnnnnggtcnnncntggcagtcggtcaaagcttnn

SEQ ID NO: 101393 - DNA, 588 bp, Triticum aestivum
  unsure (1)..(588): unsure at all n locations
  Clone ID: PAT_TA_101393
gcacgaggatcgccgatacccacatgaacgaaaccaacagagacgggatcgcacacnnnnntcctcgacnnnnaaaaagaccagcggaggcacggcgaatccaagccaattccggctcccagctccgcaagcctctttgctctctcctgcccgcctccatgccgtcgccctcgctccgcctcgccgtcgtcggcgcgggcgcggccggcctggcggcggcacgggagctccgccgcgagggccacgcccccgtcgtcttcgagcgcgccgccgccgtggggggcacctggctctacgcctcccccgcccccgcagccgccgccgacccgctcggcgccgccgccacccactccagcctctacgcttcgctccgcaccaacctcccccgcgaggtcatgggcttcctcgacttccccttcaccgcggcgcgcggctccgtcgtcgacgcgcgcaggttccccggccaccaggaggtgcttcggtacctcgaggacttcacgcagcggttcgacctttacgggctcgtccggttccagacnnnnntggtcgnnntccnnnaggaggccggcgggaggtgggcggtgacgt

SEQ ID NO: 101394 - DNA, 571 bp, Triticum aestivum
  unsure (1)..(571): unsure at all n locations
  Clone ID: PAT_TA_101394
gcacgaggacggccacggcgacgccatgcgtgcccccgcatctccttccgcctcaccgccacctgacctctgccttctgcggagccacgccgtcgactccttccagaggtgcgcctcgtcgctggaaacctcgtccccataccagaggtgaggcaccaggacgtgcgcgagcccacggtccagattgatggacgaggcagtggatgggtgctgtgcgcccaagcacgcagctcgtcggccctgggaggaggtgcggctgccatcttcctcctgcctccctgcttgctccaaggaaccctcacggggaagggggaaaggaacaaccaataagggggagaaaggcggaaataatcaagaccatagacatttttggacgtgggttgtctgtagtgtccaagtctcaaatctcaattgacagtttcattgtgattttttggaatgttttctatctaatcaaagagacatannnctgtgtacagatattgttaagtgggttatccatgaagccgcaaacagggatggccacntaattcagtnnngtggctgctgcatagcacacttatttgaaaaa

SEQ ID NO: 101395 - DNA, 400 bp, Triticum aestivum
  unsure (1)..(400): unsure at all n locations
  Clone ID: PAT_TA_101395
gcacgaggtgttcaaaacagatacaaacagtttgaagtttatgaaagtaatctttagaacagataaatgctcaaaacagcaacaagaaacaatccaacgactgaacttgtaaacatctgaaattgtttgccacttgatgcctatatacagacacacatggtcctctaggatcatcacgataaacggcaaattgaggaattgagaacctgggacgacgccatggcctatccacagcccaccaatgcagctaggttacgcaagcttcgatcgtgggtggccatggcagctggtacgcgtactccgcggcgtgccgcttgtcccggagcacnncgtactgtgcgtcgtccggcaccacancanntnagagctcggnnnnntcctnnnnnnnnnnnagnnnnnc

SEQ ID NO: 101396 - DNA, 286 bp, Triticum aestivum
  unsure (1)..(286): unsure at all n locations
  Clone ID: PAT_TA_101396
gagcctctcagggggttctttccccacagaaaaaatggccaattttgttactactctacatacctagggtcagcagtaggcacatacagatttgcccaacatgacattgtttgtcaacaccagcctttttattactgnnccaacagcatggaaacttacaccgtgccgtgcagttcgctggaagtantctcaaaaaactcacacacaagctgtcttttttgcagctcaaacataaactcttctcaaaatgaaccaccctttttgtcgaccgactttttnnntatgc

SEQ ID NO: 101397 - DNA, 358 bp, Triticum aestivum
  unsure (1)..(358): unsure at all n locations
  Clone ID: PAT_TA_101397
aaaattttttnnnttaattttttggtccccaacttttttttttttttttttttttttttttggaacattttcctcaaggggtttcactttttttggttttttatttttcagtgcaacattttttttggggttctttttttctttttagttcattagtccccttcaattttttgaggttgggtgcgaggcccaaaccggtttttcctttcctttaaagtttttggggcgggaatttttcccaatttccccgatcgttgngtcgttggttcccccttctttttttttcccctttgtttgggacccactttgnnntttnnnggttctttctttccnnnnntntttttntnnnnnnnnnnnt

SEQ ID NO: 101398 - DNA, 633 bp, Triticum aestivum
  unsure (1)..(633): unsure at all n locations
  Clone ID: PAT_TA_101398
gcacgaggaaatgaataacacgattcagattaaggagtgtttagtagttgtgtgctcatgcaagtacatggtttaggtgtacgtgaatctttaagctgttcctttctaggagaatttctaagactgtttgccatttacccaaaggttttgaagctttgggagcctgcgactggctcgacaggtggcatcagcaagcgccggccggcctcggcactgctgtgggtggttatnggtgggcggagcacaccattgggattcgacatcagggtacggtggcaagctaaatcttcagtccagctaggattttttttttttggttcacgttttgttactgttttccattcgggatttcatggtgagcaaacctaccatttgcagttgtttgtttcagaaattcatgtcctgacttcaaattttggtcgtaaggtaaatcctgccaacaagtcgatgctatgggtttactagttctcttaatatttctatgcaaattattgcccccttcattttatttgcaagtagcagggaactcaaagacagatgtgcattttctcacgcgcattctactccctnnnnngtttggggctttgggcaatacagaatggaagaatttgttacttttgtatnnntntggnn

SEQ ID NO: 101399 - DNA, 566 bp, Triticum aestivum
  unsure (1)..(566): unsure at all n locations
  Clone ID: PAT_TA_101399
gcacgaggcagcatttgcgtattccatttccaacagagagctctcaaggtgaagatgtcgaccaccaccgcggccgcgatgagcatgaagctgctggtggacaccaaggccgggcgcgtgctgttcgcggaggccggcaaggacgttgtcgacttcctcttctccctcctcgccctgcctgtcggcacggccgtcaagctgctcgggccggactcaatggtcgggggcgccggcgacctctacgccagcgtccagaagctcgacggctcctacgtcctgcccggggcgaacaccgacgcgctcctatgccccgccgtgccctcgccggcggcggtccccagcatctccctgtccctcctcggcctgccgagcccgtcgccggctttcttcaggtgcggctattgtcacagcccgggctacgtgacggaggtgagaggcgccaagtgccccagatgtggcaaccatatggcggacgcgatccagtgcgtgcggcccgattccggcgactccgggcaggccgccgccggnnnggcgagnnnnnntcgtgcnnnnncgtggtgacgtac

SEQ ID NO: 101400 - DNA, 606 bp, Triticum aestivum
  unsure (1)..(606): unsure at all n locations
  Clone ID: PAT_TA_101400
gcacgagggagagagagagagagacgatgagcgagcgtgcgctgggttgtgagtggcttcagttttttaatcgacggcgggggcctccacttccactccacaggctctatactctcgactacttaaattttgcgttggatctagaagagcctgccagtctttgattcggctcaacaatggagatggtcctcgccgcagcagcaaactgtaccggtgccttgtcgtccaaccaccccaaaacgttcctcaaatcgcgtcgatcctcgctccaaatgcgggcctgcagatcgggccccgacgcgccgctcgccgtgtcgtccgccgccgcgccggnnnagccgcgcccggtgcgcctgggcatcatgggctgcggctccatcgcgcgcaaggtcgcgcgctcaatgctgctcgtccccgccgccgacgtggccgccgtcgccagccgctccgnnngcaaggcgcgcctcttcgccgccgacaacggccttcggagcggcacgcgcatccacggctcctacnnnnngctcctcgacgacccngacgtcgacgccgtctacatgccgcnnnccannagcctcnacgtnnantgggcnnnngnnnnnnnng

SEQ ID NO: 101401 - DNA, 540 bp, Triticum aestivum
  unsure (1)..(540): unsure at all n locations
  Clone ID: PAT_TA_101401
gcacgaggcattcacccgcgcgcacgcacacacgcgctggcacgcctgcaggtgcgcggtcaccgcgcgagcacgccgccatgcagcgacgtccgggaagaccccgcggccgccactctcttctcccggtcgcggcgggcgtgctccggtgcatcgtcctcgccggggccgtcgccgtcgtggccgcgggcgcgcacgcggacgcggtcgcggcgccggcgatcctggacacggtgtgcgggtccaggcaggcggccgacccggagtcgttcgacgtgagcttcgtcaacaccctggagctcatctaccagaacgtgacgcgctccggcttcggcgccgcctcctccggctccggcaacttctccgtcttcgggctcggccagtgcctcgcctacctctccccgaccgactgccagctctgctacgcgcagagccgcgtgaagctgccccactgcctcccggccgacggcggccgcatctacgtcgacggctgctnnctccgctacggcgccggcaactttaccgccnnnnnnancgacg

SEQ ID NO: 101402 - DNA, 656 bp, Triticum aestivum
  unsure (1)..(656): unsure at all n locations
  Clone ID: PAT_TA_101402
gcacgaggcaccatccaaatataccaactcactcggaagacaggtgtacgacgtgtctgactctgtaaacatcctctcagtgaagatagcctcttcggatgtgggattcccgttaaaggtgtacggtaccgtgattgcaagagattaccttgattttaagtgtgtctatctgttccgtcgccgtagagaggattaccagctcatcaactcagaggatcaatcgttgatcttgactgaccaactcgaggacttgtgttactagatagtatatattttgaggtggatcttaagatcaaggatgaccaagggaagagagaccaagaacttagcaagggactgtgtgcgattgatggcatattaatgggaggggaggaacatggtcatgttggatgtgaagaccttgatagcaggctgagcactgtagaggtgaaatttgcagtagttaaacttgcagtggaggctacccttgaaatcaaggttctcaaaggagatttctatggagaaatcacagcttgcacctccaggattcnnnntcgccttgtgcttcatgatagcaaagcnnnnggtgtaatctgtgatggtactggaatgctccagttgnnncgccgtgttgtaactgttgggatgnnnnntatgcttttattaacgattgctnn

SEQ ID NO: 101403 - DNA, 631 bp, Triticum aestivum
  unsure (1)..(631): unsure at all n locations
  Clone ID: PAT_TA_101403
gagcagttctcggtcacgttcgcatggcttggtttacgcctcatctcgttgccttgttcctcctcttctcacacctcgtgatcccctcgtcatcggcgacaactcggctcggagccgatctgctgggcgcggcacgtgcgcctccgttcgagtcatggctgcgcagcctgcgtcggcgcatccaccagcacccggagctggccttccaagagcaccgcacaagcgagctcgtgcgcgccgagctcgacgcgctcggcatcccttatgtctggcccgtcgcccagaccggcgtcgtggcgaccatcatcggaggcggcggctccgggcctgtcgtcgctctccgggccgacatggacgcgctccccctgcaggagttggtagattgggagtacaagagcctcgaagatggcaagatgcatgcttgtggacatgatgcccatgtgacaatgcttctaggagctgccaagctacttcaatctcggaaagaagatttaaagggtactgtcaagcttgtgttccagccngctgannnnngctacgccggggcttactacattttaaannnnnntgtcctcgatgatgtctctgccattttcggcttgcatgtcttccnnnnctnnnnnnnaggnnn

SEQ ID NO: 101404 - DNA, 314 bp, Triticum aestivum
  Clone ID: PAT_TA_101404
gcacgaggaggaggtgcagcaggccagggaggattacctgaaccgccgtaacggcttcgagatggccgccggctggacctctggccagtgaccgaccacagccgtgcttcaccaacattggcggggcaacgacaacagaaagggagggccgtggcagtagacgtcacaatgggctgcactgcatgcattttttttcctggtcatgaccggtcttcaaagtcgaatccaaaggcccaggggattatttgtcctagtcaagatattagtgttgtttcccgcaaaagaaaaatataaatattattaaaaaaaaaaaa

SEQ ID NO: 101405 - DNA, 611 bp, Triticum aestivum
  unsure (1)..(611): unsure at all n locations
  Clone ID: PAT_TA_101405
gcacgagggtaacaagagcacttgcctggctgtgtgcatcactcggtgcagaggccgagggtctttcccctcttgaaaagaaaaaacaagaacacttgcgtagttgcgtggttatatatattacagcagttcacactaagtattagctacaggtgcatgatttagtccttcacatactcactttcttttgtcaatgttgttatgtgcattgcacatttaccgtgtccacaaatgtcgtgttattgctatttccaggaggcgccgcaaagtttgtaggaattgtccatacatgtgctttctctagtagcttactgcagcacaataatcacaggaaatagcagcacatgttaattgaatttttcatttcaattaatcttttggctttttttcccatagcatggggcatgggccacaacagtaattatgtcaggcagtactatatactagctgatgcattatgtgtacttgtgtaccagtgtgctgactggaaggactggtagatcatctggtatgaatgtagcagtgtttcttgggactggggttcttgaaccttaatggccccaagtaacttctttagcttaatgcaattttcnnnngctagttatgttttc

SEQ ID NO: 101406 - DNA, 601 bp, Triticum aestivum
  unsure (1)..(601): unsure at all n locations
  Clone ID: PAT_TA_101406
gcacgaggggcatccaggtgtcctcaacgacttgcttctgcttgacacacactccatggagttctctactgtcagcctccaacctgaaccactgcagtgtcagtgtgacgactatgttgttgtcgaggcagcacaaggaatgcttgggctgctccttgtaatcaacgacgggcacaaccatgatggcccataccggctcgagtattccgttctgagaaataaccagtggcactcagagaaggtcatcccgttgctggaaaagtatgatgtttttctgtttggtgtagccaggggatacgcgctcatacacgcacagtacaccccatctttacaagagaatccaggttttttttcagtggacatcaagacattgcaggtagagttcttcggcgaaggctcccatggctctgatagtggtgaactatatgctggtttcccaccatcattgtgtgcaccaactatatgaagtggtggatatgttatccgcttacttgcaaaataatatgattcagacgctgatgccacttgacctaggaagaagaagttggttcctctgagcgtgttgtggtcaggaagagaaagccatgcgtggatcggaann

SEQ ID NO: 101407 - DNA, 211 bp, Triticum aestivum
  unsure (1)..(211): unsure at all n locations
  Clone ID: PAT_TA_101407
cggtgttgctggcctgaacatctgccaattccatagtttataggtgtatttattgtacacttgagtgaccaggtgtacatttnctggttggggagaaaacatgtgcacatatcagtttactcgctcacncnnnntgcttcttggnncagttgccacccnnnggcatagatgggtgttcgtcgtgncngnnnctaccagcnataccctcagg

SEQ ID NO: 101408 - DNA, 506 bp, Triticum aestivum
  unsure (1)..(506): unsure at all n locations
  Clone ID: PAT_TA_101408
gcacgaggggaatctgtggtggcgcggtggaagcgggaggacatgctcgacactnngccgtcgcgctgcacgccgccgctgccgccttcgccttcgtctcgctcgtgctnnnctcctccaatcatcacggtgactggatgcngttcgaccgctaccaggagtacatgtacctgctcgcgatcgcggcgctggccttcgcctactcgctcgcgcaggcgctgcggcacgcgcaccggatgcgcggcggcgccgaccccatctccgcgccgtccgcgaggcttttcgatttcattgctgaccaggtactcgcatacttgctgatgtctgctctatcagcggctatccctatcacgaaccgcatgagaacagctgtgatcaacaacttcactgatgcgaccgctgccgccatcagcatggccttccttgcatttgttgccctcgcattgtcagccacggtttcgggctacaagntctccnnncnnntgtacatgtgatgatgtgaatct

SEQ ID NO: 101409 - DNA, 640 bp, Triticum aestivum
  unsure (1)..(640): unsure at all n locations
  Clone ID: PAT_TA_101409
cggcacgaggccaccgcagcccccaaccccacnnngaagcagcagccatggcccccaaggcagacaagaagccggcggccgagaacaaggtcgagaaggcggcggagaagacccccgcggnnnnagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctccagggagatccagacctccgtccgcctcgtcctccccggggagctcgccaagcacgccgtctccgagggcaccaaggccgtcaccaagttcacctcctcctagactgacggcgtgcagttggtttctgcatctgcatctgtactgttgactctgcttatctatctatccgcaagtagtggtagcagtagtagnacctgtgctgggtgattgccaacgctttgttggcccgttg

SEQ ID NO: 101410 - DNA, 448 bp, Triticum aestivum
  unsure (1)..(448): unsure at all n locations
  Clone ID: PAT_TA_101410
gcacgaggctcaggccccatacactacaggatagcttatcatttgcttcttagtgcttgattacnnntagacatggaggtannnggacgtttttaacaagattgggaaggagtgagtcgactggtggtggaagttcgagtttgcatttctcatgcatatgaaatgttggagtgccaagacgtatctagcaatgtttcgttgcaggaacaagataaaaatgcggagcctcaccattgataagctcattggccagcttctaaggccccgttcggcnnnngaccagcgacatcacgtccaagacactatgtccatggaagaaaacagcgaatcgcaaatgcattgagttgcctcctttcagtagttgaccggaatgtcttttctcactaaatgcacatcgccgaaaggcttaaaataaatctagtaaaatacgtgcatcaaaaaaaaaaaa

SEQ ID NO: 101411 - DNA, 517 bp, Triticum aestivum
  unsure (1)..(517): unsure at all n locations
  Clone ID: PAT_TA_101411
gcacgagggggacaagactgggttctacccatatgactatgatgaagatgagccgtatgagtcattaatgtgtgcggtatgaatctggagatgatgtgatcgaggggaacgtcgagtcgtttgaagagaaggtggtgttgaagatcaggacccaaggacctggtatgtaccacaactggaggacggaaaagtacggctgccccttctgcagcaagcccaagcccaggtctgggttattggagcatctgatggaacattgccgggctacatcgatctccagtggtgagtacaagatcagggctgagcattctgccctcctgaaggtcctgagaaaccctaacctctagtcctacatcatgctgatcatcagaagctggaagccgtactcatcatcagtatatttgatgatgttttacttttggaaagctgcatctgggtctgaactggttaaaaactacctctattaatgtaacgtaatgtattgtgtgtcttannnnnnnnnnnannnnnnnaaaaa

SEQ ID NO: 101412 - DNA, 573 bp, Triticum aestivum
  Clone ID: PAT_TA_101412
gcacgaggatgtgtacgactacgcgatgtgatgccaagttcgatgacgaccatgtaccactaccgctcctcgaacatgaacatctacttcctcttcgaatcgtgaacctctactttcactacgatccgcgagtaccactacttccactacgaactcgaaccgccgcaaaattgcatgcttcgaaaggtataaccatcgagacgaccgcccgtggaccgaatgcatgcgtgttgaatgagatgggccccgtgtttgcaccatgtccgagttgtcacttcctcggtcctcctcgtttgccggtaacccatgggacacccagagtccaggatcaccccaccatccttgcatgatacgctcccgtcacttttccttttgcaccggtatcttcatgagctaccggaaccgatatgttgctgtggcatcatttttggattcgttgccgtggcacccctttcgtttccgccatgatgacaaatgcctcatatcttatcatgtcaacattttcttaaaattgcataacttgaacatgtcatcccaatcatgataataacatttaaaattaaaaaaaaaaaa

SEQ ID NO: 101413 - DNA, 282 bp, Triticum aestivum
  unsure (1)..(282): unsure at all n locations
  Clone ID: PAT_TA_101413
ggcaaatcaatttccgtggattgggttttttttacaggaaaaggttacttttccaaatttgtttangagctaaaactcctggaaaagngtttaatttccaacaaaagaatccaattttttattgggggggcacccccccccaacttgnaaattacgccccaagttaaanaaaattatttacatctagggtggctcaaatttcaacaaaaaatcccatgattccaaacctgggccgcgggattagggcgcaagattctccttttcctttnccgaattcattcc

SEQ ID NO: 101414 - DNA, 626 bp, Triticum aestivum
  unsure (1)..(626): unsure at all n locations
  Clone ID: PAT_TA_101414
gcacgaggcctcggcctcggctgcggcgccctgcacgtgtctccgcctcgccggagcgggagcggccgccgccgccgccgccatgtccgggctctacggccagcagggcttctccccttccaggaacctgtccccccagattagaagcaacccagatgtcgatagccagtacctggccgagctgctcgccgagcaccagaagctggggcctttcatgcaggtgctgcccatatgcagcaagctgctgagccaagagattatgcgggtgtcaaactctgcacacaaccctgggttcagtgatttcgatagacatcgattcagaagtcctagtccaatgtcttcaccaaatccaagatccaatctctctggcaatgggttcagtccttggaatggactacaccaagagagattaggctttcctcaaggaaacagtatggattggcaaggagcgccaccaagccctagctctcatgtcatgaagaanntctacgcttggaggnncagttgattcttatccaagtttcaattttgtgggacgtattctaggacctagaggtaattctctaaagcgggtagaagcatctactggttgtcgtgttttcatcagagnnnnnnnnnnntcnnnn

SEQ ID NO: 101415 - DNA, 613 bp, Triticum aestivum
  unsure (1)..(613): unsure at all n locations
  Clone ID: PAT_TA_101415
ctcatcgtccatcnnnnagaggaagcagagtgactcatgacgttacatagtcgcctacgagccaatgatgagcaaacgaggcagcgaatcgtgcagctgtaggcttgcagcaggttggcgggcgaatggtcataaagagaagataacaggcatgtcgagtgctgtgagtattccattcatttagacaactacgtttccaagatcatcaagagatcatagtgtgacagatgggagaacacacacacacctcaatggatgacatattataattacggagactagttgtaaggataatggagtgcaattttctgattcagtgatctgcaggtttgaagaactaatattgtgtagaaaatggcaatcgaattatttagatttaataaattagatttaaggataaattagttggtgcatttcattatcaaggactaatagtatcaatatactaggagcaatatgtagcaaacaattcaaaatttaaggaatgatccatcttacccctcaagaagaaggaataatccattttaatatgttcctttatatatgcggagnnntcttagtagttcgtatgtcaagatgtttggatactgaataatggtgctctttctantnn

SEQ ID NO: 101416 - DNA, 588 bp, Triticum aestivum
  unsure (1)..(588): unsure at all n locations
  Clone ID: PAT_TA_101416
gcacgaggagcctcctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactgagccggcgcccaggaggccggccggcagaggcgagcacgaggatgaggaggagaagcaagcaatcatcatcaccatcaccaccacccagcgtatcagtaccactagccgccgcatgcgctcgcgcgcgcgctaaataaaataaaaccgtcatgtgttccttagttctgtacgcctcgcgtgtagtgttcgaccagtgtccctcctcatgcctccacttctagtgaatatatggcgcctcaacttngnacgatcnaaaaaaaa

SEQ ID NO: 101417 - DNA, 630 bp, Triticum aestivum
  unsure (1)..(630): unsure at all n locations
  Clone ID: PAT_TA_101417
gcacgaggcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacnnnnnnggagctgctgatccaactttcctgtactttgcacatgggctgaaagagntcaagtgctaatcgcactgtatgctaaaatctatgcggtcgtcagtatttttgctct

SEQ ID NO: 101418 - DNA, 600 bp, Triticum aestivum
  Clone ID: PAT_TA_101418
gcacgaggcaactccacagcgccgatcgagagcccaacatacttcatcgaagctagctaagctacgagagaagagaggaagaagcgaagaagctacaatgggcgggtgcttctcttcgtccggggcgtacgaggaggccgggtgccggcggccgcagcgggtgaggccgagcgaccaggacggcatctactacgtgggcgagcgggacgtggacaacaaggccggcatctacatcgccaacttccaccgctaccagtccgaggtcgtgcccatgacccccgcgccctcctcagccgccgcctgatcgagcgcgatccacggcggagctgagcaagagcaagatctgagcaagagcacgatggttccatggcgggtcggttatttgtgctgttctttcgcttaattcccttgtttaggctgcgggcggcataaacctgagagtgagctcctaatgaataaataattagtgaagatgaggggttgttgatgttagtagctgatcagtacttatactactagtgtctgcagtacgtatatgtaattatgtatgtaaatttgttcaagaccggagagtgaatatatatggagactatgcttaat

SEQ ID NO: 101419 - DNA, 478 bp, Triticum aestivum
  unsure (1)..(478): unsure at all n locations
  Clone ID: PAT_TA_101419
gcacgaggcaccacttcgagcgcctcctcctgtctcgccctcgccccccgtcccctcgtcggcgcccgatctaagtcaagatgagtcgtggcgggagtgctggtggtggtcaaagttctctgggttacctgtttggagatggtgagcctgcaaagcccgctgcagcaccagctgcgaagcccgcacctgctgagaaaccagcaccggcagctgctgatgtagccaagcagattccagctggcattccaggtagccgggcgaacaactactaccgtgcagatggccagaacacgggcaacttccttacggaccgtccttcaaccaaggttcatgctgctcctggcggtggctcctccctgggctacttgtttggcggaaagtgatgttaatgatgctgcttaatgaacgaacgatgaattggcctgtatctctgttatccatgtggtgaaaactggaagtgtttgggnntnnnnnnnnn

SEQ ID NO: 101420 - DNA, 667 bp, Triticum aestivum
  unsure (1)..(667): unsure at all n locations
  Clone ID: PAT_TA_101420
gcacgaggaacaaatgctgaaggagggtcatgcatggcattacaagatttacgacaaacgcaaagaatttgcaaaagtaagaaatgatagtgcatttaaatgtctttttggtataatgccacttgtgatatgaaacacctttcatatctaaaatgaacttggcatgcttacaaactattggttatttggttaatacctaagggggcatatccaccagctagattaaaccatgaattaagtgcacccatgaaaagcacttgggttttattagtaaattaatataataattgtgaaaaaacactaacatatttctgaatagaacatcatggtgtaatttaaagttctgaattcattttgtgtcaggagtaaaccattaagatttatacactgtaaaagtatatagtaagaaacaatagttttttgcataatgtctcactttttggcctggtaacatatgagtttaaatctgactttnnngaagaggtttggatgatagcacctagcagctgatgatttgtaatggtcaccatatacgtcccaattactccctccattcctaaatataagaccttttagacatcccaatatggactacatatggagtcaaatgagtgaatctacactctnnaatatgtttatgtacatccgtatgtannnnatactgana

SEQ ID NO: 101421 - DNA, 438 bp, Triticum aestivum
  Clone ID: PAT_TA_101421
gcacgagggggttgtggagagacaccaactacggcgagggagtcatcatcggtgtagttgacaccggcatctatgcggcgcatccttcctttggtgatagtggtatcccgccacccccatcaaagtggaagggttcatgccatggcactgctgctgcccattgcaacaagatgattaagcttcaagactgttgtgcaacttgggaacggcaatcacatcaatggggaggcttttaaccagaatttaaactcaagctccaagcccaagtcatttcctctgtatgtagacaaacactgcaagtcgtcgtcttaagctagttgggtttccatgtctgtaaaaaaatcaagtttggacatgtaacatccattcctcaataactctgttgctttgaaaatataaatgatttggtatcagatcatttggttcaaaaaaaaaaaa

SEQ ID NO: 101422 - DNA, 591 bp, Triticum aestivum
  unsure (1)..(591): unsure at all n locations
  Clone ID: PAT_TA_101422
gcacgaggacaagacaaactggagttgaggcgactcgcgactcacgcacgcgagcctcgatctagcgccgctgccaccaccaccacccaacgcaggatctcccctccactgccaccttcctgcatcttcctccccagccgcacctttctctcctcgccgccgcccgagacgccctccggcgaagttcggatggctccggggaaggtggcggcgaggcccttttctagctgattgtgtggctgtagcggccgtgatccatggatccggggaggcagccccatggagaggcggtggcgtcctcatcgagacggcaccccgcgccggcgccgggatctgacctcaactgcggcagcggcatggtgggtctggtctccggtcagatctgatccagctggtgcagcctgctccatgcgcggcggcggtgatcggtggcggtcccctgcacacgatgctggatgaagggttctcgaacagatctgggtgaaaaccctactcttggcacgttgcaagggcggcgatggcggcgtttttgcgtcatccccttttgaaggcgtcgtcgtggagaagctctnnncccctatctgctacctt

SEQ ID NO: 101423 - DNA, 404 bp, Triticum aestivum
  unsure (1)..(404): unsure at all n locations
  Clone ID: PAT_TA_101423
agttccaacaaacttgatttggtcgtgtgggcatcatttatcactcaaacccggcgctcgttagggttttctggtttttcgggggaaaaatcgcaagaggcggaaccatgcgcgtgtaccacgacaagctttccggggatgagcttctgtcggattccttcccgtacagggagctggagaacggggtgctctgggaagtcgatggccattgggtccttcaaggagcnnntggtgtggacattggggccaatccctnngctcagggtggtggtgacgatgagggtgtcgatgaccacgccgtgaagnnngttgacattgttgacaccttccgtcctcaggagcaacnnnnttttgacaagaagcagtttnnntctcacatgaagcgctacatcaagaacctcact

SEQ ID NO: 101424 - DNA, 426 bp, Triticum aestivum
  unsure (1)..(426): unsure at all n locations
  Clone ID: PAT_TA_101424
gcacgaggtctcccccttgctccccttcctctctcctacgtgcaacagagccgccaccgccactgacctccccgtccccgtgcccaccgtcatcgtcttcgtgtgggaagacgtccagaagacccgcatccgtcgtcttcgtccatcccgagcaccaaatcaagctgggatggcccgtacgctcgccatcgccgtcgtcttcagcgcgtacatcgccggcgaccgtcatcgattgccattgttccgctccacctcgaccctccccgagcacgccaccggactcgcgatcccgagactgctggcgacccacagttcgactacggtgttgatgacccctctctcttgccagagcaancnggagccagatgacaccactgatgactactgctacccgagggtgctactactacgnnnnnnnnnacgcnc

SEQ ID NO: 101425 - DNA, 485 bp, Triticum aestivum
  Clone ID: PAT_TA_101425
gcacgaggggtcacctcacccaggagaagaagagagagaagcgagaagatgtcggggcgcggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggtttcgggggctaggccgccaccaccaccagattagagtgcctagggttcgtggtcgttgctgtaatcgcagcatctcgctgttgttcgctatcttctgtaggatcgaatggaattgaaattggagcagtttatcgttg

SEQ ID NO: 101426 - DNA, 277 bp, Triticum aestivum
  unsure (1)..(277): unsure at all n locations
  Clone ID: PAT_TA_101426
gcacgannnnggaagcaacatcacttgatttggggcatcaaatacatacccgcttgaaaaagtatcttaatattgggaataaatgactaaattaaaaaaggttgttagtaccataagcttcaacctctaaatggacaatcttatctagggttgtatttgaaatttataataaactgttatggcaatagcccaaggcccactattattaaatgatgatggacattggctagaacttgatatagtcaactgatcatgatgtttccctaaaaaaaaaaaa

SEQ ID NO: 101427 - DNA, 630 bp, Triticum aestivum
  unsure (1)..(630): unsure at all n locations
  Clone ID: PAT_TA_101427
gcacgaggatcctggacgtgagatggctgtttggggcagttgggtctaccnnngatgcacatgttcctgcaggctcggccacggtgctggcttcaccacaatgttttgtgctctgggtctgggatatggtgtcgcctccgccgtgtcatcgtgtctctgcgccgtggccggctagcccttctcatggcgccgagcagctacagaatgtggccgggcaccattgggcagtacagcctgctgcacgagtgcacccgtacctgtgacatgacaactctgtgcgggagagcagccaagaaaattggattggaagagggttggaacgaacaccggcactctgagtctgaaggtcttaagccttcagaagatgtcaagaggttggtgttcgaacgtgtacggaagatactcaaatcaacatacgaggtcgacaaggatgaggaggctgcatattccatgaatgacgttacgacattctggggtcaggcggcagccaagaggcgtcggaggaaactgcggagnnnccggctagcatttggccatgagtttcnngaggacatccttgtgtggcacatcgccacgcaagttttcctcangagtgatgatggcnnnnngtatgcanngacgaagcatgcn

SEQ ID NO: 101428 - DNA, 645 bp, Triticum aestivum
  unsure (1)..(645): unsure at all n locations
  Clone ID: PAT_TA_101428
gcacgaggcaggatttccaagaatccgccaaggagctaagcgcgctgagaggacagctgaaaatcgtgacagacgaaagggacctgtcgtggcaggaagcgaagcaactccgcaaaaccaccagcatgatgcagaacgaggtcgcgtcgctaaagaagaagatcgagtccctcgaagaggacatccttgtcaaggaggggcagatctcgatcctacaggacaacgtctacaagccgccgctcgacttcatctgcagccccaggacgatgaagcagttcggcatggagtgaaaaggttgccgcatgcacagaggaaagtaagcaaaaacatacagcagagctcttgggacatatatagcgtttttatacctgcatggacagatatagatgtggcctgcgccgcataggccgtgttcatatgcctttattgcagtatctttttttcgaacccgtgcaggacacctgcatggtttgaaaaaaannnatgtgatttgttttgcaaccgaagtttgctgtatcttttgtaaagcgacgcctgcatcacaacctgtgatggccttgccgcgcctacttaagtttctgtactatgatgaatctgtgatgtggcgatgacactgtgaatgggtcgtnnntnnnnnnnnnttta

SEQ ID NO: 101429 - DNA, 461 bp, Triticum aestivum
  unsure (1)..(461): unsure at all n locations
  Clone ID: PAT_TA_101429
gcacgaggctcccactctggtcttcgccgccgccgccgccgccnnnnnccggaaatctccatctcgagctccctcccctcgatgaccgtatgagatgtgcggcggcggcacgctctctcctccccctcccacccgctgcggcgcccatccacacccacaccgcatccccttccctggccgccgagctcgccgccgccgacgccctccacgcgctgctctccacgctcccgccctctctgcccaccctcctcccctgcctctccctcctctcgccccgcctcaccccgcacaccgtctccgatgcgctcctgtgggccgacctccctgccgcatcccgcatccgcctcttcctcttctccgccctctccccgcgtctccgctccccgctgctccactcccgcgccgtctccgtgctcctttccggcgaccccgatgccgcaatgttcgacgccctcgccgac

SEQ ID NO: 101430 - DNA, 592 bp, Triticum aestivum
  unsure (1)..(592): unsure at all n locations
  Clone ID: PAT_TA_101430
gcacgagggagagagagagagagaaactagtctgcatgtctatctgctgtgaatcaatgggctaactaaagcctatagagtagatggagtgtggcgaggccataacctgtggggacagaagcgatctggagttggtaacgcccgatttcccgttcgtaccacacctaggcacgtcccaattggtggtcgaggcggtgcgatgcagagacgatgtagaactggtcgccgatgaaacagaggccaccgctacagtggcgcacctacggcggtcgtcgctacgcaccttccagcggaggtcgtcgatagtccggtccagcttggtgtggaggtcgccgaacaccgtctcgacagcattctctagcctggtcttggattcggcaaagctccgatcaacatcgcgggcgagctggtccctgagaacgtcatacatcgcccgaccctccggcaagaggctcgccagtagctcggcgcgtcgtcgtggaaatncatgggattggatgggggaaattttgggatgaatatttggtggagaatcgaacggctgtgccaattgtgaggagctcgctactaattcnnnnnnnnnnnnnnnnnn

SEQ ID NO: 101431 - DNA, 587 bp, Triticum aestivum
  unsure (1)..(587): unsure at all n locations
  Clone ID: PAT_TA_101431
gcacgaggctagcacaagcacaatggccactaccttccgcaacatcttccttaaagccgctgaggccttttgctgtttgattggcacagtttccggcatgtttctcttagtgctagcactgaccctttttgcatccactagttccactcatccatctccttcttccgctcccaccgctagttccacctcctatcacggcacttgcgatgaagatgagttgcatcgactcatggcaactcatgtgggctatgtagtttgcgctatggccattgccatgttgttgatggtctttgttcggaaggttgcggacggggcagccaaggaccacgagcgggtcgccgcctcggaggacgcagcttacaaggctgcgtacgatgccgcggaggtggccaaagaggctatcgggcgcgccgagaaggaggtcaaggagctcaacgacccgcgtcgcgtcaatcttgccctgggcgttctcgagggcgaccaggctttggccgacgcccggaagaagctggatgcgtgcgtccaggagtatagncgcgccaccgataagntggaacgcttgaagcccnngnnnnnnnttgctcgtc

SEQ ID NO: 101432 - DNA, 434 bp, Triticum aestivum
  Clone ID: PAT_TA_101432
gcacgaggtaaatgatgtataatctggaaaaatgctctccgctctgtgggctcaagtgagcttaagctgatcgtccacttgcatctgatggtaacaggttttggcggcggtggtgctgctgctcctatgatggtagactcgtctgattcccctagctgcatccatggtgacgaagctcgacctaggctagaaccccctccagtgagctcctcaagtcctcttatacccctcctacttgcttgttggttctatgctctgcctttgtgaggtgtaattgttcaattttgttcatagtcgagcattggatgatattgtatttgtcatgatgtacatggttcatgaactatgccaaccttcatctttgttgtactagtcatagtaggataatgcaagttttgacaatccatgcatatttctgcatcaaaaaaaaaaaa

SEQ ID NO: 101433 - DNA, 677 bp, Triticum aestivum
  unsure (1)..(677): unsure at all n locations
  Clone ID: PAT_TA_101433
gcacgaggctaccaccttctccgcagcgactctccatctgcccgcgccaccgcgccgcccaccacctcgcgctcttccacagcctgcagccacggcgtcgcccccttcctttcccttccccggcgacttgcctccctctgcgctgccctctgcgtcggatccggtgagatccgacgattcatgccccccatggccggatcccgctccgccccgtccggatcaagccgggccgctcaccgcgcgagccaccgcggccaccaccgagcgctgcccccgactgagctcccgcgggcgtacttcaccttctgttctccagaccggtggacggaaagaagaggaggacctccaaccccaagcccatatgcagttcacccgacgcgcctgttgcggtgcgcagcgcatctgagtgcgttccgccggccgtgcttgcagtctgctttccccgtgcatgcgtggcatggctgtccagaggaggagcacgccgcgggctcccccttcatcctctccaacaatggctccgacgagccccctggacgcactgaatccatctcggccgctcatcaaatttttagtttctgcagttcgatacaacatgtcgtgtnnncaattgagcggtcctggtattcaggcagtgcagctcatcctctttgtgctcnnnnntgtcggnnnncactagn

SEQ ID NO: 101434 - DNA, 321 bp, Triticum aestivum
  unsure (1)..(321): unsure at all n locations
  Clone ID: PAT_TA_101434
agcacgagggaagtgacacaggttcttgcaccgatcagatccatcttctgcgcagaatgctggacaagctgtgggannncgtggaggccgggcctcgtcccggagacgggtctcgacaagctcggccgcgccgccgccacccaacccctcaccatcaacacagctgcaggggaggcgattaagcnatcgccgtcgatgccgannnccccgaccacgccggtgactccgtcgtcgtcgacgccgccgcatggcggcagcgtgtggcggggcgttttccaccccggcagcaacctggnnnnnnnnnnntcggcgncaacctct

SEQ ID NO: 101435 - DNA, 550 bp, Triticum aestivum
  unsure (1)..(550): unsure at all n locations
  Clone ID: PAT_TA_101435
gcacgaggccacgcctgcctcatctctcggagcaggaggaggagcttgcaggaacaatggcagcccagggtcttctctctgggaggcagctgctggggaggcctctgcagtcctccatctccaggtcgtcttcctccnnngaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgatgggggtggtgggcatgatcgccccggaggccctgggcaaggtgggcctggtgcccccggagacggcgatcccgtggttccaggcaggcgcgatcccgccggcgggcacctaccagtactgggccgacccatacacgctcttcgtgttcgagatngcgctcatcggcttcgcggagcaccggg

SEQ ID NO: 101436 - DNA, 486 bp, Triticum aestivum
  unsure (1)..(486): unsure at all n locations
  Clone ID: PAT_TA_101436
gcacgaggtagccagctacctctgtcgccgcgcgcgcggagggccgtaatcgccttgcccttcttcccccaatccccacctaaccccctccgacccccgattcgccgagcgcgcctccgcagcccttccacccgaccacgccgccgcccccgaggaactcccatccccaccgcagcccggcccgtcccgcccctactggactggcgcggagcggaggagatctgccccgacctcggttccctcctcctactgtggtgacgaaccctaactcgcctggnnnntaaactagcacgaccaacagatgggtagctactgattgaagctcgaccatttgatgtgaacattttgcattccttcagtgcttaagatggcggttggactaacatcccagctgttccaagnagtcactgctaccaacnnnnncggccaaaccaacaatttctgtggagtacaacgaatagctggtgtgnnnatgcgacgttctnn

SEQ ID NO: 101437 - DNA, 505 bp, Triticum aestivum
  unsure (1)..(505): unsure at all n locations
  Clone ID: PAT_TA_101437
cgtccgttcgtttccttatctcctctcctgctcctccctccacccccaccaccagtccaggacgcacgcacgcagctcgaacgcccatggccgcgcccatggcctcgccgctcacggccgtcgcccgcgccgcccgcctccaccccgtctcctgctccgcctcctcctcctctcccaagaaccccaaacagtcgtcgtcgtcgtcgtcgtcttcgccgcctgctgtgccgtcgctgaggtccgcggcggtggcgttggcgggggcggtgccgctgctggcggcgctgccgccgccggacgcgctggccgtgggcggcgaactggggatcatcgagggccggaccgtcgcgctgctgcacccggccatcatgggcggcctcttcgcctacacgctctgggcgggctacctcggctggcagtggcgccgcgtccgcaccgtccaggacgagatcaccgagctcaagaagcnnnnncgccccgccgccgcggcgnnnnacccccgccg

SEQ ID NO: 101438 - DNA, 541 bp, Triticum aestivum
  unsure (1)..(541): unsure at all n locations
  Clone ID: PAT_TA_101438
gcacgaggcaaaaccttcctcaaacagcccactcgccagcaagctcgagtcgagcgagctcgtagtccagtctcttgcagcagcaacacacacacgtctcactgagagcaagctctcgatcgtttgagtgatcatccatggactttgacctgctgttgagctccagccccgaggcgcagctcgcgctgatgaacaccatgctccagctcgagcaggcgctcaacgaccagtcgctgatgatggcggaggcgtcgccgccgatatcgcccgtgcagaccccttcgcacagcctctcgcctccgccgcacgtgtccacggcctgcgcggccgccgacgccggctatttttaccatcaggacctgcatgcccaggccgccccggcgggctacgccggcaccggcggcgtgcaccaggaatacgtggtgtccccgggcgccgccgtcttcgacggcgccggcggcgcgccgcagggttactcgtccccgtcctcgccggacgcgatgcgggagatgatcttccacatcgcgnnnctgcagcnngg

SEQ ID NO: 101439 - DNA, 534 bp, Triticum aestivum
  unsure (1)..(534): unsure at all n locations
  Clone ID: PAT_TA_101439
gcacgagggccaatccccacctccacttcctcactcgatcttttctctccatatctccacctcctaccagctcaagcacaccagtaccaaggcgggcagcctccatggacgcggtggagtcatcgtcgccctactccccgccctcgctgcgccacaagctgaggacgaccgtctgcggctgctttgggtcaccatcgtcgccgggcagcagcggggagaggccgcacaccggcggtggcagggccaggtggaggcgacgcgtggcggccgtgggggagttcaggtacgacccgctcagctacgcgctcaacttcgacgacggcgccagtgtcgacggcacggaagcagaggatgcggccttccggcacagaaacttcaactcgcgcctccctccctcacccgtgccggcctcccgagccgtcgccatcgcctaaagtcctgaatcgtagtagcggtcgtcctttttaacttttgtagcttctggctctctgatttttcttcttctctgagcgagatngaatcagaacatctgnn

SEQ ID NO: 101440 - DNA, 511 bp, Triticum aestivum
  unsure (1)..(511): unsure at all n locations
  Clone ID: PAT_TA_101440
gcacgaggcacacaccacgcctgcctcatctctcggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgatgggggtggtgggcatgatcgccccggaggccctgggcnnnnngggcctggtgcccccggagacggcgatcccgtggttccaggcaggcgcgatcccgccggcgggcacctaccagtactgggccgacccatacacgct

SEQ ID NO: 101441 - DNA, 304 bp, Triticum aestivum
  unsure (1)..(304): unsure at all n locations
  Clone ID: PAT_TA_101441
cccaanacaaatggggcttgcggttttcttgaccccaatcgtacacaacgtaaacaccacatttccattcagacgaccatttcaccccctttcaaactggagggaannnnnnacccacccccaggggggctttgtacttccccggcacttttgccccgccctgaatgcatatcccaacaaaagccggggcctgcccaaaaaaaatcttgagctccttctgcaaccccccaaattccggcatgtgccaaacgtatctagggggtatcaggtcatcgaacaccgccgcctgccacccaagcggtcc

SEQ ID NO: 101442 - DNA, 453 bp, Triticum aestivum
  unsure (1)..(453): unsure at all n locations
  Clone ID: PAT_TA_101442
gcacgagggatcgacgagaantatggagagggtgacgaggctatcgacggagaaggcggtggtgatcttcacgccgagcaacgactgcccaatgagctacacagtgacgaccctcttctcgggcctcggcgtttgcgcggccgtgcacgagctggacaaggacccccggggccgtgacatggagcgcgacctcgcccgtcgtctgggccgcacgccggccgtcccggccgtcttcatcggcggcaagctcgtcggttccaccgacagggtcatgtcgctccacctcggtgggaagctggtgcccatgctcaaggccgccggggcgatctggctctgagcctgagaggctgagagcagcatcaagttaactcccgcgtataagtaccgttagtaatcaaaattttacactgcatgcatgcgcgcgtagagagnnncggtttgtattttgcctnn

SEQ ID NO: 101443 - DNA, 398 bp, Triticum aestivum
  unsure (1)..(398): unsure at all n locations
  Clone ID: PAT_TA_101443
gcacgaggccatccaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttnn

SEQ ID NO: 101444 - DNA, 216 bp, Triticum aestivum
  unsure (1)..(216): unsure at all n locations
  Clone ID: PAT_TA_101444
gcacgaggcttgtttgttcctaagaatatgtgtatgtccatgttcacatacgagcatgctttctcggtgagttgcaagtctttctcttccccctccccaaccactccctctccccctctctttctctccttgttgcaaatagttagttgcattgcctccctgattaattagttgaagttgcaagttgnnnnngtcctaccgaagaaaaaaaaaaaa

SEQ ID NO: 101445 - DNA, 267 bp, Triticum aestivum
  Clone ID: PAT_TA_101445
tagcgtggtcgcggccgaggtactcacacaaccacatccacagctgcctcactgcctcagtcagctcaccttctcaccatgcttaattagttgtagttgatcttcacgcagaagctaatccccaccgagacgggacgggagagacgtgatatgatataataataaagaattaaaaaaaggtatcgtcagtttattggatcctgatccgcttcaggtggggccagctctccggccatcttatccgttaggtacctgcccgggcggcca

SEQ ID NO: 101446 - DNA, 617 bp, Triticum aestivum
  unsure (1)..(617): unsure at all n locations
  Clone ID: PAT_TA_101446
tagcgtggtcgcggccgaggtccacgatgtctggcgatcgtctcttccgtctcagatttccgaagccggaatggatgaacagcgccaacacccgtaacgcaggcgtctacctctccggcgcactgttctccatagccctcttcgtcctcatcgactcctctgtttacagcaactcccgcctcaatggcgccgacctacacatcaacttcgtggactggatccccggcatcttctcattcctgggaatgatcgtgatcaacagcattgacaagactcgcttgacgggcgacacattcgcatactcgggagacggagtggcatggaaggcgagggtgatcctgtttttgggctttgcggctatggctggaggactnncaggtggaatctcggtattggtattgaagtatatcacggctggagcggaaggcatgacgttgtggtttggcgtatcgaatttgatcgcgaatgcgctggtgatgttcagctctgttgtgctttgggtgagccagaacatggaggatgattacacctacaaccttgctctgtgaggacttnnngcgggcaatagaatctagcagcgataacgacgggagtacctgcccgggcgnnnnntcgaa

SEQ ID NO: 101447 - DNA, 352 bp, Triticum aestivum
  Clone ID: PAT_TA_101447
gcggccgcccgggcaggtgcgatcaagtctatggagaatcacatcctcgcgcatattcgacaattctgcgcgaacctcgccggaaatgtcgaatcctccacgcatccgcagtattccgattctgtggccccgcatacctccaaggctttcggacctacggttgacatcaccgaccaatccaattacctcgcttttgacatcatgggcgacctctgcttcggcaaatctttcaacatgcttacgcatcctgacaaccgctttccgatcgatctgatcgcgtccgcttctcaccgacatctcatttgcggcacatatctacccatccacacgtacctcggccgcgaccacgcta

SEQ ID NO: 101448 - DNA, 438 bp, Triticum aestivum
  Clone ID: PAT_TA_101448
tagcgtggtcgcggccgaggtaccaaagaggccgttgatctggtggaggaagaagacagcgcggccttccatcgcactacttgcactgagcacgaccgacgaaatcgctggtgagacgactaggagggtcgttgccgcctccgcggatgacaagatggagtcggaggagtcaaacacatgtctgtttgccggcttggtgctcgtggttgtggttgacactggtattgtttcccagatccaagtagagtgaaagcatatataggatacattggaggaatggaatctctgaagcaaacaagtgatgctatcgactctggagcatgaccaactcttttttggtcattgttgggtgtcacctttgatttggggatggggagctccaaatagtggcagaattttgcaatcctatactccggacctgcccgggcggccgctcga

SEQ ID NO: 101449 - DNA, 481 bp, Triticum aestivum
  Clone ID: PAT_TA_101449
tcgagcggccgcccgggcaggtacgggcccactacgtagctaaagtccagctcagaggaaggcaaaggatcggcaggctgttttcgtgccccttattttaaggcaagctccgtggaaggtcatagtgggttccaacacatagatgccgtggtccactcatgtgcagaccggagtgctgttggagtgggctcagtctcggacagtccagctccatggtgttcttcgttcggctgatcctccagcactccgatcaagataggcaatagttccactaccacaggtgaaacgctttcgttcacgacgcccgcagtcgagctggcgtcatggtgtcatgctcgtttggagaccaagcggacgcgtatcaaacctcgccgcatttcttgcacttcacgtaacctcgtcgacatcctcccactcgtctccttggcccacgctgagctgactaccagctaacgtatccacctcggccgcgaccacgcta

SEQ ID NO: 101450 - DNA, 349 bp, Triticum aestivum
  Clone ID: PAT_TA_101450
tcgagcggccgcccgggcaggtactacacgcgaaatctctatgatgctctccggcttttggatattcagtcctctcgatattgtatacacatttgcttttgccaatccgcgacttttaccgcccgcaatactctatcttcaatacccaacatctacctggccttattccgtcttctcgcatcctggttctcatgccctgtgcgtgtcgccgctttcctcaaggtctgcacgtcctgcggctcttcctcctcttcctcgtcctcgagcacctcgtgtagaacatagccgcttgtttggcgacccaatacacggcccagagacacgttgtacctcggccgcgaccacgcta

SEQ ID NO: 101451 - DNA, 192 bp, Triticum aestivum
  unsure (1)..(192): unsure at all n locations
  Clone ID: PAT_TA_101451
tcgagcggccgcccgggcaggtacaacacagaaatcnntagagcagtccttcgttgtcgaagatctgctcatcatcaagtgaggttggtaggtcctcatcatcgtctgttgactgctcctggccataaggatagacaccagtttcttgaaggttgaccatggcctcatcaatgtacctcggccgcgaccaca

SEQ ID NO: 101452 - DNA, 335 bp, Triticum aestivum
  unsure (1)..(335): unsure at all n locations
  Clone ID: PAT_TA_101452
tcgagcggccgcccgggcaggtacgggtggaacggtatgcgacagcttaccttcgagcatcatggactggagctttgtttcagttgagtgatcaagctatgaatactaactcggtgaaaaaaagcatgaagaaattcaattcggcactccgagaaataagcagggtccaaacgacatggaaagtgcccaaccctcaacttagacaacacttacggttagttatattgcagcatgttttccccgcttatcgcgcacatttacgaaggcaatggccgggcttccatatggagaagcacgtaaagtacctcggccgcgaccacgctaatcnannnnnn

SEQ ID NO: 101453 - DNA, 257 bp, Triticum aestivum
  Clone ID: PAT_TA_101453
gcggccgcccgggcaggtacgctcagccgcagcaggttgacggcgcacaacaatacggttacggcgcgcaaggatatcctcaaagcccatacggacaaggcggcatgccataccaacagcagcaatagtgagcgcggcgcacgcattccgcccgcaccacgaagtcaacatgacaccatcaatgtgccggacattcgtatgaagcacgaagaagagggatggagttcttgcggtgtacctcggccgcgaccacgcta

SEQ ID NO: 101454 - DNA, 292 bp, Triticum aestivum
  Clone ID: PAT_TA_101454
tcgagcggccgcccgggcaggtacacgacgaggtgggtggcgctgcagacgctcagcttcctctgcttcctggtgtcgctcgccgcggcggtcgcgtccatcgagggcgtcacggagtcgctcaagaactacgtcccgttcaagaccaagtcgtgaggatgggagtttttgcatgctgccaaataattggccgtcgacaatgcttgtttgtgtgtgatgggaaaccatcgtcggctgggtgcgtcggtggggggtttatcccgtgttacgtacctcggccgcgaccacgcta

SEQ ID NO: 101455 - DNA, 229 bp, Triticum aestivum
  unsure (1)..(229): unsure at all n locations
  Clone ID: PAT_TA_101455
tnncgtggtcgcggccgaggtacttgttactcgaggggaatctgctgtcaagctcagcgagctggtagaagaggtcgtgcttcttggtctcgatttcaactatctgactatggccccatgctctcttggcgtcgaggtctagcgcaggctttgcacagggttccttcaaagcggtgttgccgccgccgccgcccccgtggccagggtacctgcccgggcggccgctcga

SEQ ID NO: 101456 - DNA, 619 bp, Triticum aestivum
  unsure (1)..(619): unsure at all n locations
  Clone ID: PAT_TA_101456
tagcgtggtcgcggccgaggtacactggagaacagaggaacggccggggaggcatctccaattcacccatcttcctctccaacatctctataaccctgctcatggacgggcggctttcagggttcatctgtatgcaccacaatccaaccaaggtcatccttcttacaatttcttcagtcccatatttttcttcagatccatgcaattccctcgccaaattatcccaaacccaatgtggaaaaaatgcttcactagagctgtctgcctttcctttctgatccttcttcccttcgaccatttctaggagcatcatcccatagctgtaaacatccgactttgtcgagacgactccgaaacccctagagaacacttctggtgcgatgaaaccaaccgtccctctcgcttccgccattgaaaggacactgtccttgaggtggcatagctttgccagaccaaagtctgcaatcttgggacagaactcgtcatctagannnatgttgttaggcttgatatcgaaatggatgatgccgggcgttgcaaccctggtgtagatactctaaccctcgtgcgataccgattgcaatttttaggaacatctcacatnnnnggnnnngtttgg

SEQ ID NO: 101457 - DNA, 313 bp, Triticum aestivum
  Clone ID: PAT_TA_101457
tagcgtggtcgcggccgaggtgtccgccgtgcgctgaagaccttcatccccgattcccccgagtacgagcgcctcctcccccacgtcaaggacaacgtcggattcgtcttcaccaactccgacctcaaggagacccgtgacaagatcttgtccaaccgtgtcgctgcgcctgcccgtgctggtgccgtcgctcccgatgatgtcttcatcccagctggaaacactggtatggaacccggcaagacctctttcttccaggctctcggtgtcccaaccaagattgctcgtggtacctgcccgggcggccgctcga

SEQ ID NO: 101458 - DNA, 318 bp, Triticum aestivum
  Clone ID: PAT_TA_101458
cgagcggccgcccgggcaggtacacgcctcattcggtagccgtgagccgcttcaatgtcaagcagcatgcggttggtgcgctcgaggttgagctgccgagtgaggtgattgatggcttgtggatcgacagacacccgcagccactctggaaggtatccagggatgacggtaagaagcgaatcccacattcggttgccgttgcgttgacgccaggagctgaagagctgtaacgcgacgagaggaccaaagaccattaagagcctggagctgatctggaggatgttgaaggagctgtgtacctcggccgcgaccacgcta

SEQ ID NO: 101459 - DNA, 233 bp, Triticum aestivum
  Clone ID: PAT_TA_101459
tagcgtggtcgcggccgaggtacacaatcagcttccatcctattcactggaatgctctctgcccgtccgcctcatggcacaccatcacttctgcctcacttctctccttattcaatcacactttcaccatccgcctccttcaattcctcgctcgcttacttcgccttggcgaggccaacagcgttgttgcccaggtcgtagacggagtagtacctgcccgggcggccgctcga

SEQ ID NO: 101460 - DNA, 402 bp, Triticum aestivum
  Clone ID: PAT_TA_101460
gcggcctcccgggcaggtaccaggactccgaggacctgctcggcgcctggttcaagcagaacccgggcaagcgggagaagatcttcctcgcgaccaagtttgccaattgctcggacgccgagggcaatcgatgggtcgactcgacgccggagtattgtcggaaagcgtgcgagaagagcttgaagaggttgggggtggagagtattgatctttattatgcgcatcggttggatgggaagacgccggtggagttgacggttagggagttgaaaaagttgaaggaggaggggaagattaagtatatcgggctttcggagtgtgatagtgattctttgaggagggcgtgcaaggtggagcatatcgatgccgtgcagattgagtacctcggccgcgaccacgcta

SEQ ID NO: 101461 - DNA, 635 bp, Triticum aestivum
  unsure (1)..(635): unsure at all n locations
  Clone ID: PAT_TA_101461
tcgagcggccgcccgggcaggtacctccatcctgttctgacttactaaactccccgatccccaaagcccaatcccataccaaaaagaaaaaaatgagagtcctgttcatccacttcaactcaagaagaataaacttagttcgctcgtacgagatgattccgatcatcatcaccggcttcatcactctgctggatactctatcggtgaagtcatggccgctctcaccatgatcgaatccccctcccacatggccatcatctccgacaagcctcccgcctacgccgactcgcccgacgcccccctcgagaaagagccgttgatgccctccgaggcggaagcagatgttgaggtcatgctcgtccattccaagcccatcacctccaaaatcagcaccaccatggcacacctttacaaaatcgacggtttccgtggcaagttccgcggcgcgagggtctcggtcatgtatcatctcctnncagcgtggtttccaacttcctcatcaccgtcttcgacgcgggacttgttggcaactccttgatctacatcttcgtctccctcggtcttgcgcgtgtcnacatggcttggacgcacgccatgatcgccaccgagtcgcccgtgtcgttctggcgcnncat

SEQ ID NO: 101462 - DNA, 258 bp, Triticum aestivum
  unsure (1)..(258): unsure at all n locations
  Clone ID: PAT_TA_101462
tcgagcggccgcccgggcaggtaccatgacgngnaggacacttccgtgcgcgggcgcgaggaggagcgtgccgtcgcctaaccggaggaaatcgcgaacatgatgatgnngaaggagaatcgnntttgatcgatctctctcttggacacaaacacatgccaccacccaccccatgcagctttataccctannnnntgcgaggcgcggcgaannaaggagtcattcggtagcactggacctcgggcgcgaccacgctng

SEQ ID NO: 101463 - DNA, 256 bp, Triticum aestivum
  Clone ID: PAT_TA_101463
tagcgtggtcgcggccgaggtacagagcgtggatgatgccaggaatgtaacccagaatggtgaggaggatgttgatgaggaggtcggcgccgcagccacgctcgaggaacactccgattgggggaatgaagatggcgaagatgatcttgatgatgtcgcttccggtgaaaggcatgttggcggtgtttgcggttgcttggtttggtggaatttgttgctgttgtgagagatgacacctgcccgggcggccgctcga

SEQ ID NO: 101464 - DNA, 311 bp, Triticum aestivum
  Clone ID: PAT_TA_101464
tcgagcggccgcccgggcaggtactgcgccgcgagattcaagaggtagttcaaacgcacgactactcaatgtcagacgcccatgcccatctccctcaagatagcaggtgtttgcagcgagtccagactgctcttggccgatagtccggtattcatatgccgcggaacgttcaagcgctgttgtcgactcagatccggcggcatgggcgatgcaggtataggagatctactgtaggaataaaggtcagatttgacctcgacaatatgctccagaggttcggtgttcatcgtacctcggccgcgaccacgcta

SEQ ID NO: 101465 - DNA, 344 bp, Triticum aestivum
  unsure (1)..(344): unsure at all n locations
  Clone ID: PAT_TA_101465
tagcgtggtcgcggccgaggtaccctaatgatgcaaagtattttagaggttcttcttttgccggccccatatatnnnnacttctccctctgagagtagcacaatgtcatcaaatttgctatagactgaacctctcggctggtgtatagagcatatgacagtgtgcccatcttctgcaagctgtctaagagtctccatcaccttctctgcctggaatgcatcaaggcctgttgttggttcatccgcaaagatgactgaaggacttgcaatcagttcacatgcaagcgagaggcgcttcttttcaccaccactaattccgcgtacctgcccgggcggccgctcgaa

SEQ ID NO: 101466 - DNA, 155 bp, Triticum aestivum
  Clone ID: PAT_TA_101466
tcgagcggccgcccgggcaggtacagcatcttggtgccggctggtgtggagaacattgtgatggtgtctgttgtggagtggagcgtggagtggagtttgttcgagcactgctctggtgtgaagatggatgtcggacctcggccgcgaccacgcta

SEQ ID NO: 101467 - DNA, 362 bp, Triticum aestivum
  Clone ID: PAT_TA_101467
gaacagaatctgtattcctcgtctcgtcagtcccaccgacacgaaacacacacaatgaatggtggactgctataccactcccctcccatcctagtcatcatcaataatcatcacaagcatacacaacacctcccccgctatccttcctctcatcctccatctcctctccttcctccactttaataaccctctcccgctccgcctggatcaaaaccttccgcatcctcaactgtctcacctccctctccttcctcgccgcttccacggcacgcgcctcccgaaaagaagaagcgtctttttccctctcagcttcaagaacatccaaacaatgctcctcctccacctcggccgcgaccacgcta

SEQ ID NO: 101468 - DNA, 605 bp, Triticum aestivum
  unsure (1)..(605): unsure at all n locations
  Clone ID: PAT_TA_101468
tcgagcggccgcccgggcaggtaccaggcccaatggtgagtgggtcgccggcgccgccacgcagagggaatctaaaagggctaaaatatcacctggagttttggcctccttggtcttctctcttcagaagcgttcaaccgctctgcactctatatccattgactccgctggtatcagcaacttctttcttgcttctaattcaaagcctcgcattgccaaatccatcaaactacggggaccattgacaagtctgacacctggtacactgaaggacctccgtaatctcagaaaactgcacctcatcgaaaccggtctcagcagccaaatattggtggaagccctgcaaagcttggaatgcttggaatatctcaagctcggcgaggaggatcgctctggagcttggaacggggacttctcagtgcaaagtggtggattctcagccctccgggacctgtgtttcgagggtgcaaagcagtatccacggttgaagatcgcacaaggagccatgcacgtcctcacctctcttcagctgctttgtgnnnnntctccgcctctgatgggagttgacggcatnnnncatcttacatgtctcgacgaggtcatac

SEQ ID NO: 101469 - DNA, 324 bp, Triticum aestivum
  Clone ID: PAT_TA_101469
tcgagcggccgcccgggcaggtactcggcgttatgcaatgaggattcggggtgtgtttgacttagctgccaagatgacgttaggctttatgctggttgcttatgcggttagtcccaaactgcccagagaagaggacaccaccaataattgcccacaatgcggcttgagaacatcaacgaccagagaaggcaccaccaataattgagaaccaaagatgatgctatctttaatttgtgatattgtgtgacatggtatcatgtaattatatctcttgtctattaactaattgagtagaatatacagtacctcggccgcaccacgcta

SEQ ID NO: 101470 - DNA, 388 bp, Triticum aestivum
  unsure (1)..(388): unsure at all n locations
  Clone ID: PAT_TA_101470
tcgagcggccgcccgggcaggtactctcatctacattcgctcaagcatgaatcatcacctactatgcctccttctcttgcatcttcctccgtgctgccagcaccatctcctccctccgcttcttcaaagcctccgcacgagcattcttatccgaactccatgcattccgcttctgctcctcactaggcacaggctccttccccttcccatttacccttgactgtagattatacctcgtgatcagatctggttgtgtggctgtcggtctcttagggccgcctgatgcactactttgtgcttctgctggtnnnnggggggtttggctgggacgaannnnngtggtgtttctaatcctcttcctcctagtacctcggccgcgaccacgcta

SEQ ID NO: 101471 - DNA, 614 bp, Triticum aestivum
  unsure (1)..(614): unsure at all n locations
  Clone ID: PAT_TA_101471
tagcgtggtcgcggccgaggtactaaacgagcggaaactaaaactatttttttttttattgttattaaagcgaacaatattactaagagtaggttgttatccagctcataaaataaaggtaacactatgtagaaagtcaatcctacaagtatatacaaggcatatgaagttataactcctgtatctaacttagatatgttcgtgcttaaattcaacaaagctttttctaaaccaaagggtcctactaactcaatagaacctttatctaatactttagtagtttgccctcctagttttaacactaagtctgtcacgtatctgttataaaacatttcaattaagaaacgttggttgaaaaaactgaaaatgttatacccaaatctagacagcttaaagtttattagtgctttaggtgtaaattcagatattatgattgaaattatgcttagtgatatagtgaatattaaaggtaaaatcttaaagaaagtaggcacagcaaattctgtgtctaacataatttcatgactagggtgtatgaataaactattatcctggannnnnntagatcctaacccaataaacatatctttagtaacataaccaaagaatatann

SEQ ID NO: 101472 - DNA, 572 bp, Triticum aestivum
  unsure (1)..(572): unsure at all n locations
  Clone ID: PAT_TA_101472
gcggccgcccgggcaggtaccaggaagatctcatgaatccactagccaaatcaagataatttggccaaatggagagacgcggtagattgtagggggatttcggctgaagaatttatcccagagaactccacatttgcaccactgaacattccaagacgggacaatgaattatttgtccagagaaagaacaacatgatcaaggatgtagaggagaaatttgtctatccatctgagacaaagcagcttacacgagactgggtcctaatgactgtttgcaaaagatggagagcctacaaatctcgcttgaagaaaaaatatttcaaacggaaagagagatctctccaggaaattatnnnnngatgttccaatnnngtgttaataagcatcaacgggagannnctagttggaatgtggtgccaggattcacacatgaagttatgcgagnnnactcanngntgtgtgaagcaacagaagaatccacacacaaccgggagaaaaagccatgtcaggctacaaaaagagatggaaatcaaaaggaaagcaccggtcnacaagattgaccttnngnnnnn

SEQ ID NO: 101473 - DNA, 465 bp, Triticum aestivum
  Clone ID: PAT_TA_101473
tagcgtggtcgcggccgaggtaccacgcaagggtaggcctcctcgatgcgcggtgtctgggtcctcacccagcggcagctcccataatcagaaacatgcccgagctcgcctcgctaagaaaaacgcaccacgccatctcacctccaatgcatcacaattgaacgccgtttcctcatctgcaaagccctcaaaagcaatccgcgcgcatattcgtgttgctcgggtcggtgtatgacgagaagaaaattttcagccgagggtatgtgtcgaacttttcatattccacagcggtgatcttcccatccatgcagtatgtgctcgagtcttccatccactcatgttcttcttcccttccgtcccttgttcccgtgcagcgcagcctctacttcctcctgaatgagcagccctcggtcaagcgggccttgccaccggtgggctggcaacctgcccgggcggccgctcgaa

SEQ ID NO: 101474 - DNA, 635 bp, Triticum aestivum
  unsure (1)..(635): unsure at all n locations
  Clone ID: PAT_TA_101474
tcgagcggccgcccgggcaggtacacattacagatgggcgaagagaagcatgaaacaatcatttttgtgaccacacacctaatcgccgcacctaatcttctcaatgctcatagtcatgggttctctccccagatccattgtggggcataactgagtggatcgaggtggtagacatcagtgggtggcggctccatgacacatcatgtgaggcattgctgaccaggagctttgcactgggatcatggctgtgggttgtggtcgagggagaaagcttgcttctcttcttccggatgtgcaggttgnnnggtggacgcaagtgttcagtgaagctcagaggcagaaggcatccaaccaaatcatcatacttgacacttcaaaatctgcatccttggacagaatcccgtttgcgatnnngaggtttcacagcgtgttgcatntggtgccttcttaccttacaggtgccctccttccctgctcgcaagaccctgagattaaannnnnctggagcacgacaatcatatgtcccactgaactctggagnnncaaaaataatttgatgcaaaggaaaaacaaagcacttcgatgcnnnnnnnnnnnnatgcttgnnnnngnntttcnncacntcgacnacctac

SEQ ID NO: 101475 - DNA, 588 bp, Triticum aestivum
  unsure (1)..(588): unsure at all n locations
  Clone ID: PAT_TA_101475
nnncgtggtcgcggccgaggtacacaaaagaggaggctgagggcaaaaggctgaaaaatccttttgacactattactgaaggaattggaatcaacagggtcacagcaaattttatgatggcagaactggatggcgcttaccggggaacagatagagaagctgtcgagatgtcaaggtttctgctgagaagagatggactatttgttgggagttcttcagccatgaattgtgtcggggctgtaagagttgcccgggatttaggtccaggacatacaattgtgacaattctctgcgacagtgggatgaggcatctaagtaagttcttcaatgatgaatatttggccaatcatgggttgacaccaactgctactggtctggagtttctcgatcaataaaaacttcacaggggaatgcatgatttcagcaattttgtcattcctcgttgtctgtcctgaaaacagttgatgagtgaacaccgaggcgccgaaacattccatctaacaagggaactgttggctccagataatggacctcaanttttatgtcacccnntnnnganngttcccctggannnatnnnnnnatgtac

SEQ ID NO: 101476 - DNA, 346 bp, Triticum aestivum
  Clone ID: PAT_TA_101476
tagcgtggtcgcggccgaggtacatcttgatcttccaaagagaaaaagaatgaaggcgccggaagattcggccagtaaaaaaggatgagcaaaattgcaacgaatcaaaatatatatagtcatcaaaagaaaaggagtagttattccacaatagttccctgcatctcaacggtccagcaaggatgatgatcccgtggagacgaactgatcgctatcctggccgctgtcagccacttgcttgctagggataattgctgcaggcgaccattgatctgggacaacaagaaagtaggctgacatagctttcctgaaacgctttttgtacctgcccgggcggccgctcgaa

SEQ ID NO: 101477 - DNA, 247 bp, Triticum aestivum
  Clone ID: PAT_TA_101477
tagcgtggtcgcggccgaggtacgatgagaggatgccattgcgcgaggaaagtgatcgcccacatgagccaacagctcgccacggataatatgatacttgagcgccagacggtctggttctcgcctttggggctaaagaaccatgctgccatcgcgatggctaccaccacgatgatgctgattatgagactccatccgttcgccattttgtgagatcgtgcttggacctgcccgggcggccgctcga

SEQ ID NO: 101478 - DNA, 438 bp, Triticum aestivum
  Clone ID: PAT_TA_101478
gcggccgcccgggcaggtactcattctggtcaaaggaaggttcgagtgaatgacctatagggagagtagcagtgaattccagactcttgcataatgccaaggaagaaacgatctcttctcacgcatctcaaggcttccaatcaaccttcttcacccgaacaggcatgccctctctcggcttcgccgctccaacaagaacttgatacatctcctctccctcaacatcctgctttcctttcctaaagctcggatccttcgcaaagtcactcccatctcttcccacctccgccaatccctcttcatccagcgccgtagagaattccatcactctcgccaccaacgccaacacaaccttcatctccatgatggcaaaattctgtccgatacaattcttcggacccagttcaaaggccctgtacctcggccgcgaccacgcta

SEQ ID NO: 101479 - DNA, 387 bp, Triticum aestivum
  Clone ID: PAT_TA_101479
tcgagcggccgcccgggcaggtacagactgaaagatccgtccaattacgacactcacaatagtcatcagggaaagagcagccattgacccaagtaaaaccaatgccttttgatactgcatcgcaagtagtgcagcaatgaaaaatgtcttatccccgatctcggatacaaaaatgagtgtaaatgctgctgtgaaacctgactttgctagtgcagctacaactgcagatggctgtcctttaaagaaaacgataaaagcagatgccagggcgcacagaagtagcacggcagcaatagcttgcatgtaacgagatcctgaagctggttttgctggttcatttgaacttttggtactatgatggccggtacctcggccgcgaccacgcta

SEQ ID NO: 101480 - DNA, 363 bp, Triticum aestivum
  unsure (1)..(363): unsure at all n locations
  Clone ID: PAT_TA_101480
gggagatcttcagaataattggtagatcttgtcgtctactcatgctatcctgagtgctgctgtgttcgctaaaaccacacttggatcaatgcttctgatacggcactcggcagcaggacaccggactccgtgataataccgttgatcaggttgggaggtgtgtagtcaacagcatcctccggccgccagctcgcactcttctccgctggctcttcgtccatatctgccacgccctcatcctgagagcctttcgactcttgactctcgctacccttcgatgtcttgaattccacgattcgttgttggatcccgnnatcttgctgtcccagtgggtataatcgtacctcggccgcgaccacgcta

SEQ ID NO: 101481 - DNA, 387 bp, Triticum aestivum
  Clone ID: PAT_TA_101481
tcgagcggccgcccgggcaggtatcggcgagggtgacacggtcccgcaaggcataggatgcgaaggatcggaagcagtttgagaggatgacgagtcgggaggggttgagtgagagttttgaagaggcggtgaggagcattgatgaggggagagtgagggaggaggaaggggcgttggagagggacgtgaagatgacgccgggagcgtgggtggatgggtcttgctgaagactcgggaagagctggcagtataattgatggatgcgggacggaaaggaaggaagatgacgaatgggaaaggacatggacatggcaagtatgtcatactgctgtatgagcagcatcaatgaggagggaattaagctgtacctcggccgcgaccacgcta

SEQ ID NO: 101482 - DNA, 512 bp, Triticum aestivum
  Clone ID: PAT_TA_101482
tcgagcggccgcccgggcaggtacactttgtcgagacatagatccatcaaatttggcaaccgagaaagggatggcaaaggatcttctctcagctgcgaccaggatagacgcagtgaacacaagttctgctccatggcttgaaagagaggagactccgccaacaatgccccttccggtaatcttccgcccaaacttagcttttgcaggctaggcgggagggcgttcaacaacagaacctcattctcatcactcgcactcacatttaggttggacaagaattgcataagaactagagactcgcagaggtgttcacaaaatgttcccttcacgacccatatcctcaagcttcttagttgccttaactcccttagttgtctaatggatccatccacttcctgcacttccaacgcttgcagagtctgcaggtttgttaggttcccaagcccaatagggaagcatacacctctagcatatcgaatattttgtattcgacctcggccgcgaccacgcta

SEQ ID NO: 101483 - DNA, 269 bp, Triticum aestivum
  Clone ID: PAT_TA_101483
tcgagcggccgcccgggcaggtactacttaaatttaataaagcaaatctttttttacaagaatgatcatgttattaacccatcaataaacaatatggacctaactgcgtatatatcgtcaaaacgcgggtcttctaatggaaattctggaccatcatacaatggggcaaacagttccaatgttgaaaaaattaagttcaccagcagtaatattgtaataaatagctcatttagttcaataatagcagtacctcggccgcgaccacgcta

SEQ ID NO: 101484 - DNA, 286 bp, Triticum aestivum
  unsure (1)..(286): unsure at all n locations
  Clone ID: PAT_TA_101484
ggaacccgaacagtatcacttttggggtannnaactaaaganntcatcaacacatctaaagcttggccttgctcgcctgcctgtccaactggaaaatggccctggtctccattccatacgctctggacatttctgcagccttggccttttgcgcctcaatcttcgccaggcagtccttgcccctcttggtctcgttcctgcccaattggagcaagtgaacctcatcagggccgtcaacgatcctcattgtgcgaacgtgcgcgtacctgcccgggcgggcgctnga

SEQ ID NO: 101485 - DNA, 356 bp, Triticum aestivum
  Clone ID: PAT_TA_101485
tcgagcggccgcccgggcaggtactggaaagttatcgcaatcaacgaacgttgtgctgtgatctgagcgtcgttgcagggctgaatcgacaccacacgcctcaatatgacagtgtccatcgctgtcgcaaagatcgacaatcgcaggaatcccacaaaagagtcgccatcccactgaatccgcagcatcataccacccatcctcacccatcctgacatccccacaaaacaacccaacccaagccctccccttcaaaccgcacaacaccccacctcccccgtcgccgtgctagtaacagtcaaagtaggacaagtaatcggcccacaatccgtcgtacctcggccgcgaccacgcta

SEQ ID NO: 101486 - DNA, 635 bp, Triticum aestivum
  unsure (1)..(635): unsure at all n locations
  Clone ID: PAT_TA_101486
tagcgtggtcgcggccgaggtacaactaggggtaaccgtccagattttttaactatcttaataactatttccctcatgtccttatcatttttcatgtcttcctcacttctcctcatcttccttagcagtaacctcatggcatcaattgttcctagggattgatggtggtagataagtgatctggaagattccaaattacacttctcggctaagtcaacatcttgtgtcgttactattatccggctacctttgttgttactaagaggaaaaacaatagatttgatccaaatccaatcatctatgttccataagtcatcaagaacaacaaagtacctcttctcaagtagctctatcctcaggtaatgggcgaggtcctcttctcgcatcaccttcccttcaagttgcttcatcaatgcttcatcactgaaaagttttttgatcatatctttaagaagctcaatctgcaaaatgactgcgagactgtgatccaagcacatgaagaaaatttcttcgcaatatcactttgatagaccttggttgcaagantagtcttgcctactccacacatgccaacagcacatatcacattggctggaccatgtttggcgttgacatccatcagcataatcnnctnn

SEQ ID NO: 101487 - DNA, 404 bp, Triticum aestivum
  unsure (1)..(404): unsure at all n locations
  Clone ID: PAT_TA_101487
tnnngtggtcgcggccgaggtactgtttgtcgtcccaaagctcactgagttcatcgagtatgccctttttgcccttttccctcatgtttccttctgcatccactgcattggactcgtcgacaccatttggctctacgctctcgccgacggccaagttcggatcagtctctccgaggttgaacaggtccaggatctggtcagtctccatggtgcctaagcctgcgttctgctgattcaccactgtagaggcgacgtcgattttgaagcgctggagattcaagatcttctctnnnagtgtcccacgagtcaccaggcgataaacattcaccactttcttctgnncgatgcggtgggcgcgatccatagctnnaagatgctnnnnnggtttaaannnnntnnnnnnn

SEQ ID NO: 101488 - DNA, 239 bp, Triticum aestivum
  Clone ID: PAT_TA_101488
tcgagcggccgcccgggcaggtacttgatgttgacaagcacctcatctgggccaggcttctggacgggaattttcttgtagacgactggtccgccggtcttctcgacaacttgggcccactgctcggtagggatgtcgcccatttttgcggtgattggaattggtaaagtttgggagatgtcggggttgaggtcaattggtattggtgggggaggaatacctcggccgcgaccacgcta

SEQ ID NO: 101489 - DNA, 318 bp, Triticum aestivum
  unsure (1)..(318): unsure at all n locations
  Clone ID: PAT_TA_101489
caagttaaaatcctgacgtcataagctccaaataaaaaaacctcaagctccaaataacatctgggagatttggccgcaaaaatgtaattctcccaaatagagcgacgacgatgtatatacatacatacaatcgagacccagagcgtagcgagtgactcccgaatcaaacccatccatctatctaaagcagccttcaaatccaaccaaagaaatccgatccaatcctccagatccaccccatttgaaactgagtgagcacgttgcgcctgccgctccaccaacacactttaatcaanacctgcccgggcggccgctcga

SEQ ID NO: 101490 - DNA, 271 bp, Triticum aestivum
  unsure (1)..(271): unsure at all n locations
  Clone ID: PAT_TA_101490
tcgagcggccgcccgggcaggtacatgttcacacctcgaagcgtgcactcagactaagctatatacacattgattcataaaacattctgcctggcacagcgagtcgttcagtaagtgtagcggaagccgtcgtcggcgccttcgattgcgaatcctccccgtgcttgcttcttgttggcaaagtagaagtaggtgttcaaacaacagcatgtcgtgatcatgagcagagaagcgnnnnnacatgcccannnacnnnnnatgtatnngnnng

SEQ ID NO: 101491 - DNA, 413 bp, Triticum aestivum
  Clone ID: PAT_TA_101491
tcgagcggccgcccgggcaggtacaagcaaatccggtattcaacccaaaactccacgcactcatgagaaggatgaccatgctgttggccatccgctaaacgcccgcatccaaagaaagaggactctcgtccattcagctttttcaatcatgaatcacatcctcctcaattcacctctcattcaaaacgtctccccgacctctccgtcatccgtccaattcgcctcgcttccatcaaccacatacctcccattcccttggccctcttcgacaatagcctgttcccgcaccctcttcaccattcccagccctccactcgccgtcccgggtctcttctgaggaccaccctggccgacacgcaccacactctgctgcgcctgctgtttggcatagtacctcggccgcgaccacgcta

SEQ ID NO: 101492 - DNA, 304 bp, Triticum aestivum
  Clone ID: PAT_TA_101492
tcggcggccgcccgggcaggtctgcatctcgccggcgagccttccgtccacccctgcatatcccccaccattaccgtatccaccagcgccataccctccaccgtttccatacccttcaccgtctctgtatcctccatcatgcttgtttccacctccccacttctcttccttaggcaggcccgaccctcctgcaggtttcacattcttcttcttggattctttagcatctgtaagctctctagcacccgctacatcctcggagagaagcaggagcgaggctagtacctcggccgcgaccacgcta

SEQ ID NO: 101493 - DNA, 514 bp, Triticum aestivum
  unsure (1)..(514): unsure at all n locations
  Clone ID: PAT_TA_101493
gcggccgcccgggcaggtacatgagtgcatatctaatatcattttgaatcaaagctcatcctgactgaaaacatcgacttatgtccgtcaatggcatactaaaagaacagttgtatccaagatgcctttaggccatctctgcttgtgactattccttcatcagacatcatcagaccctatcgccatatgatttcccaagccatcaatatcaaatgcaccgtgatcattagactcccgaaatatcgtcctgtgatcttccataaatcccctcagaaatttcaacagtaaagaactctactaatctttttctgaatggctcctgtgatttttgggagtgcaatcaatgagattagcttaaccagcatcatggttcaacttatgcaactaccagcatctgttttattgaaacaaaannnncttagcttaactacattatctcacaatttcattagggactacagcagtagcaaaagcatcatggnnnnnncttcacacctcggccgcgnnnacgcta

SEQ ID NO: 101494 - DNA, 502 bp, Triticum aestivum
  unsure (1)..(502): unsure at all n locations
  Clone ID: PAT_TA_101494
tagcgtggtcgcggccgaggtactgcacgatcgagccaaacaaactgcacgcacacattctgttttttgcgccactgtctatggccgctgatgatgttcatggggcacaatacatccatcaattgttttacacaaccacacacacatacatacacacaaaatcagcactagcacctgccagagctgcaagagaggatcagcagaactgtatttggggaccaaccgagctgcacaaaatcagaaacctgcaaatgtagctaaagatgacacttgcacaccagcaccgaaatctgtaaaatcaacagaaaaactagtaactggtcgcccaaccgcaccgcaccgtgagcacaagcaaattgcagtgctgtgcactagcaaaatccgaagaaagaaaattttctttctgaactgcaatagaaccagcacgccggcgcttacaaacgaatttggaacatgcaagagctgggctcgtgcaagtgtacctgcccgggcgnnngctcga

SEQ ID NO: 101495 - DNA, 380 bp, Triticum aestivum
  Clone ID: PAT_TA_101495
tcgagcggccgcccgggcaggtccgggcaggtacactacccataagcaagagctgtccttgagctttcttgcttgtcgagaccccccacaatgtatggacagaccataaggagtaatttttgctttatggttaggtctttctttaagcactaagtgttgatcaattgtgttaattccatctattcaggtgtggccgattgagggcatcaagaagttcgagaccctgtcttacttgccacccctctccacggaggccctccttaagcaggtcgactacctgatccgctccaagtgggtgccctgcctcgagtttagcaaggttggcttcgtcttccgtgagcacaacagctcccccgggtacctcggccgcgaccacgcta

SEQ ID NO: 101496 - DNA, 422 bp, Triticum aestivum
  Clone ID: PAT_TA_101496
gcggccgcccgggcaggtacttgctcccttctcgaccaaacccagagtgcttcacgccgccaaatggcgactcgggcgcagagatgagcccagtattgatgcccaccatgccaaactccaaagcctcagcgacgcgatagcagcgctggatatccttggagaagaagtagccggcaagaccgacttcggcttcgttagcgagcttgacaacctcagcttctgtgtcaaagggaaacagagctgcgaccggtccaaaggtctcctctgaagcgatcttcatcttgctagtcatgtctctgatcaccgttggagcgaagaagttctcaccgagctcgggaatcttctctcctccggccaagacctttcctccgtgtgatacagcatcgtcaacgtggtcttgtacctcggccgcgaccacgcta

SEQ ID NO: 101497 - DNA, 474 bp, Triticum aestivum
  Clone ID: PAT_TA_101497
tagcgtggtcgcggccgaggtagactttatcaacaatttcagctacgggtatgatgctcgcattgtgttctgcatcacttctcccgcttgtaagacctggaagacattatgcatacagcctgtcactgtcagatattcaggtctcgcaactaaacaaaaacatggtagactgcatcatacctgtagttacgtcatcttctggttgatgttcgtgtgccgtgctgtttgaattccccatatgcaactattgaatggcaaaaatcatgaaggcagaaatggtagttctttgatgatcttcaccaacatggtaatttcttctacatctttgacattctgcaagggttattgttctacatatatactgcaacatgttgctagcatatactgcaattgtattttattctacatatatactgcaatggcactttcatctacatcttctacatctctgtacctgcccgggcggccgctcga

SEQ ID NO: 101498 - DNA, 350 bp, Triticum aestivum
  unsure (1)..(350): unsure at all n locations
  Clone ID: PAT_TA_101498
tagcgtggtcgcggccgaggtacctgaagcgaggattcccgggacagcgacgaaagatccanngttggaagagtagtttccgatgatggcagtgttgacgatcagggtgaggacggtctgttggttggctgcggtgttgtccttcnnnnaagcggtggtgtatttgtctcacagcggcggatcatgaggatgctcacannnnncacnctgctgctggtatgtttnntggactgcaccnnnagaaaggacggaggcgagggtcataatggaggtcttcatggctgccaaggtactggtgcttctnnannnttttacccgctgagctgtagnannnnnnntgtgatactggt

SEQ ID NO: 101499 - DNA, 539 bp, Triticum aestivum
  unsure (1)..(539): unsure at all n locations
  Clone ID: PAT_TA_101499
tcgagcggccgcccgggcaggtctgatttgatttttgccggcgattagcctcctttcttgcgccggcctaaataagcagaggaggagtagtaggggggattcgaatatgggcagatcaggcatctgccgcttgtcgcagatccaataaggtcgatccaaatagttcaggcgtctcatcatcaagaacagttttttcaacaagaccagttgatctgatcagccatgacgaagaaaagacgtcaccgcagaaacaacgtaaatgcaacacagaaagcaactctcaacaaagacgctgctggcagcgaagaagtcggagacaggcttagcaagctgcctaatgacattctactcaacattctggagagggtggacacgctcgatgcatttgctggcctcaagcgcctgtnnnctgcgcatatgannnttggtgaaagtgacatacccaacatcctcagcacttgcaagctcttggagtctttgcatttaaccaattgcgactcgggggntgaatnnnntnnnnngcaactagnacatgctaa

SEQ ID NO: 101500 - DNA, 569 bp, Triticum aestivum
  unsure (1)..(569): unsure at all n locations
  Clone ID: PAT_TA_101500
tcgagcggccgcccgggcaggtatcctcatccggttcctcttcatctgcgccaaagacccaccacttcgccgtcaagacaaaagacgaccgcattgattggatgcgtgaattgatgctcgcgaaagcactgcagcaaaaaggccaaggattcgaagttgaggtcaatggcgtcagggccgagtaacactcctggagactccttttggtgcgactttgattattcttttgacgactttaacgcgagaagccagcaaagcgatgcatatccttactttatttcacagtcattttcttccgggcatcattataccacaatatcatcatttcggccgttgttggattccctttgtctgttgagggaggcagtgcgaggagcttggaacagggaggagataccatgacgggttgctggaaggcagcccacaaaatggccaaggggaaagnnnangcgggtttgactccacttcgatcactgcccacgggcttttcggaacgacgttgatgagcagtatctataatccagtagttctagcgctcgcaagnnngagtatcacactnnnnnngattt

SEQ ID NO: 101501 - DNA, 160 bp, Triticum aestivum
  Clone ID: PAT_TA_101501
cgcagttgaaagatatcattcattcatatacccataaagccgttggaaaatgccatcccgctctcccattgcatgcactcctcctttatccactaccagcgccctttaccataacttctgctcgttgcaaacctactgtacctcggccgcgaccacgcta

SEQ ID NO: 101502 - DNA, 371 bp, Triticum aestivum
  Clone ID: PAT_TA_101502
tcgagcggccgcccgggcaggtacctgtctgtaaaatcattgccagaagaaatgacatttatttcgtcattattgccatcttcccctaatttcttcagagattcagttcctttgctattttttaaagactccagagcatcttctgatctatatttccctgacatgtggaccatatcatcaccattcactctccttttctttccagttttttcttcttcgcttgttgaaagggcagcagatctttttctagctgctgaaccattcttttgtcgctgatcatctgggctcatttcataagcattatatgggtcgtcattaccagcattcacactggacccttgttctttggtacctcggccgcgaccacgcta

SEQ ID NO: 101503 - DNA, 463 bp, Triticum aestivum
  unsure (1)..(463): unsure at all n locations
  Clone ID: PAT_TA_101503
tcgagcggccgcccgggcaggtacatgggtgaccnngtctggttgatcacgtcgagacatacgctgccggataactcgtcaatgttggggtggaagatgcggttcacgaaaccgatgcttgggctcttgtagggatattggtcgggtagttcgacgtggattttccagagtcctccttcgaatggagtctccgttggccccttgaatcttacatagaactcttgcatgttgtcattgaccagagtcacctcgtagtcactcatgagcatcttcatgacatctgtctcgattctcctctttggactactcatcttgccgtctgctccccgagtatgcgccttctgagtgtgctccctgcgtgtgttcgattccgcttggttcccacgaaggcaattctttctgatatggctgaatgatcgtattcgacgagctcgaaggtagtacctcggccgcgaccacgcta

SEQ ID NO: 101504 - DNA, 471 bp, Triticum aestivum
  unsure (1)..(471): unsure at all n locations
  Clone ID: PAT_TA_101504
gtgcttgctgatctcttcattcacgtgatatgtgtgcgagactactatcagagcggaattctgcgcttcggccccaacacgccgccttcgagcctctcccttcacaggacaccactcacttcgtaatgaagttgagatagtctgcaacgatgagcgtgaccattgcatggggcgctatccttacataatatgttgagaacccacgatagaacctgagcggaccctcatcccggatcaccttcttcgcgcagtcaaacatgttcttatacgggagcttgccatccgggccgcgggactgcttctggagacgggtcttgatgaaatcgaacggcaaactgaagaatgatgcgaagaatcccgcaacggccgatgcagtgagagtctgggcgcgagggcccatgttgtcnatcttcttcagccttgctttcgcctcggaaannaaccctagctgannnnagttcaatgccntag

SEQ ID NO: 101505 - DNA, 228 bp, Triticum aestivum
  Clone ID: PAT_TA_101505
tagcgtggtcgcggccgaggtacattttatagactatagatagaggataataatgtagttgcttcgttgcgttttctgatcagcctcgaccggtcaagccagcagcaacctccgagctctcacttcactcgtcgaacaccttgcactccacggcgttggggtcggtcttgcagtagtcctccagcgggtcgccgctgccgccggtcacctgcccgggcggccgctcga

SEQ ID NO: 101506 - DNA, 521 bp, Triticum aestivum
  unsure (1)..(521): unsure at all n locations
  Clone ID: PAT_TA_101506
tcgagcggccgcccgggcaggtattgcgtatggttcgaaggctacgttgaagaacatgggatacggtggtggacttctacactctcacgtgcagacctatcctgagggatctggccagcagcaaatcacttgctaccaccacaaagatgccaacaacgactggttcttctacccgaacagacaccagcctacctacgacccggaagcagatctcaagtttgtcggcaacggagacatcatccgattaatccacgctcagaccggccgcaacctccactctcacaccgtccccgctcccgtcaccaaggccgaccacgaggtctcttgctacggcaacttgactgttggtgacaccaaggaccactggatggtggagactgtcagtgatgcggcttccaacgattggacgaagcttcgcactttgaccacttctttccgtctgaagcacgtcgatctcaactgctaccttcgtgctggcaatgtcaacctgnacagtgggggtttcaagcagattgagacga

SEQ ID NO: 101507 - DNA, 416 bp, Triticum aestivum
  unsure (1)..(416): unsure at all n locations
  Clone ID: PAT_TA_101507
nnaaatanccatggttatcaatcttaattgaannnaccaaaaaaaaaccacaaatcccttcccctaaaaaaaggaggaaacaactaaaacaatttattcgccgtaaccaaatcatatatcaagactcccccccatgatccccagggccatgtggtgcctgtaattatataaaaaataaaatnncttaacttcattcttagccaacgatagccatggttatcaatctttattgaaaaaacaaaaaaaaaccacaaatcccttcccctcaaaaaaagagggaacaactaaaannattcatttgcagtaataannnantcaaatatcaagacttccccacgtgaccccaaggcaaacatgcccaaataaatccccataatggggatgcntatnncgcnagatcctggcgagggcctgaa

SEQ ID NO: 101508 - DNA, 267 bp, Triticum aestivum
  Clone ID: PAT_TA_101508
tcgagcggccgcccgggcaggtacacgacgacccgcagagaggccgtcgctccaagcaccgcctcgtcaaccaaccagatcacaagaactctactgaatgcttcgtcgagccgcagcgctacggcaacgtctacccgaacgtccaccatccgccgatcgtccttcaattgccacattatgagcttcaaattgtcccccgattcgacgtatcgacacatgcactcgtagaactggcggtcgagcagtacctcggccgcgaccacgcta

SEQ ID NO: 101509 - DNA, 595 bp, Triticum aestivum
  unsure (1)..(595): unsure at all n locations
  Clone ID: PAT_TA_101509
tcgagcggccgcccgggcaggtactattgtgttacaaaggtaaggaaattcagaaatttactagtgttcatcaatgatgctttcttcaattatgggggtttgagatttataggagaaccgtgcttgatccttagcatctgatgttgctgacggaaattgtgtaaaattgcagttacatcactgcaatgtccatgattcaagtttgtatgtttccttgtttgcaatgggaattttctttactccttttgcattaaaagaatgcacagcaagatgctccaaaatacaagggactagtgtgaagaaaaatcctgcgggcaaaatctagagtcctgctgctttaacatccttgtaaacaaatcgatgatgttgacaaaaagttgcatcgtagcacatcatgcaactcagttcagaataggcaccgctaagtaaatttaatgattttgttgactggacaacaacgcttctgtggatacctcacgtatggtaacttggtaagatcagattttctttgtcaagtgtgctgatatctttttctaatgataatgatatgnnnnnacttatccatcctttgagtacctcggccgcgnnnacgcta

SEQ ID NO: 101510 - DNA, 605 bp, Triticum aestivum
  unsure (1)..(605): unsure at all n locations
  Clone ID: PAT_TA_101510
tagcgtggtcgcggccgaggtactcgtgccatcccacgaggcgatcgtaatagcatgcaactactgatctggccatgtcgtgatcaggctcatgctgcatggatcggttattgtttttgctagaaataaaatctacgagacgacatgagatgattacagacttttacatatatagatggtatatgagtgacttgaggcaaaacataaacctaaatcggcttccacaatgatagaccttggcttctcactagaattcagatcatatatcaacatgcatcactcccttgctgtaatgtaagtgcgctgaaaggcacggggtaggaactggaagtgggtcgctggatgagtgtttggtatgcctctcgcatggttggccttgcttgtggagaggattccaagcaagaaaaggccatcttgatgaggagagctaagctattctcttctgttgttgttggtgttgtcggccgttggtctnnaatatcttttactagcatagcttgttccccgctcaacaaactaccgtctaatagatcccttggatgcttccccatcactagctctagcacaaccacaccgaagctatagacatcacannnnctccgtca

SEQ ID NO: 101511 - DNA, 267 bp, Triticum aestivum
  Clone ID: PAT_TA_101511
tagcgtggtcgcggccgaggtccgtcttgctcggcatggcggtctgctggtgggattctgatatccggtggatctcggagaagtagaacttcaggtcgtcgggcttgacccatggtgtgatgccgtgtcccaagttcgcgatccatccctgcttgccacctccaaagcccttcaccatctcttcgaccaccttcgtaatgccctcatgatctccatacaacacgccggggtccgcattcccctgcacctgcccgggcggccgctcga

SEQ ID NO: 101512 - DNA, 633 bp, Triticum aestivum
  unsure (1)..(633): unsure at all n locations
  Clone ID: PAT_TA_101512
tagcgtggtcgcggccgaggtacaaggggcagaatacatgctatataagaaagtaataaatgttgacttacatattaataccctgcctttttatcacgcgacatgcatgcatgggacggtccacgaattaaagcctgccaaattaactagcaattgatgcatttttattagtttccaaatcagttgttgaacatgatccaacgatgaagaggcaaggtgcccaggcacctaggtgtcccaaactggaatcctatatatatattgtttgtgtgatatcattcttttaaaaaacaattatagtgtcctgttgtgctagatgtttgatacttcgcttgaataagaagatatttctcaagcagaggaatacagttatgctgcgctcttccatttttcaggctttggttttcactgatatcaagataaagttgcctcgcatggcaacttcctctgatcctaattttcttatcctggtatttttttatcattaaagctgagaaatgtttctcaagcagnnnaaatacagttaaattgttcacttacatttttgcatgtttttgttttcgtgtnnngatgtattttagtgtcccgcctccgacgcgccgtgggtgcnnnacgtcaatgcagcnnnctcca

SEQ ID NO: 101513 - DNA, 157 bp, Triticum aestivum
  unsure (1)..(157): unsure at all n locations
  Clone ID: PAT_TA_101513
ggtttttttttttttttttanntaacacaaattttatgaaaccttatatgtttacagcaaatatatnnctcaaaaatatttttaaccaagcacaaccagctttacaaacgaatggctttaaagtttaagccaacaaattttttacgntnnngtgcag

SEQ ID NO: 101514 - DNA, 278 bp, Triticum aestivum
  Clone ID: PAT_TA_101514
tagcgtggtcgcggccgaggtacctatctttactcatgccagaaggtggtatcatcgctcccaaagaaaaaaagtcgtctctcttcctcgaatcttcccaaaaaaacctcgtcactctcaatgcccaatggcccgtgttgtgattgcatgctgggtcttttccgtgagccgtggcgattgtcctccctttgtgaagtgaggacagtatagatccgcgactcctgaaagagtcttccgtccactgcttgccgcacgtacctgcccgggcggccgctcga

SEQ ID NO: 101515 - DNA, 309 bp, Triticum aestivum
  Clone ID: PAT_TA_101515
tagcgtggtcgcggccgaggtactggttgccgttctcgccgcggtggttgttgagccaggacaggggtgaggaggcatgggaggttacgcggaggttgcatgcgaatgagaaggatcccggagatgggtatgcgagagccgagttccgacagatgcagacgcaaatcgaggcggagagaagaatgggtgtgactggaaccttggccaaggtgaagctgggctttgggcaggcaagctttcggaagaggttggcattgagatttctcgtgcaatttggcaatcagtgtacctgcccgggcggccgctcga

SEQ ID NO: 101516 - DNA, 371 bp, Triticum aestivum
  unsure (1)..(371): unsure at all n locations
  Clone ID: PAT_TA_101516
gcgaacaaaccttgctcaaggtttcatttcaatcttaaaaacctaacgaacaaaacggggaccgaacnntaaccccgaacgggagcagcggcacatttaacgggagcccgaacatttcggaacccaccccacggagccaaaactaagatacccgggagccaaccaaccaaaaccttttgggaanccgggaaaaaccggtcggggaaccaagannaccggccnncgaggggccccccccttcactccctcacaaaatttaccccccccccccattattatcgccccccccccnnaaacaattggggcaaaacttggcggggggcatggggaagccaaccggggcgtacctgccccggcgggcnnttnnnnnn

SEQ ID NO: 101517 - DNA, 632 bp, Triticum aestivum
  unsure (1)..(632): unsure at all n locations
  Clone ID: PAT_TA_101517
tagcgtggtcgcggccgaggtacctgtcaaacctaaattatgtatttgattttaaactagtttttgcaaacccagaatttggaacatcgggcataacagccccagtttcgccctttctgtttttagatttgtcttcagttatgatgcgtgtagcacagtaatatatccaacttgatacgaggaacagttataatttctttccagccattgaattagcagttacgttcagccaagttatgactttatctctcatttgaaagctatcagttgttcttcgatgtctcatcctgcacaacaatgtagctgaagaaaatctttattgaatgaaaactaactataccatgcattctctcgacaagattttgaccttttctggattaatatttttcaaacaagaaatatgttactggtggtgcatattaattaagttctgcacaaatgacttatgtccttcgatattttcaggcacttctgaagctttccttcattctgttgccaatgaaaaccagcttaagcagtcaaacaatatgttgctccttttctcagcaatttatactgttctaaatgttgcttttattaaatccgccggagctgnnnnnntgatcgctgcaaattctgtcaatatgctactg

SEQ ID NO: 101518 - DNA, 325 bp, Triticum aestivum
  Clone ID: PAT_TA_101518
tcgagcggccgcccgggcaggtacacgagctcacggacagacttgaggttggggtaaccgtaggcgatgaatggctcgacgatcttgagcatctccgaggtggccttggtcaggcggataaagacaccgttgttgatctggagcagacggaggagctgaagagtcttgcgcttcttggggtcgatcttgttgatacccttgatgcgcacaacgaacacgagcttgggctcggctgggacgtagtagctgccctcagacttggcgacacgacccaggcggatcttctcgcgctcgaggtcgcggtacctcggccgcgaccacgcta

SEQ ID NO: 101519 - DNA, 506 bp, Triticum aestivum
  unsure (1)..(506): unsure at all n locations
  Clone ID: PAT_TA_101519
tagcgtggtcgcggccgaggtaccggctcgcaggaggtccaggaacagatcatgcgtgtgttgtgtgagcgtctgatggttccacgcccacatccgtggggtctcattgtcatgatgctggagttggtcaagaatgagacgaacaatatctggtctttgccgtggatcaagacggcgcctcaagtcgagtcgatgttgctcaaccttgcgcactcacaggatcagaggcaggctcgcagccccatgggagcaatgatgtaatgggagaattaatggttgtggagagccctcagcaatacctacggataacgggcgagccgctactcggcgttggttttgaccaacatatttcaggagttatgggcgatgggcgaggtgcattacagaggggaatggaaaagccagggttaccagggacagctttgcacggcgtttgatgggatggggcnntaatcgtgcactaatctacagcaaaagccatgtacctgcccgggcggccgctcgaa

SEQ ID NO: 101520 - DNA, 433 bp, Triticum aestivum
  unsure (1)..(433): unsure at all n locations
  Clone ID: PAT_TA_101520
tcgagcggccgcccgggcaggtacggattcgtggtcgtctatggagggaagaatactctcgtcgatggaaccagtgcttcgtcgccggcggctgctggaattctcaccaacgtcaacgacgctctcatcgctgctggtcgtcctcctcttggattcatgaacccatggctttatagccgtgccggcagggggttcaacgatatcaccgttggcaacatttggggttgtaacacatctggtttcccggcgannnatggttgggatttggcgactggatatggcacgcctgatttcaagaacattcgcgccgctcttggtgtgtagagnnnnntcgttgnnnncttgctgnnnnggaggtctacgtcgaatgatcagatgaggtattnnnagagaaagacagacaaccagaatgaacangtcgttcgnncaacnn

SEQ ID NO: 101521 - DNA, 307 bp, Triticum aestivum
  Clone ID: PAT_TA_101521
tagcgtggtcgcggccgaggtcatccatccatccacgacatcaacatcaccactttcaccaaacgcacctttcttcaaaaccaaccccaccacacaaatccatcaaaatgactggaggaaagtccggaggcaaggccagcggtgccaaatcgactgcgcaatcccgttcatccaaggccggtctcgcattcccagtcggtcgtgttcaccgtcttctccgcaagggcaactacgctcagcgtgtcggtgctggtgctcccgtctacctcgccgccgttctcgagtacctgcccgggcggccgctcga

SEQ ID NO: 101522 - DNA, 276 bp, Triticum aestivum
  Clone ID: PAT_TA_101522
tcgagcggccgcccgggccggtactgaggtccatacttgctacggaacgtctcgtatgtaacgggttgtctccatggcgtcactccacttcgtccatcctttcccaagtatcctccaccaaccatgcgggcgagtgtaggctgcatcgtgttggtcgcaatttgtcgcgagagagggctgtatctgaaggcgatctgcggtcgcaattcgaggatactgtggccggtcgatgcggtcggcgatgtcaaatgaaagacctcggccgcgaccacgcta

SEQ ID NO: 101523 - DNA, 276 bp, Triticum aestivum
  unsure (1)..(276): unsure at all n locations
  Clone ID: PAT_TA_101523
tnncgtggtcgcggccgaggtacagagcgccgagaccgagcgcaatgtagaccttgggcacgctggtttgcgactcaaagttgttgagggtggggtatttcgacagttccttgtcgagctgcgagagatggtattgtgccctctcttggacggagccctgtgtgtttccagacattccgaaggtttgttggtggttcgacggtggtattggtgttgatgcggtgatgcggtgatgagtgtgggttggttttaagacctgcccgggcggccgctcga

SEQ ID NO: 101524 - DNA, 318 bp, Triticum aestivum
  Clone ID: PAT_TA_101524
tgtcgcggccgaggtacgctgcctggtcgactggtgataccgtcaagagcaaggagcctgtgccgctttggcagattgttgtcattgctttgaccatctgtttcggtttctgcacatatggttacaacatcatgcgagtcatgggtaacaagatcacctaccactctccatctcgtggctcctccatggaaatgggtgccgccatcactatcctcatcttctcgcaatacaaactccctgtttccacctccatgtgtataactggcgccaccgtcggagtcggtctctgcaacggtacctgcccgggcggccgctcga

SEQ ID NO: 101525 - DNA, 543 bp, Triticum aestivum
  unsure (1)..(543): unsure at all n locations
  Clone ID: PAT_TA_101525
tcgagcggccgcccgggcaggtacttctcatccatctgcggcttcatctgcttcggcactttactccactccctattatgctcctcctcaagcctcatgtatctctcaatctcgggaacaatccactcagttgcagtatctgcagtccgtccaacaacttccatgggaatcaaatgtccgatatcctgaaacgtgacttctttcactcgacctttcttcgcgccgccggaaccaccaggaccgataccggtgctggccatcttgtccgctttcagcatgggagtagaaacgtctgacttgccgccaaagagatacaagacgctgggccgaacgaatggcagacgtgcgtgggttgctactggttccggtctgtagaatggggagttgggacctgtagctggatcgacgtcgatgtgggtgatggggttggcattgttggaaggatccgggtattctgatgttgggaaattggcccggaggaaagtcaagacttcttggtgttttgtnnnnnttagcgtcacctccgtctctgtgttcttgtcg

SEQ ID NO: 101526 - DNA, 266 bp, Triticum aestivum
  unsure (1)..(266): unsure at all n locations
  Clone ID: PAT_TA_101526
atactacacaaaaaaccccaacacacggggttttttataaaaaggggggcacctatctcttgctcttgaaaagcgcagggaatatggacacgtgccacaaatttagcaccacacaaacggggtgatgaaacaccgcactatacactatactatactgtgctgtgctataatgcgcaaaacatacanctcctatacacaaaccccttgtcctatatagaaaaagaaacatcnncatgtgccccttgtgctcacatggagcacaatct

SEQ ID NO: 101527 - DNA, 202 bp, Triticum aestivum
  unsure (1)..(202): unsure at all n locations
  Clone ID: PAT_TA_101527
tagcgtggtcgcggccgaggtacgccggacagagcaagaagttgaaggttgtgacaaaggtcaacccagatatcaagggaggcctcatcgtggagattggcgagcagacgattgacctcagcgtctcatcgaanntgcagaagnatgaacaagctcctttcggactctctgtaaatatgtacctgcccgggcggccgctcga

SEQ ID NO: 101528 - DNA, 300 bp, Triticum aestivum
  Clone ID: PAT_TA_101528
aaagtagtgtcatagaattcatgcatgctaagtatcccttcccatcatcccgcgattatctctacttcatcaaaatctttcccttgcctccgccagtaatccagtcatccttgatgatatccgccgccttctccgcagccgcatacaccgacgaaacaatgttaccagacacgtgattggggaacacactcgcgtccacacaacgcacgttcttcgtccccagcacgaccaatttggtatccgtcgcagcacccatggcgaccgatccgcagacgtggtacctcggccgcgaccacgcta

SEQ ID NO: 101529 - DNA, 330 bp, Triticum aestivum
  Clone ID: PAT_TA_101529
tagcgtggtcgcggccgaggtctggcgccaccgtcggagtcggtctctgtaacggtaccttccgcgccgtcaactggcaacgagtcggtctcctcttcttctcctgggtcatgaccatcccgatcgccggtctgatcggtggcatcaccatgggtctcttcctcaatgctccttcttactagattgtctgaagtcggagtgtttcgggtggtgttgatgttgatagacttttacgataccagacaaaattttgcacgcgagcttggcgttgtttgtatatacaccttactaccttattgaatacgaagacattcgttcaaaaaaaaaaaa

SEQ ID NO: 101530 - DNA, 337 bp, Triticum aestivum
  Clone ID: PAT_TA_101530
gcggccgcccgggcaggtacagtcaacccaaggaaaatgcaccgtatgcgcagtttacatgtaagtcgctctcgccttgagttttctgcaccgtctatgctcaaattgtcgatgatggagcgatttactccttctttggcgggctctggaccatgccgggtcccttgtagtctgggttaccgataaaggtgattggctcgaccttgttttccctcaaatactcgttggtcgcctcttgccattccttgttcattgtgcttggtgctgggcgggcgaacatgcgagaggtgaagaaaatggcgccggccgcgccgacacctcggccgcgaccacgcta

SEQ ID NO: 101531 - DNA, 520 bp, Triticum aestivum
  Clone ID: PAT_TA_101531
tcgagcggccgcccgggcaggtactttgttgatgggttaagtgttgtgggtttgttgaggcgtttcttcttggctcccattcggtggtgaccggtgaggtaggggaaagtagaagagctagagagaaagcaaaaaggggaggagatttgcaggctgtttttcggttttggcacaatgaagcatatgaagcttggctccaagccggatgtctttcagacagagggcagcaatatcaggtttgttgcaacagagctggcagcagacatcgttatctccataggggatgtcaagttttatcttcacaagttccctcttttgtcaaagagttcacggttgcaaagattagtagcttcaagtaaccaggaaagcgacgatgaagtgaatatatccgacattcctggtggtgcttctgcatttgaaatttgtgccaagttttgctacggcatgattgtaacactcaatgcatataatgttcttgctgctcgttgtgcagctgagtacctcggccgcgaccacgcta

SEQ ID NO: 101532 - DNA, 601 bp, Triticum aestivum
  unsure (1)..(601): unsure at all n locations
  Clone ID: PAT_TA_101532
tcgagcggccgcccgggcaggtacaactcagaggaaggattttgcgaattggatagaaagcttacagaaaaagaggccggaaagctaccaaacaggctgttctacttgtctatcccaccaaatatattcgtggacgtggtaagatccgccagccgcaccgcttcactgccgagtgggagtggctggacgaggtttatagtggagaagccattcggccgcgattctgagtcctcgggggagcttacccgatccctgaagatgtatttagaggaggagcaaatcttcaggattgaccattatctgggcaaggagctggtcgaaaacctgtcggtcctccgtttctccaaccttgtgttccagccactgtggtcgagggactacattcggaatgtgcagctcatattctccgaagatttcggcaccgagggtcgaggccgctacttcgacaactacgggatcatccgggacatcatgcagaaccacttgctgcagatactggccctgttcgccatggagactccggtcagcctcgccgcngaggacattcgcaacgagaaggtgaaagtgttgcgatcgatgaggaagctgnnnnnngnnnnan

SEQ ID NO: 101533 - DNA, 401 bp, Triticum aestivum
  Clone ID: PAT_TA_101533
tagcgtggtcgcggccgaggtactcatatttaatcagggaataaagcaaaagaatcatattttatgatccagcaggtgtttgtgtgtgtcatcctatgacatgtaaaaacgttggacaagattgtgaccaaagcaggcaagaaaaattatcacaagccggtattgaaaagcacaaccggagtagcaacttactaataaatacgtggtatgtggccacactccattgctacaagaagttactttcctgatgagtaaatcatttgtcaagcagattgctacaagttcacttgaatgacaatatatcctagttgaagcaatagagaaaagaaagtaaagaaataacatctttaactagctaggcagttggcaagctggtagtacctgcccgggcggccgctcga

SEQ ID NO: 101534 - DNA, 620 bp, Triticum aestivum
  unsure (1)..(620): unsure at all n locations
  Clone ID: PAT_TA_101534
tagcgtggtcgcggccgaggtactaatttactgaagcatcaagtaacaactgtcctctgtttggggtcacccctttccctagtagtattgcattctatttccttatgattttttgattgtcttactatccattagagtaagagtctgctctctaacttgtttgtccataccttcttattttagcctctttcattatgtttttttgggaagaattaaataaaattatcagtgcaacatagaggttaaagcaggtggttgagctatcactcaatttcaagaaattgaataagattcttccaaattaagtggaaatattccctttcatattttgttgttctatgcacgtgaacctagaaattaaatattgatcaacacctgatcgatgtcttattttgctagtttgcagttcattcttattaggagcagaatttaagattggggatctatgagagatgcaagagcctctaatcaagggtaaccttgaagaaaagcttgcaacttaagctgcaacaaaaagattttagaaaatgagatctcttgtgcatatttagttgatgcacttgtgtgtgtttagatgttgcagctctgttttcattgacctttgattcatgtacctgcnc

SEQ ID NO: 101535 - DNA, 535 bp, Triticum aestivum
  unsure (1)..(535): unsure at all n locations
  Clone ID: PAT_TA_101535
tcgagcggccgcccgggcaggtactgcggatactttccactgctgatccactctgtgatcggcgtgctgccagcgaagaccaggatgtaattgatgacacccacacacgtgtagttccacagcgtctcgctcttgaagcatccccactggtagagcacaatccagatcaattgttcggccgcgaagttgggatggcgactgtgtttccaaagtccggtggtgttgaagccgcgttcgatctgagcgcgagtccagccttcaggcaccttggcagtctttgcatattccgccttggcctggtgatatgtccattgttgcccatctgcgaagtattcgaacactacgagcgccacgagcagtcgggagaagacttggtcgaaagcggcgatctctggcctgagttgggaggtgagaagcaggacgtaggtagggagggtgaccgcccagnnnagaaccaattggactgtggagatgaaaaaaatgtnaaggagtnnnnntccgaacgatccaatgtacctcggccgcgnccacgcta

SEQ ID NO: 101536 - DNA, 286 bp, Triticum aestivum
  Clone ID: PAT_TA_101536
tcgagcggccgcccgggcaggtactctgcggacgaacagggacgagttgtgaggagcacgcttcggccgtttacgtccgcggcgtgaataccgctgtatgctggatcaccgagacattgcgcgaccttctgcggtgcgacatcgagaaaggaactagctggagtcatcattcggacatcgagaaaggaatcaggttgagtcatcatttgaatacgctgtgcattaacaaagggactgggtggagtagtcatgcggataccgctgtacctcggccgcgaccacgcta

SEQ ID NO: 101537 - DNA, 500 bp, Triticum aestivum
  unsure (1)..(500): unsure at all n locations
  Clone ID: PAT_TA_101537
tagcgtggtcgcggccgaggtactactcaccaacgcctcaagaagcgggccatggcatgaatctgcttcaccagcaaacccacccacgacgaacaatttggcttcctatcactccactatcccatgtttctccatatatcagcgggcattgttaagggctctcaatcatcttctctccgctctcagcctttccattctccacatccgcctcctcggcatcctgcatgatcccgcccatcttgaccgcacgccggcggaagaagactctcttcgcaaacttccacgcctccacgccagcgaagaacagaaccgcagcaatgacgacgatggcccactcccaggtgatgccttcgtgcttgaagacttcgcggttgatgacggggatgtataacgttgggaagatggtcacgaagccgaagatgattgcccagaagnnnaacttgttgcggcggacgtcgtaataccattgagtgaagtacctgcccgggcgnnngctcgaa

SEQ ID NO: 101538 - DNA, 452 bp, Triticum aestivum
  Clone ID: PAT_TA_101538
tagcgtggtcgcggccgaggtactaggtgggattcctttgttggttatatctgttcttaatcacgatcctgctcttaatggacacattcaagaacttacatggagtgacatagcagctctgggttatacatctatattcggcagtgctgtcagctatggtgtctacttctacaatgctacaagaggtagtttgaccacgcttagttctcttactttcttgactcctatgttcgcctccatttttgggttcctctatctgggagagaccttcgcacctgagcagatcggtggtgcacttctgacattggttgccatctatatggttaattacaagagtattataggcgagaagtaagagacagtcaaaaaattgatagattctgtgccagacgggtattgcacttcactggagcacatgtaacggcgttgtacctgcccgggcggccgctcga

SEQ ID NO: 101539 - DNA, 156 bp, Triticum aestivum
  Clone ID: PAT_TA_101539
tagcgtggtcgcggccgaggtacagctacagaatttttttccccaaactgtttacatgacgaagttggtgaggactttctgcactaggtgctccccatacaccaccttctcatacttggcaacgccgcccgtcacctgccccgggcggccgctcga

SEQ ID NO: 101540 - DNA, 635 bp, Triticum aestivum
  unsure (1)..(635): unsure at all n locations
  Clone ID: PAT_TA_101540
ttcagcggccgcccgggcaggtacgtcagcggtaagtcgcccaaggctgacaagcgtttcagatcattcaatactgccgccaagtctttgagcgctcgagagaaatcgacagagagaatgttgagcaggccatctgtattgaggtgactcgactcatcagcagtgctggtgaaagagtagccggtgacggtagtcaatggagtcaaggcagtgatggttgggttcacctggaactcgatccaagatccaggcgtagccttgggaagtgagcgcatcttgcgaccagtctcttcctgaagggcagtcacagccttgaagcgcttatcaccatggttggagatgccatcgaattgtgccttttgtccggaaacgaagaatgctctcacggcttgtgatacattttggacgacttgtgcctggctagctggtgagtgcgagaagaacctcgcgccaccaacacggccactgcctccgagggcatatcctccagctgttcttccaagcgctccaccggtcaaattcggtctcaaagttgatgcgaacggtgcacgtccagangnctgctgaatggcatagctggtcctcgacttggggnnnnnngctctgtcgtacctcggccgcgnnnacgctantcn

SEQ ID NO: 101541 - DNA, 638 bp, Triticum aestivum
  unsure (1)..(638): unsure at all n locations
  Clone ID: PAT_TA_101541
tagcgtggtcgcggccgaggtactgagccaccattgggttgccatctcgtgacttggcggcagcagctatccttctcctcttcattctctcctcgttgcgaaccttgcgcttctctggcttacgggtggttcgtggtgcgggcggcgtccagctttccaacgaagacgtcgaagacatgaaggacttcgtgtcccatgcctgagagctctcggtatttgatcgacggaaggcttgcatcgtatatttggatgatttgggtgttggtcgtgatttagtagtgctgttaatccggttgagcgttggtgttcgttgtgtgttcgagctggtcttggagcagtcgatttttgtgagatcacttcggtgtcggattcgacctgcctttatgtctccggcctccctgaattcggtatcaccaggaccaactccagtcgagaagatgcatcattgctcatgtgagaacatctagcgtgccggccaaggcgacaaaacatccgtgcgaacgtgcgtgactgcacaatacgcaagatcatcaagagtcatacgacaacgtattggcggaaacgcgactacctgcatgtatggcggcaatgttgctcnnnnngtcnannnnncngncnnaagtcggnanngntcaaag

SEQ ID NO: 101542 - DNA, 175 bp, Triticum aestivum
  Clone ID: PAT_TA_101542
tagcgtggtcgcggccgaggtacatttcacatctcgtcctagaatattgtcccacatcccgtctgacctttgttcctcatacctcacttttgaaagccatgaccattatcccgcacgctgactccgaatcttttcagacaattcaattccgtacctgcccgggcggccgctcgaa

SEQ ID NO: 101543 - DNA, 189 bp, Triticum aestivum
  Clone ID: PAT_TA_101543
tagcgtggtcgcggccgaggtcatcgtgcatagctggcaccgatcagcctttgatgccattatttatttatttccagcatggtggaaaaagatagaatatgtgcatgagttgatacatgagagaggcgctctttgtaaaattatcaagagtaatatacttcgttgattccaaaaaggaaaaaaaaaaaa

SEQ ID NO: 101544 - DNA, 209 bp, Triticum aestivum
  Clone ID: PAT_TA_101544
tagcgtggtcgcggccgaggtgctaggtttattccctagctctctttttctcctgtcatcgtcgtattatccgtatttcagtttgcttagctctaaagactcctcctatagtggtatcatcggaatcaccagaaaaagagaaaagagaacctgtggcaagacaaaggtagtgtcgccaggccgccgtacctgcccgggcggccgctcga

SEQ ID NO: 101545 - DNA, 579 bp, Triticum aestivum
  unsure (1)..(579): unsure at all n locations
  Clone ID: PAT_TA_101545
cgagcggccgcccgggcaggtactatactcatgatcaaagcatgaattgaatattcacatagactgcacctcccctccacaaatcacgcactcgagtgcaaacatgtgtattaatgaccattatctgaaacagagaaataggaaagcaccatcggccacccatcagcaatgaaggagctagtaaacttaacaaatcgtaaccacactatggatcacgactgccaaggtatcatgcggcatgaactcggcaacaagcggccgctcgccacccttgcagcagcatctgatgaggttggacaaacaacggctttgcagcaccccaactgccctagcctcctcctcacttcacaataaaaacaactgcatatctagtgcattatcaacgagatccaaatccaatataatgcttccaagctccatatctctactcccactcacaaaaaatgggcacataagtttggtagctctgatgcatgcatactcattccatcacacagtaaaccttgnnntaaactttcttttcttggtcctctcacgnnnnnatggttcacttcaaagtcttaaccacnnnntatcaac

SEQ ID NO: 101546 - DNA, 213 bp, Triticum aestivum
  Clone ID: PAT_TA_101546
tcgagcggccgcccgggcaggtacagtctccgttgagccagtcatctccagatcaacaacctcaatttggtcctgcagcacccactttgatgtagtctacagcaatacgcagcatgtctgaagtatttgtttgcttgtccatgttgggcacgaggtgttgcagcctccttagcagcctcttgctaatccttgacctcggccgcgaccacgcta

SEQ ID NO: 101547 - DNA, 279 bp, Triticum aestivum
  Clone ID: PAT_TA_101547
tagcgtggtcgcggccgaggtggagaagtccgatatcagggagttcgcgagggagatgctcattctctcccagatcaaccaccgtaacgtcgtcaagctgcttggttgttgtcttgacgtggaggtgccgatgttggtctacgagtatgtctcaaatggcaccctctaccacttcatccacgggaaggagcttaacaacgacacagccttggacacccgtctccgcatagccgcagagtcggcagagacattggcgtacctgcccgggcggccgctcga

SEQ ID NO: 101548 - DNA, 459 bp, Triticum aestivum
  Clone ID: PAT_TA_101548
tcgagcggccgcccgggcaggtacatacaatctggtatttctccaaccgtaatccaaacaatcgctggtccatggaggattgctcgttcgcggtcccagcaactccagtgtcgtttcgtcatgccgctaatatcacaaagtcttctcctgcggtctagaaacccgtttacttccttcgtccctgttgcatcgccaggatctggaccatgcggacgaagatgttgatgaagtcgagctcaagcgagatggactcgttgacggcgtcacggcggaagagaccacgctcagccatgcgggcgtgggctaggatcttctgggtatcgtagagtgtgaaaccgccaaagacggcgagacctccatacaaccaaagcttctcagtaagcataagcgtcctcgtagcagtaacaggcagcacgagcggcgcaagtccgctcagcgacctcggccgcgaccacgcta

SEQ ID NO: 101549 - DNA, 417 bp, Triticum aestivum
  Clone ID: PAT_TA_101549
tagcgtggtcgcggccgaggtaccgcggcttatcctccttgaggtagatgttggaactgacaacgccgttcaggtttccccaaccaacgacgattccaataatcacaccacgcttgtagactccttcgatgttgttcgatacccaggtcaaagtgttcgggatggtcgggtagattcctgccgctccgaagaagactccaacgtattggatagttgggtttccgctgataagaagcatgaggaagccgatgattccgagacatgcgacgcccatgttgagcagagcacgttgtcggaggcgatctccgaggtatccgatgatgatggtcaaagtagccgcaacggcgtatggcgggacggagaggagctggaggcgagttccctggtgtcccatccacctgcccgggcggccgctca

SEQ ID NO: 101550 - DNA, 294 bp, Triticum aestivum
  Clone ID: PAT_TA_101550
tcgagcggccgcccgggcaggtacgcatatacgacgtactttgaacgcaatgggtggcagtggcgatgctggtagcttcagtgatggttcaaacctcggacccatcacgaccgcgtccaacgcctccgacattccatccgcataccccagggactccacgctgttttacagaacttcttcggcctacactatggacgacgaaactgcgttcaataactcggctcgagctttacagctccttattctggcgccggcgtatggcatgggtcccgtacctcggccgcgaccacgcta

SEQ ID NO: 101551 - DNA, 574 bp, Triticum aestivum
  unsure (1)..(574): unsure at all n locations
  Clone ID: PAT_TA_101551
gcgtggtcgcggccgaggttgctgccattgtgggtggctcaaaggtgtcatccaagattggggttatcgaatccctgttggagaagtgtgacatccttcttttgggtggtggtacgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcaggtatattacatttttgttttcctcatgcaagcgttgaagataattatcaatagatcttttttagtcaagctgaagcagctcacaaatatgtgaaggctatatacctgatctacaatttttctgtagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtnnnnnctga

SEQ ID NO: 101552 - DNA, 388 bp, Triticum aestivum
  unsure (1)..(388): unsure at all n locations
  Clone ID: PAT_TA_101552
gcggccgcccgggcaggtacgcttcatgatgggttctttgcggcnntcgaagtnnnttgtgagttctgggaagtccatcaagacttcagccatctcatttccgcgctctccacagccaacggagacgatcnnatcactgttggagaacttggacacagcttgactaatgacagtcttgccacatccgaaagcgccaggaatgcacacagttccaccaagcacagaagggaaaagagcgtccaagacacgctgtccgacgatgaaaggatcgccagaactgagcttgtcggtcgaaggacgtggaacacggacaggccactcgtgcatcatggtgtattccgacttcttgccctcaaactccacctccngnnncttcgtgtcaacagtg

SEQ ID NO: 101553 - DNA, 386 bp, Triticum aestivum
  Clone ID: PAT_TA_101553
gcggccgcccgggcaggtacatcattctcggtgatacatttttgcggtcggcgtatgtggtgtatgacatgacgaatcatgagatctcgttggcgcagactgtctttggtgtggatgcggcggatgatcagattgtggaggtttcgtcgagtggagatggcaagcctgttgggacgggcattgcgagttttgttgctcctggaggaacgactggatcagggtcgggaactggaacaggaagtgggaatggtagtggaggctcgagtcggacaggggagaaaggcgctgcgtcgagagttggcggaggattggggatgtgtgcatttgccttggtggcatgtgttctttcgctctggtaagacagtacctcggccgcgaccacgcta

SEQ ID NO: 101554 - DNA, 397 bp, Triticum aestivum
  Clone ID: PAT_TA_101554
tcgagcggccgcccgggcaggtacacattctacactcggcagagttgccagcctttctacttcttctcctcctcttcctttggaggttctggcttgggcgtcggaagtttgaaagtctcaggcttccggtcgtgtcctggtccgacctgttcccacgcggcggtgcctccctcaaagtttctgaatgcctgtgtcaactccaggggctcaaccactatccgcttcttctcctcgtcatatctgatctcagtgtagcccgtgagagggaagtcctttcgcagtggatggccatcgaatccgtaatcggtcatgattcgttgcaaatctgggtggttgacgaagaatactccgaacaaatcgtagacctcccgctcgtacctcggccgcgaccacgcta

SEQ ID NO: 101555 - DNA, 173 bp, Triticum aestivum
  unsure (1)..(173): unsure at all n locations
  Clone ID: PAT_TA_101555
tagcgtggtcgcggccgaggtacagccacttccagctcttgtcaggcctcctggttgtctacagcgctcgcaantgcgtcggggtcatngtcaatagcgatcgtgtgagggcttaacatgggtcaaagactnngcttgcagatgtgatgacanctcnagcaatcanncnntct

SEQ ID NO: 101556 - DNA, 362 bp, Triticum aestivum
  Clone ID: PAT_TA_101556
tcgagcggccgcccgggcaggtactgattgtagtttctctattattcctgcgccgctgcggcgctggatcgcaatccattaccacgccgagcggccgaccgaaatcgacatggtcttatccgaattcccagagtcgtcgtcaaattttcccatgcaacaccccaagtccgatatatatacacagatgccaccaaagcaggacattacacatgcaaatgctgttgttcttcacacgctctctcctctctctcatccctcgaatcctttgatctacaagagggcgaagagaccagcgatcatggcgaaagcaccggcaccaacacgggtggcgtcaccggtgtacctcggccgcgaccacgcta

SEQ ID NO: 101557 - DNA, 454 bp, Triticum aestivum
  unsure (1)..(454): unsure at all n locations
  Clone ID: PAT_TA_101557
gcggccgcccgggcaggtaccgaatcaggaagcttccgaggtcgccaagtcgctcgtcgctttcctcgagcaacagttccagagtctcgattcgaacaatcgcctcaccgtcacaatcgaccacaaagccgagccttggctaggagattggacgaaccaaatcttccgcacattggaagaagcaatcatggaagtctggggtccgattgacacacatcatcctcacaatcgatcggtgtcgaagctcctgtctccgtctgcgaggcagcaagccaatggctatttcaaccatcaacccaccgctaagctctcacccgctacatcttcagtgcttgcgacaggcagtctcacgcccttgnnnnaacaatctcttccacccttgtcggaagtttccaagaagcttgagactantagcatcagctcttccccannacgccnnntnnntnnnancagt

SEQ ID NO: 101558 - DNA, 369 bp, Triticum aestivum
  Clone ID: PAT_TA_101558
tagcgtggtcgcggccgaggttgccagcgttggccacatccggcaccgcaaccttgtgcggttactcggttattgccggagaaaaggcgagcttctcttggtgtatgactacatgccaaatggcagtcttgataaatatctgcactgctatgacggcggagacaagcaggcagtgatgctgaattgggctcacaggtttcagatcatcaaaggcgttgcatctggattgctctacctccacgagaagtgggacaaagttgtcattcaccgggacgtcaaagcaagcaacatactcctcgacaaggaaatgaacgggcggctaggtgactttggcctctcgcggctgtacctgcccgggcggccgctcga

SEQ ID NO: 101559 - DNA, 188 bp, Triticum aestivum
  Clone ID: PAT_TA_101559
tagcgtggtcgcggccgaggttcctcgcccaccaccaaacgtctcttcacaaaccaactcagaactttctccatcacaaccgccagaatgggtgtcaccaaggaactcatctccgccggcgacggccagactcgtgcccagaagggcgacaccatcaccatggagtacctgcccgggcggccgctcga

SEQ ID NO: 101560 - DNA, 265 bp, Triticum aestivum
  Clone ID: PAT_TA_101560
cttaacacgttgggtggtattggtggtcgctaccttcagctcaaggaaaagcgcacagatcataaacaaacaacacttcctgatcaactagcatataccctcaggtgtccgacgcttttgcgcgcgtggttcgggctctcgtccaaagatgctcggttcatcgactgcgccagaccaatggacacttgctattctgcactcaggctgcccacaagatcctgtcctcgtccgtcgtcgcctaatacctgcccgggcggccgctcga

SEQ ID NO: 101561 - DNA, 483 bp, Triticum aestivum
  unsure (1)..(483): unsure at all n locations
  Clone ID: PAT_TA_101561
tagcgtggtcgcggccgaggtacgtttcccatcatcaagtttatgaacaagaagtcgtgagtgtggagagacatgtcctctctcgccatccactcggatgccaattttgctcgtccagaatcccccttgaaagaccgatgcgcctggcctgccttttctgttgtttcctctggtctgtccgtcccaagaatcctccttcaatcgtcatgtcaatcgtaaattttgcagctgtatctgtgccagcgcgtcctgtagctagaccttctgttttgcccgccccgagatcaactccagggagcgtagagccccaagtcctccgtcttcgtgcatcatcaatctacatatgccacttcatattcaataccctcccatcaccattgctcgtgaccttcttgaagaagctctccgagagatccaagctgccttcagcgcagctggggcaacgatcgacaatctcgccgaccnnnncgggcggccgctcga

SEQ ID NO: 101562 - DNA, 336 bp, Triticum aestivum
  unsure (1)..(336): unsure at all n locations
  Clone ID: PAT_TA_101562
tcgagcggccgcccgggcaggtacctgcatctgacnnccaccatgacgctctactacagtttggtcttcggacttctcgtcttcgagatggtcgtctttgtctccctcatcgtccccatgccattcgccgtcaagcgaaagctctttaccttcatcagcgagaacccgctcatcgcgaagctgcaatacggtctcaagatcaccttcatcttcattctgatcctcttcatcgacagtgtgaaccgcgtctaccgtgttcaggttgagctggcacaggcgaagcaccaaggcggtgcgnnnggcggcgttgccggtacctcggccgcgacnacgcta

SEQ ID NO: 101563 - DNA, 507 bp, Triticum aestivum
  Clone ID: PAT_TA_101563
tcgagcggccgcccgggcaggtactgcgagaccatgccgcaggcgatgatgcgggcgaagttgttggcgttttggatggcggcgtcgagttgctctccaccgacgttctcgtagtaaatgtcgatgccatctggtgcgagtctcttcaaagcatccattggtttctcagtcttgtagttgaaaccgccgtcgaaaccaagctgcttggtgatgaagtccagcttcttgtcgtccccaacactgccaatgaccttcaatccctcgtgcttcgcgagctggccaacgatctggccaactgcgccggaagcagcggaaatgaagatggtctcacccttcttcggttggccgatctcgtagaacgagctgtaggccgtcagaccgggcattcccaatgcaccgataaagagctttgggtcgaggttgcattggttgttgagcgggttgtagttggctgagtctgctgcctcttttgtgataacgctgtattcctcggccgcgaccacgcta

SEQ ID NO: 101564 - DNA, 389 bp, Triticum aestivum
  Clone ID: PAT_TA_101564
tagcgtggtcgcggccgaggtacgcggcggcctcggtctcgttaccgacgacgtaatcccagtatggagcaacctgatcgagctgatccttgaagaattgaggaatgaaaggcgccgagagggagaaaatgtatggcttgttcttctccgcagcttccttgccaagagcaggagcggccggcacgcacaccgtcaagtggtatccaccgacgtagtatgccttggccttctcaactacgctccagttctccttcaagtgctcaatcttgtagcagttcgctgctgcgaggtctgtgcacatgctgcggtcatgtccagtgatgatcacaccacagcgtccggtgggctgctctgtgtcgtagaggtacctgcccgggcggccgctcgaa

SEQ ID NO: 101565 - DNA, 651 bp, Triticum aestivum
  unsure (1)..(651): unsure at all n locations
  Clone ID: PAT_TA_101565
tcgagcggccgcccgggcaggttggagctctgaaatggtttaacgcgtcgaggtctggtgccaccataacacatacctcacatgaaacagattttgcacttccttggaatgataccaaattcactccgataactcctctcgaggagcaaagcgatgatcaattggtgattattcgaagcgggaaaagccaagagaggaaactgaagagaattagagcgtcagaaaagatccccggggtttgtgtaaaagcatcctcacgaaaaccaagaaaatcacgcaggtccactagtagtcaatttataactgagtggaaaaactatccaggccggcgaaggagcatagttcgggaacagtcggagttgctggtgactatcaaggaatgtgcaaaccttgagaagatcagggaaaacatggtgaaggaagggcaggaggtctgctatgataagtgggccaaagcagctggagttgatgaagcggccctgaagagtagactgcaagccggatactgctgcagagagaggttactggtgaccancgagtggcttgtcaaatacattgcaaggacatacaccggaatgnggacagctttcgaggatctactccaggctgggaaaatgggtgtccttgatggcgctgnnnnnntcnncagcc

SEQ ID NO: 101566 - DNA, 437 bp, Triticum aestivum
  Clone ID: PAT_TA_101566
gcggccgcccgggcaggtacaagaatcgttacgggttctgtctgctccttctggcaacccagggtatctctcctgcgtctctgaacgttcattcatccggagcatcagccatagtctgctccgcgaacgggttcacgaatccaggtgtgggccatcactctacttctccccaaacatctcctgatccatctccctcctcgcctgcgcaacatcacttggatgcatactactcctcctgttcgcattcctattcttcttcctcccaatcccgatcaactgcaacatctccgaccagaacccaacagcaggctccatgaacgtctcctcatacgcatcaatgatcggcttctcccacacgagatcgacttcaccgagcgggatgaccttggtcttgtggatgagtttccagataatgtacctcggccgcgaccacgcta

SEQ ID NO: 101567 - DNA, 573 bp, Triticum aestivum
  Clone ID: PAT_TA_101567
cgagcggccgcccgggcaggtgtcgcgccatcgggagccggaaagtccactgttgcaagcttactcatgcgcttctacgatcctattcaaggcagcataaccattgatgggaaggatatcagcacgatgaatgcaaagcaattgaggcggaagattggctacgttgggcaggaacctgtgctgttctcgggcaccattgctgagaatattgcatatggtcgaccacaagccagccgcagtgagattgtcgccgctgcccgtcaagctaattgtcaattcatctccgactttcccgatggcctcgaaacttttgctggcgcgcgcggcactcagttgtctggaggccagaagcaacgaattgccattgcgagagcgttactcaaagagcctgacatcctcgttctcgacgaagccacctcggctctggacgctgagagtgagacacttgtcaatcatgcattgcaaagcttgctccgaggcgataacaccaccatttccattgcacaccgtctcagcacaatccaacgcagtgacaccatcatctgcattggtacctcggccgcgaccacgcta

SEQ ID NO: 101568 - DNA, 600 bp, Triticum aestivum
  unsure (1)..(600): unsure at all n locations
  Clone ID: PAT_TA_101568
tcgagcggccgcccgggcaggtacataaatacagcgccgcctctcctcatcgctcctagtgagagtctcgactctcccagccagacccgcacaccatagcgatcgatggccaacgcgaaaataatgaaagggaacttgctttgttttccgtagaaaatgtaaaggtctggcgaacgatcgaccatcgtctccatctccatctccatctccgtcttctctcctccatctccgtcgtgcgcgccggcacattgctgtcttcctcgctatgatcaagacgcctctgcaaatgctgggtcgccgcgcgactgaagacacgtcggagcgatcgactcgtgttcaaaaagttctcgctcgaggaaatcccggaatccaaaacctggatgtagtgaccggtggatgttcagtgtaaagaatccaagaatgaataggaagtaaagacacaatctcaaaagacttttttcatttattaacaatcgatcgcgatcagaagttttgtgcaatgcccgagttcccttgttggtagttcccgggctgtngtatccgcgtattccggcgtgcgctgacgtcgcgcacaatgggcataccgccttcttggccgnn

SEQ ID NO: 101569 - DNA, 368 bp, Triticum aestivum
  unsure (1)..(368): unsure at all n locations
  Clone ID: PAT_TA_101569
tagngtgggcccggccgacgtacccaggcgcttgccacagaatgctgatggaaacaggcaccttactgatggacnnngccctcggatcttgcgctannnnncgcttgacctaaccaatgctgnnnnngccattgctatggtggacacgaaaagaccgatccccatactctgaagctccgagaagcccctctgcttacnnnnaatctacttgctatcggannncatgaatactctcgtaaatagggacccaaacaacgatgctgattacnnnnaatgacnncagggcgggcggtgggatcttaaatgatcccacttggttnnngagtgccattccttgctctatgaacattgatgaattctgagcgcat

SEQ ID NO: 101570 - DNA, 395 bp, Triticum aestivum
  unsure (1)..(395): unsure at all n locations
  Clone ID: PAT_TA_101570
tagcgtggtcgcggccgaggtacatggtagtgccgccggacatgacgatgtttccgtagagatccttgcggacatcgacatcacacttcatgatggagttgaaggtggtgacgtggataccgccggattcgagaccaaggacggaaggctggaagagagcctctggagcacggaagcgctcgttgccgatggtgatgacttgcccatcggggagttcgtaggacttctcgagggaagaggactggctggcggtttggatctcctgctcaaagtcgagggcgacgtagcagagcttctccttgatgtcacggacgatttcacgctcggcggtggtgctgaagacgtatccacgctcagccaagatcttcatgaggtagtcggtcaagtcacgannn

SEQ ID NO: 101571 - DNA, 682 bp, Triticum aestivum
  unsure (1)..(682): unsure at all n locations
  Clone ID: PAT_TA_101571
tagcgtggtcgcggccgaggtacaatggtgaagacgatggcggaatactggcagcaatcaatgggtcactatcacatgtccggtcagtcttacttttaagagggtctcttgtgcattcttttctggtgctgaagtttatccgagttctttacattatagattggagatgtgagagactagatctcaccgatattcgttggttgtttctactaagatatctgaagatttgtgtcaggaaagatttgatcatacctagtaaaattggggagttgcagcaattggagacaatagaaattaaagggcgaacatttcttccatcagatattgttactttgcctcggttgtcacatctcagttattcaaatcatgtgttgttgcctgacgaaatcggaaggttgaaatctcttcacaccttgcgaggtgttgatttcattcaaagctcggtagaaaatatcaagggccttggtgagctgacaaacttaagggaacttgagatggcttggaaatttgttaagggagcggtcaacatgcgtgttgatgccttgtgctcttccattggaaagctttcttgcagtctcaggagccttagtattnnntccaaatgccttcaagnnctatgggtcgatggctggagcagcacactaaccccacctcgtcgtcttcataagcttgatctgtatnn

SEQ ID NO: 101572 - DNA, 607 bp, Triticum aestivum
  unsure (1)..(607): unsure at all n locations
  Clone ID: PAT_TA_101572
tagcgtggtcgcggccgaggtacaataggaagtatttctatgctgagtctgttgacccatcaacaatagccaagtctgccacacgaattgctgtattaggagtctcagccttaacatcgagtaatgcaggacatatcaatgttccaccgattccacagcgaggggactctttgctggtagtggggtctccctttggcatcctgtcaccattccatttcttcaacagtatatcagttggcgctgttgcaaattgcctacctccaggcgctgccaggagctcgctgctgatggctgacatccactgtcttcccggtatggaaggtgctccagtgtttgataaaaattcttgtcttgtgggaatgttgatgaagccattaagacagagaggcagcaacatacaagttcagcttgtgattacatgggatggaatatgcactgcatggagcagaaacaaactggagcaaattgagcaagcctcaaatgaactacttgatgacaaaattgcagacagtaaaactgtggaatcatgtggcatggataaccatannnngtttgtctctaatttagnnnntgaccttaatcagtatagcattccaccttcactcnn

SEQ ID NO: 101573 - DNA, 507 bp, Triticum aestivum
  unsure (1)..(507): unsure at all n locations
  Clone ID: PAT_TA_101573
tagcgtggtcgcggccgaggtacatacacataaaccatctgttcggatcaattactttgcatactgcaggcgaggaaatgcccatgtttgctacaactcgccgtcgaagggtagcaattgatgcagagggaggtggtggctgttgatatcatgctcagtccgattgttagggatcttcgctctttcaacggtgaggatcgcatcttcttgcagggctccagttggcttctcgcgcctagtctctgtgctgggcgtgcgttgttggaactcctccggcattcgcgccaagtcgttgtggacagtgacaagagccgtcgacggatgaagcacgttccaaccacgcaccttcatcagctccagcaaatactccatccaagcaggctctgattctgatacatcctttttcgtcttagagttctcaagctgtattcgcttcgagagaaaatcgtggaatgtggcccaggcatcgccgaagaacagagtggccgcggaagaaggcgcgtnnnc

SEQ ID NO: 101574 - DNA, 637 bp, Triticum aestivum
  unsure (1)..(637): unsure at all n locations
  Clone ID: PAT_TA_101574
tcgagcggccgcccgggcaggtacaagaaaggaaaagaaaacaaagtagcagatgccctctccagagtcaagtatgctctgcaagctctcacctctacagctgccattccaacatggataacagaagtagtaaacagctacaaacaagatctcaaatgctcagaactcctggaacagctagctattgctcctaatggaaaacctccttattccctcaccagtggtgtcctgagatataaaggaaaaatcctcattggcaacgtcacggaactgagagcatctctcatcacttctttccatacatctgaattaggtggccattctggagagagagctacatatcacagactcaaaattctgttcacctggccaggcatgagacaagcagttaaaaactttgtccaacagtgcccagtatgtcaactcaacaaagcacaccatttcccttatcctggtctcctgcaacccctgcctgtcccagactttgcatggacacacatcagtatggattttgtggaaggactacctgtttctgacaacaaagacctgatactggtggtagttgataggttcactaaatatgctcatttcattggccttaaacaccccatcaatgtcacaacagtagcacaagcnn

SEQ ID NO: 101575 - DNA, 266 bp, Triticum aestivum
  unsure (1)..(266): unsure at all n locations
  Clone ID: PAT_TA_101575
tagcgtggtcgcggccgaggtacgtcaaggagttggagggaatcnngctggagcttggcatcaacctcaaggagaacatgtttccagaggcttcgtcgtaaagagcgtggtttggatatggtatagatgaggtgcgatgatgagaaggattgagacgatgtgacaaagtaacaatggggtatacaacagagcacttcagaggaggtattgtgctctgctatgctacgatagcctcgctcagcatttgtacctgcccgggcggccgc

SEQ ID NO: 101576 - DNA, 303 bp, Triticum aestivum
  Clone ID: PAT_TA_101576
tagcgtggtcgcggccgaggtggttgggtggaggatctggggtgggaaggatgaggggagtgtggcggcgattgagggggtggagaaggtgggtttcgagacaaaggtggaggtggagagtgtggatgtgggatatgtgaagattgaggctgtctggcgggagggagcggaacagagttgtgctggtggcggagatggggtgtcagacttggtcgtcgtgcagaatggcagttgagtagcgtgatgggagggcaaaatttcatgttaatgttttattgtaatcacaggcagcattcatgactg

SEQ ID NO: 101577 - DNA, 268 bp, Triticum aestivum
  Clone ID: PAT_TA_101577
tagcgtggtcgcggccgaggtaccctcagcgactacaacatccagaaggagtccactctccacttggtgctccgtctgcgtggaggacagtagatcatgcgaacaaaagcgtgattgagaagggaaaggtgttttggttttgcgattatcatcaggtttacgaatcacgagcgaaggtcagcgaaagagctgatctgaggatgcaaaggagtgcatagatgtgacgaattccagcggcctcgcgccttgagctgtcaaaaaaaaaaaa

SEQ ID NO: 101578 - DNA, 472 bp, Triticum aestivum
  Clone ID: PAT_TA_101578
tcgagcggccgcccgggcaggtaagtggttgagatcaatttatgtgaaaggagtatttttgggacgtgtgcttgcgaagggtgaatcccttatgagtcgcagttttgaagaattggaagagattactggctatctggaatgctgtggtgttagaagagactggattggtcacgtggtcagtagatgtccacagctattgaatttgtccttggatgagttagagacacgagtgcgattttatacagatatgggaatgaatgagaatgactttggcactatggtctatgattatccaaaagttcttgggttttcagcctagaagagatgaacagtaaggttcaatatctgaaagagtttggtttgagcacagaagaacttggaaaaatgctggcttataagccacagctcatggcctgcagcattgaagaaaggtggaagccacttgtgaagtacctcggccgcgaccacgcta

SEQ ID NO: 101579 - DNA, 290 bp, Triticum aestivum
  Clone ID: PAT_TA_101579
tcgagcggccgcccgggcaggtacgcacgccgatatggcactcctttgtccagcctggtggcttcaatgcccacgcaaggaactctttcgagtagttgaagcggaatgatccttccgtgtcctccacgtagtggttatacagcaaatcgtagaactcctgcagctcctctttgtcttccaagtcgataccacaccattcaaaaccatcgaccagcttctccagctctggctttgcgaccttcttgcacacagctggaggtaaaatcggtccctcggccgcgaccacgcta

SEQ ID NO: 101580 - DNA, 598 bp, Triticum aestivum
  unsure (1)..(598): unsure at all n locations
  Clone ID: PAT_TA_101580
tagcgtggtcgcggccgaggtacgcacattccgaggaggatgacggaacatatgtagaacacgcagatgcggtagaatgtgagcttgatggctcgtgggacattcttgcgaggattctgggcttctccaacagtgacaccgacgagttcagttcccaagtatgcgaacacagccgtgaccatcgattgccagacggcgaggaaacgtccccagctaccgcttcctttgtatgggttgaatgctccgggattgttccagtatctgaagcctctgacatcgccatccgcgcctccaagagcgatgatgagactgagaaggatcaaccctagaataaccaagactttgatcgaagagagccaaaattcgatctcgccaaagtatttgattccgagaacgttgatggtgacgatgaggaccnnaaaaatcgtgatccagacgcccggatttactcgatccgccggcagccagtatgatatgaccagggctcctgccgttaactgattaggcgtggtgatgatatatttgaaccagtatgtgtatccaagagagaagccaagagccgggtcgacgaaacgatcagcgtagacagcgaaacctc

SEQ ID NO: 101581 - DNA, 331 bp, Triticum aestivum
  Clone ID: PAT_TA_101581
tcgagcggccgcccgggcaggtacctgtctccaccggacgagtttgcaatgggatgctgtttgtcgtcctcgctgaatgctcgccttgaaagatcatgctcgtatgcctcagaaaaatgcagcggactccagcctgcggtccttcgtcctgtcagtttgagctcagcaccgttgcaaccgttcgtgcctctccgtcactccccttctatcccaaatgccggaaaatccaatataccgaaacaaaataaacctccgcctcttgcctccccctctcaaggcctgctcaaatgcgagtccgcccatctccggatcctcggccgcgaccacgcta

SEQ ID NO: 101582 - DNA, 578 bp, Triticum aestivum
  unsure (1)..(578): unsure at all n locations
  Clone ID: PAT_TA_101582
tagcgtggtcgcggccgaggtactgagagcgctgagcggcttgacacgcatactgcacggtctcgatgagggtgttctggttctcgcccgctggctggccgtccgtgatcgagatgatgaggagtggcttgcgcatttgaccgctgttcaacttctgaatgaggattgggtcgatgaccttcttcctcaattctgtgccgaatggagtgaggcccttgtagcgcttgctggcaagaagctgctccacctgctgctcgttcctgataccggagatctgctggggtggcaggtcctcattcatgaagcggagctcaatgccatcgtcgtcgaacagagtcgcggcaaagactgagcgctggagaatgagctggagatccttgatacgctcgccattctcctcgaaggacatggaaccactgtcgtcgacgtagatgatcacatcgtagagagccagcctgacaatatcattggcaatctccttctgaatgcgccacgcttggcacagacgatcgacctgctgggcagcacgagctgcgatctgtggcagcatttgtgctccttgtgtccctggtccgtnn

SEQ ID NO: 101583 - DNA, 357 bp, Triticum aestivum
  unsure (1)..(357): unsure at all n locations
  Clone ID: PAT_TA_101583
tagcgtggtcgcggccgaggtcacttgtctcacccaatctacctaattgattttttattcttaaacaccttaacaaagtccgtagatcaggttatttatagttccaggtgtaaacaatttttgaagctcttttttctgtttcttttctcgtagtatccagttcagtatttttcttgtatatatagctagatattaggtatgaacaattatacaatgtttttgaatcaagtctaatttatgttgctaattgttttccattgaatatccatatgtgcaaagcttgtggatttgtttgactgagaagcacctccattatattggacctccagaannnnnnnnnnngnnnnnnncnntcga

SEQ ID NO: 101584 - DNA, 291 bp, Triticum aestivum
  unsure (1)..(291): unsure at all n locations
  Clone ID: PAT_TA_101584
tcgagcggccgcccgggcaggtacagccacacagcnncaaagaccaaccaccccgcaactgtcacccagatcccactaatccacggccacgcaccagagatgacaaaacttctcggccactcatcgtgagcgaaatgcctgaccgtgactgtgcgcttctcctccagattcgtaaagaatggccggcgatactccacgaaaaagttgaagatgccatgctgatcgggaagtttgaattccgcggcgtagatgctggcgtccgcagtttggacctcggccgcgaccacgcta

SEQ ID NO: 101585 - DNA, 205 bp, Triticum aestivum
  Clone ID: PAT_TA_101585
tagcggccgcccgggcaggtacaagctcgtaacgaagggcgcgatcttgctcgcgaaggtaatgaaattatccgagtagcttgcaaatggagtcctgaactagccgcagcttgtgaagtatggaaggcgatcaaattcgagttcgagccggtagatactattgataagtagataaaactaaagataaagaagagaaggtataaat

SEQ ID NO: 101586 - DNA, 291 bp, Triticum aestivum
  Clone ID: PAT_TA_101586
tcgagcggcgcccgggcaggtaccattctccacctattttgttctttgttgaagtcaggatttgggcactgtattgagacaagtgtcaactgtccaggataacttgaaactatcgagcgaaacgtggaagttgcatttgtcgatagaaaatataagtttcttttcccagctaatgttacatcctgaaggcaccttacaacaagcttttcattcatctcaagcccaagaaaattcgagccttcccagtttctagccatttggaatagaaacacctcggccgcgaccacgcta

SEQ ID NO: 101587 - DNA, 289 bp, Triticum aestivum
  unsure (1)..(289): unsure at all n locations
  Clone ID: PAT_TA_101587
tcgagcggccgcccgggcaggtcgatgacgaaggcgacgacgatgatgatgaggacatgcccgagctaganggtgacgacagcgccgccgctgctggagcaagcgacaagaagatcgaaganntcgagtagaagtctgcttccgagttcttcaaaagtaacgaggttggggagcgtgaagananntgtcgacggctagacgaattcccacgtggagaagtgaatcttttggagtgcatagcgagcgaggctagagcttcttcccgggtacctcggccgcgaccanncta

SEQ ID NO: 101588 - DNA, 548 bp, Triticum aestivum
  unsure (1)..(548): unsure at all n locations
  Clone ID: PAT_TA_101588
tnncgtggtcgcggccgaggtggggggcgcagggggacttgtggtatagtaatgtgctgtgtggggttgtgaggggttgtttggagatgattcaaatgcaggtcgaggcgaagtttgtgagtgatgtgttgagaggagatgatacgacggagatgaggatcacgttgttacgatacatcgaggatgagatgccgccggacgatgagtgataggcaaataatgctctgcagcaacgacgaattccacggccttggagacattctcgccagctggctgcatcgattccgccgatcaaaggccacatcgatactgggttgcttcaaggcgttacggaagagctaaggagcatcacgatcatggccggcctccatcactgtccacatgagctctcagtgccgaatggagcacattagtccacgaacttcaaatgctctggaaagtcgtcgatcattcctggtgccgagtcgagaatgatttcttacctcaagcgcgatgcttcagaacatttgagcatgcgaaaacaaagtccattaacacttgtcaccnnn

SEQ ID NO: 101589 - DNA, 200 bp, Triticum aestivum
  unsure (1)..(200): unsure at all n locations
  Clone ID: PAT_TA_101589
tnncgtggtcgcggccgaggtacgagtagatcggttcccatacgcatgttccaccatccgcaggacaaacggaattgacacaatcggcctgcgcctggttggtcgggtcgtaatggcagactccgttaccgccgggggtggatgagcactcgaatgtaggtggcgggccatcggcgacacctgcccaggcggccgctcga

SEQ ID NO: 101590 - DNA, 236 bp, Triticum aestivum
  unsure (1)..(236): unsure at all n locations
  Clone ID: PAT_TA_101590
atnnngggtcgcggccgantnnnancgtttgattatattttggtttgccgcacaggcnncaagaagccaaggcactagtattgtagncaagcagagcaccgcccagcaaaattccagcaagagtgattgcccagagaaacagccctgcctttcctccaacataaacgtcaccacttggggaccattcttctggtgtatatattgggctgtacctnnnnnngcggccgatcaannnn

SEQ ID NO: 101591 - DNA, 478 bp, Triticum aestivum
  unsure (1)..(478): unsure at all n locations
  Clone ID: PAT_TA_101591
tagcgtggtcgcggccgaggtacatctgcgcgaacaaatcgcgtaaagttacgaaacctgttagctgcttctgaaggcactgagctactgaaaattacccaatcgaaggcaaggaagaagcggttacgttttcaaaggagcaagatccatgaatggggtctggtggcccttgagtcaattgatgcagaagatttcgttattgaatatgttggtgaactgattcgccgtccggtctcagacatacgtgaggatcaatatgagaagagtggaattggaagcagttacctttttcgcttggacgatgattatgtggttgatgctactaagcgtggtggtttagcaagatttatcaaccattcgtgtgagccgaattgttatacaaaagtaattactgttgagggccacaagaagattttcatttacgcaaagaggcgtatatatgctggcgaagaattgacgtacctnnnnnngcggccgc

SEQ ID NO: 101592 - DNA, 234 bp, Triticum aestivum
  unsure (1)..(234): unsure at all n locations
  Clone ID: PAT_TA_101592
tcgagcggccgcccgggcaggtactctcaaaagggacaggagaagttgaatgaggtggcnnnggagggggagaagaaggcgaatgaagtcaagggtcaagcggaagagaagagttcgcaggcgaagaagcaggctgagagcgtgaaggaggatgtcaaggccaaggcgcagaagtagaggagtgttgatgcttgaatgagggcgtcgcgttgtacctcggccgcgaccacgcta

SEQ ID NO: 101593 - DNA, 161 bp, Triticum aestivum
  unsure (1)..(161): unsure at all n locations
  Clone ID: PAT_TA_101593
tagcgtggtcgcggccgaggtacgcctctcatgtcgcgctttcttgagctgatcnnagatcgatgataaggctaccctgtatacatatcaccacatccgacctgttcttctcccagattgaccgcctcaaatttgcagtacctgcccgggcggccgctcga

SEQ ID NO: 101594 - DNA, 441 bp, Triticum aestivum
  unsure (1)..(441): unsure at all n locations
  Clone ID: PAT_TA_101594
tagcgtggtcgcggccgaggtacatgaagatccattcgagtcgtggccgcacaatccctttgcgagtcgtcgtctagccaggcagccagtaatttgttccgctcagaccaaagagacctgctcttttccttgctaagcgcacttgaaagcaaactgtatagtcgtgcagaaacatgatgtcgtgatggattcgtcgatgtatgcaatgtcattcatgtcccaaatgccgctgcagtgcccggtcatcgttgtccacctccctcaatccgagctcgtgtgaaatcggggtttcttccagttttgagagagtcctcgagtcttggtgtaatatgccactttgtatcgaccatgtcgtctccgtgggcgctgtggtcattgacgccatagatgaggtgaggacgtgcggatcgcgggtcccgtgcgagtagtagagttgtcgnc

SEQ ID NO: 101595 - DNA, 357 bp, Triticum aestivum
  unsure (1)..(357): unsure at all n locations
  Clone ID: PAT_TA_101595
tcgagcggccgcccgggcaggtcccgggcaaagactaccaccatcaactcaccctcatcttggatgttctcggcacaccgacnntggaggattactatggcatcaaatctcgtcgcgcgagagagtatattagaagtctacctttcaagaagaagattccgtggaaagccatgttccccaagacgtccgatttggccttggatttgctggagaaactactcgcgttcaatcctactaagagaatcacggtggaggaggcactcaagcatccatacctcgagccgtaccctgccaccgccatgcccatcgccgccaccgccacgcacatgctccagtacctcggccgcgaccacgcta

SEQ ID NO: 101596 - DNA, 173 bp, Triticum aestivum
  unsure (1)..(173): unsure at all n locations
  Clone ID: PAT_TA_101596
gttgtcgctcaaacgcgatgtgaatttttggaggtattttcagagacatctcagtcgtctagcatctgcgtagtcctcctaccattgcaagccacctttgtcccaccgtccgtttcgccatgatttgggaatgaattcacgcgctcaagtacctgnnncnggcggccgctcga

SEQ ID NO: 101597 - DNA, 203 bp, Triticum aestivum
  Clone ID: PAT_TA_101597
tagcgtggtcgcggccgaggtctgtatttggcaagactacagaaacaccggaaggcagaggaattcaaggtgttgattgccacatcccgttggatcgcttctagctccccgatctggatatggatagctagctacaagcagtacaacatcaacgatcagatattaatcatacatccagagtacctgcccgggcggccgctcga

SEQ ID NO: 101598 - DNA, 340 bp, Triticum aestivum
  unsure (1)..(340): unsure at all n locations
  Clone ID: PAT_TA_101598
tagcgtggtcgcggccgaggtacatcaagagggtatcaagccgtggtattggcccttaaggtattcccgacatgctcagctctcttgcggaaatcgttcacagagacaggtctctggtcattccttcttcctccccaaatatccacacactctgcaatcttcctcaggctacttcgccgcgctctcgaccttcgccttggcctgtgccgccaaatccttcgcttgatccacgattccctccgccttgttctccgccacttgcagtccctctttcgccttgttctcgagcgccttctcacgtccacccatgtacctnnnnnnnnnnnnnnngctcgaatca

SEQ ID NO: 101599 - DNA, 389 bp, Triticum aestivum
  Clone ID: PAT_TA_101599
ttcgagcggccgcccgggcaggtacagtcggctcgattgccttgttgagtagccctctggccactcagctctgctcatggttggcttgaggaagatgaagcattcgaacgcagaacatcgttgatgcggtgtggtccagtgaatcacaagcttgtggtccgccacgtcgggaatggagttcatggagtcacgaggtgttttgtaatttttgcttccttttaataataccagagcagggcaggcgagcgttaatatggagttcggtggatcaggatggcgttcgtggaggtccctttcaacacgatggacggtgctttacaacgatatgcaagggtttgagtcacagtggagcgacgaagtggtctggtacctcggccgcgaccacgcta

SEQ ID NO: 101600 - DNA, 283 bp, Triticum aestivum
  unsure (1)..(283): unsure at all n locations
  Clone ID: PAT_TA_101600
tggttgggtggaggatctggggtgggaaggatgatgggagtgtggcggcgattgagggggtggagaaggtgggtttcgagacannngtggaggtggagagtgtggatgtgggatatgtgaagattgaggctgtctggcgggagggagcggannnnntttgnnctggtggcggnnntggggtgtcagacttggtcgtcgtgcacaatggcagctgnntagcgtgatgggagggcnnnatnnnnngttaatgttttattgtaatcacaggcnnnattcatgactg

SEQ ID NO: 101601 - DNA, 382 bp, Triticum aestivum
  Clone ID: PAT_TA_101601
tagcgtggtcgcggccgaggtacacgacgtcctccacgtaggcttcaaggccacgcttctcggcgtatgggacggcgagggcaccggcggcaagggccgcgacagcaaagacggaacgcatcttggaattgatgtttgtttgcttgagatcacagatcttcgaaaggcggctgtcctgtgggatagcggttgtttgttgttgtgttgttgagaagcgacagtcgacgaggaagaaggacccggaaggttgaatgagcgtggtggcagactggctgcggtaaagagtgagatgggcccggtgacggtgacggtgaggtcgtgagagaggtgtcttgtcgtggtgcgaggaaggacaggtcagatcacctgcccgggcggccgc

SEQ ID NO: 101602 - DNA, 416 bp, Triticum aestivum
  unsure (1)..(416): unsure at all n locations
  Clone ID: PAT_TA_101602
ttcgagcggccgcccgggcaggtacctcttcgtcttggacgcactgaacttttgcttctggcnnnacaaggacttgacctatgacaatttggcttctggactcaagttagcattagagaaagataagtcagcacttgatgcagatcgtctgaagaattatactggaccgcaacttcgagaactgctgaattggccacgcccactgccaattgaggaggaaagagtccgccttcttcatgaggttggtctggagcttgaaagaagctttggcagcgaggctgctaatcttgtgaagtctgctggaaactctgctgcatctctgattgaactgattacccgtcactttcctgggtttcgtgaccactcactttataagggacaccaggttttcctgtacctcggccgcgaccacgcta

SEQ ID NO: 101603 - DNA, 669 bp, Triticum aestivum
  unsure (1)..(669): unsure at all n locations
  Clone ID: PAT_TA_101603
tagcgtggtcgcggccgaggtctcaggtccttcacctcgaannnaaggcgaaactgtctgaaagaatatctttgcctcaaccgtcaatacaaacatagcctacaacttacgtcccgcaaaagtcccaagacagacgatcacctgcaccgaatcacctttgctctcggagaatccgcctctttcaagcagcacgctgtctacgcaccaactaagaacatccaacaatcttcaatatgcccacctacgagcttgatacacattcactgctttgccgcctcgcgcaaggggatgatgccgaagccctctcggagcttctgaagttcgaagagagaagcggcctgcgagattccgccaagtcatacccggcttcgaatcaagactcaagcgggagaagcactcgagaagcggatggacctgatgtgaccgactttacgcattaccgaagggactcgggtgtcagtggcatgcctcaatcagatgccgggagatcgagataacgatatgatgattgatggtggacttgggctggaagcttgctggcgccagggtctaggatatgtgggagggaatgcctcgttcgtcaattnnnnnnaggacttcgaccggtggatgagagggactaaaggtatgttaaacaggagagacgatagtctttggacgccgggtacn

SEQ ID NO: 101604 - DNA, 437 bp, Triticum aestivum
  Clone ID: PAT_TA_101604
ttcgagcggccgcccgggcaggtcagatatttcccccgagccgaggtcaagtcgtctcgtcccgtgctgcgtttctcctcctcccccgctcctcccccattcgccgtccgcggttctctccaccgaacaagctcacacatcaagacaataaatagagcctcgtttgtttggggccaatcaaaccaaacaacaagttcatgtctgatctcgacgtccaggttccaactgcttttgatccgtttgctgaggcaaatgctgaggactccggcgctggtgctggatcaaagaactatgtgcatgtgcgtgtccagcagcgcaacggaagaaagagtctgactactgttcagggcttgaagaaagattacagctacaacaagattctcaaggatctcaaaaaggaattctgctgtaatggtacctcggccgcgaccacgcta

SEQ ID NO: 101605 - DNA, 398 bp, Triticum aestivum
  unsure (1)..(398): unsure at all n locations
  Clone ID: PAT_TA_101605
tagcgtggtcgcggccgaggtacatggtctcgctcatggacagaacgaacttgtcnnacgcttcaatcgccggtatgcgacaagaactcggcatgatcaaatcggcggccactccaaacggtaacccaatggcatactccatcgttactctggtctttttcactacctatgtcttctttcaacctcccgcgaccgtcctcaccaagaagattggtccacgaaactttctggctaccatctgcttcctatggggatgcactatgatcgcgatgggctttgtaaagacgtggcagcaactcgcagcactgagggtgattttgggcatatttgaggcaggcttcttccctggctgcgtctacttgctcagcacttggtaccnnnnnnnnnnnnnngctcga

SEQ ID NO: 101606 - DNA, 551 bp, Triticum aestivum
  unsure (1)..(551): unsure at all n locations
  Clone ID: PAT_TA_101606
tnncgtggtcgcggccgaggtggaggagaaaaaatagaagagcaagtggatcnncaaatggtgcaatgtgatcaagtcagtaagccagaagtgggacctcctattgctgaatctggaataaaagagcaggatgaacagcaaacggtgcaagtcaataagccagaagtggcacctcttatttctgaatctggaataaaagagcaggatgaacagcaaacggtgcaagtggataagccagaagtggcacctcctatttctgaatctggaataaaagagcaggatgaacagaaaacggtgcaacatgatcaggtgaataagccagaattggcacctcctattgctgaatctggaataaaagggctggatgagcagcaaacggtgcaacatgatcaggtcaataagtcagaaatggcacctattcctgaaccnngaataaaaggtcaggatgaacagcaaatggtgcaacatgatcaggtcgataagccagaaatggcacctcctattgctgaaaccggaataaaagagcaggaggaacagcaaactgtacctnn

SEQ ID NO: 101607 - DNA, 199 bp, Triticum aestivum
  unsure (1)..(199): unsure at all n locations
  Clone ID: PAT_TA_101607
ttcgagcggccgcccgggcaggtaccttcgaacatgctcatcacgcgccttcgcccgtccatctacatgtcatcgtgcatggcactttgggcnntcgtctccggcctcactgccctcgcaaacgacttcaagggcctcttcctgactcgattcttccttggacttgttgaagctccgtacctcggccgcgaccacgcta

SEQ ID NO: 101608 - DNA, 682 bp, Triticum aestivum
  Clone ID: PAT_TA_101608
tcgagcggccgcccgggcaggtacaatggtaagtcatgagtctgctgtcttcatacaatgaggaaatatttgtttgctgcttattcattaatatcttattactgaaaggattgccagtgtattagcgattcaagttccagctttggcagtgtagtctggaatgtttgaaattaacaagatgaactcctatcaactactccaaggttttctgaaacagtaagaacatttgctaacagaaacttagttcaaaacttagcaaacttagttaagagaaacttagttaccaagttgctatgcagtcaatatgcacctatgttaaatattcatatacttgttgacaaggtttctgtatactgctccttacccttttatgtgatatttactttcgtggtcagttacaaattgatcaaggtaaatgtatgtatatctatggtggatgatctgtgtcattcttttacaggtcataataattcaagttcatattctggaaggatgttgaccaacgagccttgtaataatgaggtcagagatgctgcaatgcataatcagttatctgcttgtaacacaaggaattatactgcaacatttcctccagtgcaggcaaactcgaatgatgtgccgcttgatgaaacatctgcttttaactccggaactcgtgcttcaacatatgttccattgcggg

SEQ ID NO: 101609 - DNA, 182 bp, Triticum aestivum
  unsure (1)..(182): unsure at all n locations
  Clone ID: PAT_TA_101609
tcgagcggccgcccgggcaggtcccgaagctgaggcggcnaacgctcccaaggctcngacttacagcacttacgggtcgtacaaagagaccaagcaacctgagaactacggcaaatactccaactacggagactataaaaatgctgctctgccccacgagtacctcggccgcgaccacgcta

SEQ ID NO: 101610 - DNA, 446 bp, Triticum aestivum
  unsure (1)..(446): unsure at all n locations
  Clone ID: PAT_TA_101610
tcgagcggccgcccgggcaggtctcgacgcgtccaggagcaggatcanggagctgcagcggcagatacagatggaggccaaccagacaaaaggccnnctgatgctgctgaagcaacaggtgatggggctcagggccaaggaggaggaggtggccaagaaggacgccgagatcgaacagaagctcaagaagctcaagaacctggaggtggaggtgcttgagctgaggaggaagaacaaggagctgctgtatgagaagagggatctcatggtgaagctggatgctgcacaaggaaaaataacagagagtgatgtagttgcccatgcaagagaggagatcaacaacctgagacatacaaacgaggacctgacaaagcaagtggaaggcctacaaatgaacagattcagtgaagtagaagagctggtgtacctcggccgcgaccacgcta

SEQ ID NO: 101611 - DNA, 362 bp, Triticum aestivum
  unsure (1)..(362): unsure at all n locations
  Clone ID: PAT_TA_101611
tagcgtggtcgcggccgaggtannncttgtcacccccaaactgatggacnnactgaagnnnncaatagaacattgtctacgatgcttaggggtgttttaaagaataataagaaaatgtgggaggaatgtttacctcatattgaatttgcttataatcgttcattgcattctactactaaaatgtgcccttttgaaattatgtatggtttcctacctcgtgcacctattgatttattgcctcttccatcttcggagaaggttaaatttgatgctaagcacatgttgaattgatcttaaaaatgcagtnnnctaatgaaaacattgagcgtatgaatgctaaatataaacttgctggagatgac

SEQ ID NO: 101612 - DNA, 358 bp, Triticum aestivum
  unsure (1)..(358): unsure at all n locations
  Clone ID: PAT_TA_101612
nnncgtggtcgcggccgaggtactangacagccgctactggacaatgtggaagctgcctatgttcgggtgcaccgacgccacacaggtgatcaacgaggtggaggaggtcaagaaganancgataaagttatatattggttccttctgttgctttatttagcttctattggttgtgtttctcacgaaaactaacttatgttgagtttctattggttatgtctctgtccaggttgagttgagcatatgtatgcctacctcagtcgatgaggtttctctaccttcgctctatgacgcagattgatttcttttctaggcttttactgtatcatgtggctgtacctgcnnnnnncnnnnngc

SEQ ID NO: 101613 - DNA, 445 bp, Triticum aestivum
  unsure (1)..(445): unsure at all n locations
  Clone ID: PAT_TA_101613
tagcgtggtcgcggccgaggtactnnagctatcacaggaacttacaaactgaaatttactgcagcgagcaatacacaatctatatgtataacatagagacaccgctgaatcacaaaagtttcacaaattgtaagctgaatattgaacagttttacacatctcaagaacactgaaagcacattcaacacagatgcagaggttcagagctgaacagtagcagaggttcagaagagaaacagcagcaacggaggtgagaagcagagtgcagagcaggaacgtgggaaagaagagcagcagcagttttaagaggaggagcagcagaggagtggggaaagggactnncagcaggcgaaggagcagcaggttgaggcgctagaaaaggggagcagtagcaaggggagaagaaaggcagcagcacagacctnnnnnngggnnnngcnnncga

SEQ ID NO: 101614 - DNA, 353 bp, Triticum aestivum
  Clone ID: PAT_TA_101614
tcgagcggccgcccgggcaggtacggctggtggcatcacagccgatggagagcttctcagtgactaaatcgccatcggtgacagtcaacccgaggatagcgaggaggttggccaagtcgtagccaacgttgtacacgttctgctgagcgtcgacgagctcgttgtaggtgacgacaccatcatgagcgaggaagttgtggtttgctgcggcgttaaggccagggcatggtccacgaatgtcctttgagtagtctggcgcaacgaactgatgggccttgacggaccagtgacctttgagcagccaaagatgacagtcgagaagctgctagagtacctcggccgcgaccacgcta

SEQ ID NO: 101615 - DNA, 454 bp, Triticum aestivum
  unsure (1)..(454): unsure at all n locations
  Clone ID: PAT_TA_101615
tagcgtggtcgcggccgaggtacaggagcttccggcatccnnactatcnnngagatcgggcccaaggtgaagcacctcaccgtctaccagcgaactcccaacatgtgcctaccaatgaaccnncacccattggatcaagaagaggaagagaggaagaagaaggatggaacatacgagaagctcatcaacgacacccgcagcacgtttgctggcttcacctacgactttgccgagaagaacacattcgacgataccccagagcagagagagcagttctatgaaaagctatggcaagagggcggcttccgatactggctcagcacctacaaggacatgctcttcgacaacgaggcnnatatggaggcctacaagttctggaggaaaaaggtcctcgctcgcgtcaaggatgaggagaagcagaagatccttgcaccagnnntcccacctcacccat

SEQ ID NO: 101616 - DNA, 178 bp, Triticum aestivum
  unsure (1)..(178): unsure at all n locations
  Clone ID: PAT_TA_101616
tnncgtggtcgcggccgaggtacatctccctttgaggggtattaggatgcgatgtggcccttacctctgcaaatagaacaaaactttgatcttggcttgctggcattatcataacctagcttttctcttatgttcattggcctgcttcgatccctcacctgcccgggcggccgctcga

SEQ ID NO: 101617 - DNA, 328 bp, Triticum aestivum
  unsure (1)..(328): unsure at all n locations
  Clone ID: PAT_TA_101617
tnncgtggtcgcggccgaggtacgacgcgtggagttaaaggtctccttgagcacagcaggcatgggatacgagctttcggaaccaccgcgagtcgnncaagggaaggaaacatggactttgtcatgtctcaaaactcggtggacgacaatgggcgatcataccaccagtcaagactcagcggctggaagggttcgcagcgggcgtagagtcgtttgtgctggtgtggggatatactggacgatctagatcgagaggcgaatttggcaagatttttgaagacattgaccatacatcgaagtatgtacctnnnnnnnnnnnnncgctcga

SEQ ID NO: 101618 - DNA, 598 bp, Triticum aestivum
  unsure (1)..(598): unsure at all n locations
  Clone ID: PAT_TA_101618
ttcgagcggccgcccgggcaggtacatttgctgacnnnaacatccagaaggagtccacccttcacctggtgctccgccttcgtggtggtatgcagatcttcgtcaagaccctgacgggcaagaccatcacactggaggtggagtcctcggacaccatcgacaacgtgaaggcaaagatccaggacaaggagggcatccccccggaccagcagcgcctcatctttgctggcaagcagcttgaggatggtggcactcttgctgactacaacatccagaaggagtccacccttcacctggtgctccgccttcgtggtggtatgcagatcttcgtcaagaccctgacaggcaagaccatcatgttggaggtggagtccttggacaccatcgacaacgtgaaggcgaagatccaggacacagagggcatccccctagaccagcagcatctcatctttgctggtaagcagcctgaggatggtcgcactctggcggactacaacatccagaaggagtctacccttcacttggtgcttgagttaattgcagggaagtataacacttgcagttgtaacggatcagtacctcggccgcgaccacgcta

SEQ ID NO: 101619 - DNA, 640 bp, Triticum aestivum
  Clone ID: PAT_TA_101619
gcgtggtcgcggccgaggtgggaagaatggtgctagaggattttgatattgagaaatctgctggtggggctggaaagctagtcatcaagactttcataacgtatgtcacaaatcatacactggaaattcaattctattgggcaggaagagggacaacaggcattccaaaaagaggattctacggccctctaatatctgcaatatcagtaactccaaacttccaaattcctttggctgttgaacctccccgtagtggcagtggcacaaatacttccaggacatctaaagctttgctgattggagccccaattattgcgatattcactgctcttgttgttggcatctactggattaagcgacgacggaagaacttgatgaatcaagatctccgggcacttgacctccaaattggctcatttaccttgagacaaatcaaagcagcaactaggaactttgatccagccaacaagattggcgaaggtggttttggttcagtttacaagggttcgttgtccgatggcaccattattgctgtcaaacagctatcatcaaagtccaagcaagggaatcgtgaatttgtgaatgagataggcatgatatctgcactccagcatccaaaccttgtcaggctgtatggctg

SEQ ID NO: 101620 - DNA, 653 bp, Triticum aestivum
  unsure (1)..(653): unsure at all n locations
  Clone ID: PAT_TA_101620
tagcgtggtcgcggccgaggtaccaactgaagatttcaagagctcggttaattttgcagcacttgagcggtatagatggatcattcaaagagttcatgagcatgggatgaaagtaatgcttaccctatttcatcactcacttccaccttgggctggggaatatggtggatggaggatggaaaaaactgctaattatttcatggattttgtaaggcttgttgttgaccgtgtgtcagatttagtggactactgggtgattttcaatgagccacatgtgtttgtgatgctaacttattgtgctggagcttggcctggtggggatcctaatgcaattgaagtagcaacatctgctttaccaactggtgtatataatcaagctttgcattggatggctgttgcacatgctgaagcttatgactacattcattcagaaagcaagaatgcaatgatgccaatagttggtgtttcacatcatgtatcgtttacacggccatatggtctatttgatgttgcggctgtcacaatagctaactcaatgaccctattccctttcatcgatagcatctgtgataagctggattttattggcatcaattactatggtcaggaggtaatatcaggacctggcctaaagcacgtggaaaatgatgann

SEQ ID NO: 101621 - DNA, 655 bp, Triticum aestivum
  unsure (1)..(655): unsure at all n locations
  Clone ID: PAT_TA_101621
tagcgtggtcgcggccgaggtacttatgatgagttagcatccaagttgaagtccatggacnnnaaggaaatctctccatttctcagctatatagacaatcttgtcaggacagttgagataccagtcaacatgaggaagcgtctgagtgagctccgcaaggagctatttacgctccaaagtttggctattcagctactggtatttgtcacttctaataagctgccggccccaccctcagttactctcctggaagaagcaaatgctaaatatgctaatctccctctccctgttctggtgagctctgaagttaaagctcctcgtttttacagatcgtttggcaaggattcgaaggatcttctctataagcactactgctctgatgctcccatgacttcgaagacgatcgtcaatttcgacatgaggggaaggtcgtccttatctatgctgttgtctactgaccagcaggtaatgttcaagtgcaactatgctgataatttgccaaaaaatctgatggctacgatgctctttggggtgccaagcagtaactccaaggtcaagcttcagtatttattcccatatggtggtctgaacggtagcttcaattttggtgaagaaagtgtgttaaaggttgcattttctggtggttatgatcgnn

SEQ ID NO: 101622 - DNA, 531 bp, Triticum aestivum
  unsure (1)..(531): unsure at all n locations
  Clone ID: PAT_TA_101622
cgagtggagaaagactttgttcagatgtctcaagtattcgggtttcaccctctcctgatagttctagtatgttcatacacagcatcatactcagagtgctgcctcttctcgcaactcaaactgttcgtcctcaaaagggacaacgccaaaggcaaacaatggaactggcgatgcgaaccgaccaccgcccaacttttcccatcttgcgatcttcatctgtatttccccgggagtttcaacccataccttctcccctttgtcgctatgtcgccgtaaaagagaaacaaatgctacacccaaaaatgtctgctgacctccacccaaaacttttgtgtgggccagcacggcctgtgtccatcaacaggaccagagcttcgctccgtagttcaggaggaggattcttccatgtgatggcaacagctacgcactgatgcaagaagcaaaaacaggcaggggcttgattttcgcnnnaaaaaaagcgcatgagtatgcaaaccnnagcaggtcgtatcagtcgtgaaaaggagtcnn

SEQ ID NO: 101623 - DNA, 266 bp, Triticum aestivum
  unsure (1)..(266): unsure at all n locations
  Clone ID: PAT_TA_101623
tagcgtggtcgcggccgaggttgcttggcctcctagcctgcgtctggtgggggctgctgtgacagtgccgcgcccgatcagagagtgcgagccccaacctgaggtctagatccatgcacgtcgatattttttttgctcactttcttttaaaaggtgttggtctttttggtttgatctgttctcattatttcagctcattatatacctatgtagtaattgctagggacatgtaaagtgaagtgtacctnnnnnnngcggccgctcga

SEQ ID NO: 101624 - DNA, 677 bp, Triticum aestivum
  unsure (1)..(677): unsure at all n locations
  Clone ID: PAT_TA_101624
cgtggtcgcggccgaggtacatcgtgaccnnaggcttttgacatcacaagactggaatttacatccagactgagctccctaagagatttgtttaccatatactcctatgttatatttatgctgatgtagttgattctaatgttgctttattaaaagcctagaactgatttcatagatatgttatctttttgttccaaatccaatctcacatgtttcttttttgctcctgactcagaccttatgtattctttattacgagcatatacttggtgattcagaattataaacttaaagtggccatcgatgattttagtgtttatctcggctgttgaatagtaaatcctacattttcccaggattttgaattatttcctttaataagatcttggtctgatgtgtagtgacccttctcgatactgacagcgctgcttccttccaatgaagacgatgttattgttcaagatattgtatctctctgcatcgttgaagatagaaaaatcttaagcggtggtttgcacttaatataccagtaaaatggagatctaaacacaccaaaatgggatggggctggaaaagccatgtgccttagaaatcnaaggaagtgaaaagaagatgacatcgttgaagnntggagggaatgtcaatgcggcttcatgagcatctatcgatgtgctann

SEQ ID NO: 101625 - DNA, 274 bp, Triticum aestivum
  Clone ID: PAT_TA_101625
tcgagcggccgcccgggcaggtacaccggggcggtggaagtgccgtagcttggaggaggacccgcaggagcggagctggatgcagcaccgtaaccctgaggtggtccttgcggagcgtaggcagcggcagccatgccggcgaagccgagagcgacaacgttggagatcatcttgacggatggggatgaggttgggtgagtttgaaggtgatgggtggtattaaagagcgtaaatggtgggatgagtaaacgacacctcggccgcgaccacgcta

SEQ ID NO: 101626 - DNA, 697 bp, Triticum aestivum
  unsure (1)..(697): unsure at all n locations
  Clone ID: PAT_TA_101626
tggccgcccgggcaggtaccttagctgatcgatttacatgctggattacaaaaaaagaaaaatcatgaactagctctccaatttcaacaagataggagccacaatcgactcgagaactgtggcgagtgttccagcagtccacctccattatcgcatgctttgtatccatgaagtttggcaaagatgacaccatcacacagcgcctttgcttcagcgatgagaggatcactgatacccacatatggtttgcgccatgcacccataagagcagcactagatcgagccactccacctgcaccggctctattagaatcaaatgatatagcaccatctgtgttgattttaactaggccggcttagcttgctttatagtgggagttcaagaagcgcaagggcttctctggtcatgcgcatgcagttagtcggatcggatcctccctcctcatgcttcagtttgttcctagagtgccaaatagaccacatgatcgtaataatcttgggcctatctccatccgaaaagtgggggtcacagagaatatctcttgcccatgaatctggatgtggtcgggggagtcgaagatcaaaccagagaagcgcctcgttccaaaaacgttctgcatatgtctagatccangaagacggaagnncgccatggctggctcgtgtggtatgtttccctcgctcggagtcggcttcn

SEQ ID NO: 101627 - DNA, 330 bp, Triticum aestivum
  unsure (1)..(330): unsure at all n locations
  Clone ID: PAT_TA_101627
tcgagcggccccccggcnnggtggttatgcccacctatacnnntcccattttcaaaaanatggcnnccnnaagnnngaaggnnntcttaacacctgcttcaagcacttcattctggttaccaaccaatttgggctgattgaccaaaaagaactggctccccttcaagaacccatcgaatcaatcattggtccctactgaaaaagaaacactgaagctgaacccaactaaacatgggtggtacccaatcctttacaggaatgggcaagccaatgggctatctgcgccaataatttactggcaccaatcttcttggtccctttctttgacct

SEQ ID NO: 101628 - DNA, 283 bp, Triticum aestivum
  unsure (1)..(283): unsure at all n locations
  Clone ID: PAT_TA_101628
ngcggccgcccgggcaggtaccatctacaacaggtcnnncacacgacacggacgccggcaaacgggttggatgacacagtnagctatgcatattgcccatactggaacaaggatcatgcattnnnaattcccaaactcagaacccatgttggcagtttccnccaaccaaagtgccaattaactgagcaaaacaaacccagccaggcgctgtgaacaagacaatangtnngggcctcttctaccctcaaaactacaatcaaactctgcagcgtttctggattnn

SEQ ID NO: 101629 - DNA, 487 bp, Triticum aestivum
  Clone ID: PAT_TA_101629
ttcgagcggccgcccgggcaggtaacccactggttcctggccgttgcgcctgggatctagagtcttttctgcgcattttgtccacactctgaacacccgagattaatttcccagttggtcacccatcctcaaattgctccaagcaaagcacgcttaactttgaggttcctttcgaatgggcccttggaaaagaaggtgcacctttggtgatatgagtataccaaatcgggatgtcacagtatgtgaatgagctgcaacatttttgggcagatctagatcagtgtgatcctgttgaccttccacatgcagagtccatggagattgccaggaattgggttgagcgcaggcgtgtgatgcaatttctcaaaggtctagatcaaggttttgagagcagcacaatgtgctgcttcatcaacgatgcttttgtccttgatgaggccattgttgcgatgtcccaagaagaggtacctcggccgcgaccacgcta

SEQ ID NO: 101630 - DNA, 211 bp, Triticum aestivum
  Clone ID: PAT_TA_101630
tcgagcggccgcccgggcaggtacttctccggtcgtgaggactaccgccctgaggatctgattgtgcacaagggtgactacgcgacgaaggcgtatggtcagaggaatttgattgataagaagtagagggtggggatgtattgagagggtgtatgggatagtgaaatagtgagagcgaatggaattttgtgatacctctaaaaaaaaaaaa

SEQ ID NO: 101631 - DNA, 508 bp, Triticum aestivum
  Clone ID: PAT_TA_101631
tcgagcggccgcccgggcaggtccaaaagcctcgacaccaggctgcacgaaacaagtctgcttctttcgcgactcttacgatgctctgacgtcgacaggtctctcgatctacggtctcagcacagactcgccgaaatcgaacacaactttcaagacgaagcagaaccttccatatccacttctttgcgatccttcagcgaccttgatcaaggcgatcggtctgaaaaaagcgccaagcggaaccacccgtggagttttcgtaattgataagagtgggaaagtgttggctgctgagccaggtggtccggagccgaccatgcaggttgtcaagaagctggtcgatgcaagtggagcgtcaggtggtgcagagaagaaggaagataaggagaaggcggagacggctgctgaggttgcggatactgcggagaaggtcgatgctgcttgaggtgtcttgtgcgatacatgcttgagctcaataacctcaagtacctcggccgcgaccacgcta

SEQ ID NO: 101632 - DNA, 510 bp, Triticum aestivum
  unsure (1)..(510): unsure at all n locations
  Clone ID: PAT_TA_101632
tagcgtggtcgcggccgaggtacggctcctgctcctctgcgatccccagcattgcgtgaagtgatggcaacacagcgctctaatgaagacgcatacggatcgaatcgtgtagcatcctatggctcagagcagagaatggggtctgagcaccgtctccgaaggagttttcaagagcagcaattcgcgcctgccacgccagaggaagaagagagcgaattgacggatttccacccaatatcgaggccaccacaacgggtcacgtctctgggcagattcagcagccgccgagcagcaacagagaagcaggcacagggccaagggtattcaccgggtcttcaacagagaagacatgttatcgtggaataggcttccatggacagtatactatttgcaaacgtattgggacggcgttgatgtccacgaaggatgcattttcatggtttgcaagacatgacagtctgcttttcttcgggaagagatggagttgtgattttgatgagaaccgtanna

SEQ ID NO: 101633 - DNA, 397 bp, Triticum aestivum
  unsure (1)..(397): unsure at all n locations
  Clone ID: PAT_TA_101633
tagcgtggtcgcggccgaggtacctggttgggatgcaaatagaagtgtctttgatgaatactcacacaactatggcaggcaagaactgggccggaataatgatcctaattttcatcagcagtcagagtcggaggtgccatttccatctcatactcttgtcaagccctcgttaatgcaactcccagctgaaaatcaaagtcaaagctctgaagtcaaaacagttgggaccaatgctgaaaaaactgatgcacatgctccaaaaaatagatctgacgcaactcctgggccttctaatgtaaaagtggattcttggttttgctctaactactttaagaggcttgatatttcgacaagccttgcttcaccagagctgnnctnnnnngnnnnnngcnntnna

SEQ ID NO: 101634 - DNA, 302 bp, Triticum aestivum
  Clone ID: PAT_TA_101634
tcgagcggccgcccgggcaggtactaagactgacagtagaatggggggtaggtatgaagaggcaagatcttagctatggaggagttgtatacacaagagatttacgagttcaggcccttctcggaggaagtaacagccctacgtctcggagcctggaggcggtcgactgtattataagtgtatgagttacaggggtgcgaacccttctaccagtggaggggggtggcttatatagtgtctgccaggaccccagccagcccacgcagcagagggtttaaagtacctcggccgcgaccacgcta

SEQ ID NO: 101635 - DNA, 430 bp, Triticum aestivum
  unsure (1)..(430): unsure at all n locations
  Clone ID: PAT_TA_101635
agctgcgtcgtcacgatacaccgcgttcgactggattattctctcgcgttgaanntcgtcgttataagctcatcttctatttacctctcttaacagtctgtcccgattgagcttgagcctccgttccaccgttccgtgtcatacatcattgcgtcttgacttcaccatcgtcctcgacggtgacgtggtcgttggtttgaagggtgtgaacggtatcggcggggaactcggcagtgaatgccttcacgagcgtgaactcctcaacgattttgcctccttgttcctggacctgcttcttggcttgctcgagctgactcgcgtcggctcccttcttcagcgtgacgttgattctgggcatgttggagattgctttggatgtatttgttnnngtctttttgcaaacagtgtgacctcggccgcgaccacgcta

SEQ ID NO: 101636 - DNA, 353 bp, Triticum aestivum
  Clone ID: PAT_TA_101636
tgagcggccgcccgggcagggagacaagggatgctcggcccgaacaagagatacaacacagctagacctaccaagcctaaaccaagagcggtcaagtcgaaccagcgagaataccaacatcgtgaaaaccaaaaccggggacaccgcgagcaagcaagatagcgccttcaagaaggaatacgatgccgagacgccatcgccatccggtctagaggacctagggtttcccctgagctcgaggaggggctcacccgaggaccttgacaacgtcttcaagaagataacgacatccgcagacgccgccgctgccagcaccggcaagccgggcagggacctcggccgcgaccacgcta

SEQ ID NO: 101637 - DNA, 346 bp, Triticum aestivum
  unsure (1)..(346): unsure at all n locations
  Clone ID: PAT_TA_101637
gggtaagnaatacaaaattattcccttactggtaaccctactgaaaaatattggagcgcggtggataacaacccccaacccattgggaagtttatggaaaaaaactggccggggggataaatattatgcctattgagagcaacaaaccccttttttgaaaaaagctcctttaaaaaaaagaaaaagaacttgggggttaccaaaatacacaccatgcccccccatgaaaggggccttggcaaaaacaaaaattgggataactggacaaaattggaaaaaattactttcactgggaagcataaaaatttggaatttggagggttncggtttaaaaagaaaattatca

SEQ ID NO: 101638 - DNA, 428 bp, Triticum aestivum
  Clone ID: PAT_TA_101638
tcgagcggccgcccgggcaggtacaagcaggttgatcccatcgtcgaggctgtcatcaaggagatgaagaccaacttaggcgtgaagaagctgggatctgtaggttattgtttcggtgccaaatacgttgctcgcttcatgactggcggcaagggcattgatgtcggattcatggcacatccgtcgtttgtcgaggaggatgaaatcaaggcgctaaccggacctctgtccatcgccgctgcggaaaccgaccagatcttcccggccgagaagcgaagagccactgaggatattcttaagggtatgaagatcccataccagatttctctgtacgaggagtgacgacggcagctgcctttacaccttttaagcatgccaatttaatatctgatatttttatcctttgtacctcggccgcgaccacgcta

SEQ ID NO: 101639 - DNA, 461 bp, Triticum aestivum
  Clone ID: PAT_TA_101639
tcgagcggccgcccgggcaggtcttgtttatgaatatatggcgaacaatagccttgacaagttcctcttcggtgagagacgtggaacacttaactggaagcaacgatttaacatcattgttggcatggctcgtggccttgcgtatcttcatgaagagttccatgtgtgtatcatacaccgtgatattaaatctagcaatgttcttcttgatgatgactttcagcctaagattgctgattttggtttggcaaggctcctacctgatgatcatagccatctcagcactaaatttgcaggaacactgggttacactgctcccgagtatgcaatccatgggcagctatcagagaaggttgacacatatagctttggtatagtcattttggaaattataagtggtcggaaaatcaatgatacaagggtcgaggctgaaacacagtacctcggccgcgaccacgcta

SEQ ID NO: 101640 - DNA, 193 bp, Triticum aestivum
  Clone ID: PAT_TA_101640
tagcgtggtcgcggccgaggtacagcatcttggtgccggctggtgtggagaacattgtgatggtgtctgttgtggagtggagtgtggagtggagtttgttcgagcgctgctctggtgtgaagatggatgtcacaacatcaacgatcagatattaatcatacatccagagtacctgcccgggcggcccgctcga

SEQ ID NO: 101641 - DNA, 239 bp, Triticum aestivum
  unsure (1)..(239): unsure at all n locations
  Clone ID: PAT_TA_101641
tcgagcggccgcccgggcaggtaccttgcggagctgctcgcggagcgccacaagctgaacccgtccgtcccgnnnctccctcatatcnnacggctgctgaatcaagaaattttacgtgttaccacactattggacaacgccttccttgtaaaccaaagnngctttgaacatgggannccactagcatggggaggattatcttcaaatggagcngcaactgatatgaatggatggacatc

SEQ ID NO: 101642 - DNA, 261 bp, Triticum aestivum
  Clone ID: PAT_TA_101642
tcgagcggccgcccgggcaggtacggctccagcgacggtgcggacaagttcacccgtgacttcgtctctgcatgggagaaggttatgaacgctgaccgatttgacctcaaggctggtcaggtcagcagcgcgaagttgtagatgatatcacgttttgagacgatgggaaggaatggtttgggtttgtgaatatggttgtagctagagcattacagttttcgggttgttgaatgaacattgtcatacttcaaaaaaaaaaaa

SEQ ID NO: 101643 - DNA, 190 bp, Triticum aestivum
  unsure (1)..(190): unsure at all n locations
  Clone ID: PAT_TA_101643
tagcgtggtcgcggccgaggtaccaagtgctaggcnntgcatgcgcctagtgatgcaataccttgtaaaggatgtgctactcccggatttccaatcaagttttttgagccttactagcagggatgaagaatttgggcagcatatcctgtcatgcccttctgtagcgacgacnatancaggactttctggg

SEQ ID NO: 101644 - DNA, 509 bp, Triticum aestivum
  unsure (1)..(509): unsure at all n locations
  Clone ID: PAT_TA_101644
tagcgtggtcgcggccgaggtactggttcagaaatcagaataactactatctgggtgcaacttgctggcagggcagttaagttagatatcttatttttcattgtatcttgcttattacttttacaaattagtgttcaagacaatcttctgttgttgcattccagcaagttagcttacagccgaagatagtttatccaatccaaatgatgtaggtcgaacaaaacttatggctggggtaaaaatatttgtggtgatcagcatcttcctctcgcttcactgttaagatgtcgacgcggcgctacgtaatgaatgatttatactactaccatgttttttatgttaggtctgagaaactagagaattcatgcctctttgccatgccaagagtattctagggatttcttatgaatatactgtatgtaatatgggatggctattttcattaagagatcaatttttatgcaggtttatctacactcttctcaacctgggaatcatcatgtgctnnn

SEQ ID NO: 101645 - DNA, 331 bp, Triticum aestivum
  unsure (1)..(331): unsure at all n locations
  Clone ID: PAT_TA_101645
tagcgtggtcgcggccgaggtacgtcgagaagcgcaaggctggtgctgtccgtgtcgatggtgcctacgtccagttcctccgcaacaagggcccgatcgcgcagaacatccgccgcttcccttctgctttcaacgcataaatgtgatgtgttgaggatttgaggttgaaatctggtattgagagtggcaggaaggcgagatgattgaacgattcgggatgattttgttcgaggataaaatcatcacaggcgtactcctcaattaatatagcgacacgggcgaatcatctccgacctgcgcagtgccgtacnnnnnnnnnnnnnnngctcga

SEQ ID NO: 101646 - DNA, 338 bp, Triticum aestivum
  unsure (1)..(338): unsure at all n locations
  Clone ID: PAT_TA_101646
tagcgtggtcgcggccgaggtacgccaacggcgaggagaaggacccatacaacaagaagttcttccataacttcccggttgaggtcaacgacgacttccacgtcgcccagatggagcccgtgctccacttcaccatgggtggtatcgagatcaacgaccaggctcaggtcctgaacaaccagggcaagccattcgatggtctgttcatctgcggtgagttggctggtggtgttcacggtgccaaccgtctcggtggttcttctctcctcggatgtgtcgtctacggccgtgttgcaggtgccagctcaagcaanaccnnnnnnngnnnnnncgctcga

SEQ ID NO: 101647 - DNA, 537 bp, Triticum aestivum
  unsure (1)..(537): unsure at all n locations
  Clone ID: PAT_TA_101647
tcgagcggccgcccgggcaggtacttctcagcctcctggacnnncttctcaatctcctccttgctcagcctgcccttgtcgttggtgatggtgatcttgttcttctgcccagtcgtcttgtcctcggcagacacgttcaggataccattggcatcaatgtcaaagcagacagtgatctggggaactcccctgggtgcaggagggatgccggacagctcgaacttgccaaggaggttgttgtcgcgggtcctggtcctctcaccctcataaacctggataaggacaccaggctggttgtcagagtaggtggagaagacctgctccttcttggtggggatggtggtgttccttggaatcaaaacggtcatgacacctccagcagtctccagaccaagagaaagaggtgtgacatcaagcagcaggaggtcctggaccttctcgttaccctctccactcaagatggcagcctggactgcagcaccataggcaacagcctcatcagggttgatgttcttgacctcggccgcgaccacgcta

SEQ ID NO: 101648 - DNA, 382 bp, Triticum aestivum
  Clone ID: PAT_TA_101648
ttcgagcggccgcccgggcaggtaccaaatggtcttacccaccgcaacatctccatcgagtatcgcgcggatgtcgcactcatgtgtggatccttcggtttcgagctgaatccagatgaactctccgctgaagagacagccgccatcccaggcatcatggaacaatggcgtcaactcaatcctctcgtcatcgcaggtgacttttaccgcctcgccatcccgcaggaatccaactggccggcggttcaattcgtcagcaaggacaagtccgagagtgcggtgttcatgtatcaacaacaagcgaaaattaagccgtctccgccaccagtcagattggtgggactagatgctggggcgaggtacctcggccgcgaccacgcta

SEQ ID NO: 101649 - DNA, 192 bp, Triticum aestivum
  Clone ID: PAT_TA_101649
tcgagcggccgcccgggcaggtacaaaaaattacacgccgatgaacacgtctccacaggaaaggaagcagggcatgtcaacagcagccaccaagctggtcatcatcatcggcggtgctggcgaccagcctttggtcgaaaatgacctacacagatgtctgaaacaaattgtacctcggccgcgaccacgcta

SEQ ID NO: 101650 - DNA, 365 bp, Triticum aestivum
  Clone ID: PAT_TA_101650
ttcgagcggccgcccgggcaggtgttgggttgtgaacacctcagctatacttgatgtgtagaggcatattcttgctataatctgttctgactgccatgcttcttagtttccaatatattagtccaacaaatgatgttgcttcctaattttttgtaattacaatatgctctgatagacattttatatgtttctctaattctttggtctggtttcgagctcagatgtatttaaggttgtcttgcaacaatgcatctttagggacctgaagttcattattaagagaagctgatgcttgtgcggattgttgaatcaatcaagatggaatgcaatagagtctcattggtacctcggccgcgaccacgcta

SEQ ID NO: 101651 - DNA, 436 bp, Triticum aestivum
  unsure (1)..(436): unsure at all n locations
  Clone ID: PAT_TA_101651
tagcgtggtcgcggccgaggtactccatcatcctgtgcgacttacacatgccgaacaaagacggataccagacgtgcaaggagatccgcaagtgggagaggaagaataagcaccctcacctcccaatcatcgcgctgtcggcgaatgtattgggcgatgtgtatcaaaagtgtgtcgacgcggggttcaatagttacatgacgaaaccggtggacttcaaggagttgagtcaggtgttgatgagttttatggacccgaaggatccgagcaagccgcatgagttgatgcgactgaagagggagaagtcaactattggggccgcgcgctgagtggaaaaggcgagagtgcgggaggttgctttgcatgcactttgtgcgccgaatcgcatttttattttggagtttgagcgggattgagaagcgactttctgtgtgnn

SEQ ID NO: 101652 - DNA, 566 bp, Triticum aestivum
  Clone ID: PAT_TA_101652
ttcgagcggccgcccgggcaggtaccaactgactgggcgtgtccgtgctcctgtgttcttggggctacgataacctccttgtgtgcccctcagcattaatgagataatgttggtccaatgcttataatttaatcagtggttcctactgaatttttaaaaggtctatgcctaatttggtgttgcttattcaattagcttcacatgttgcaactaatcatgtttgatgtgctgccatgctctcagtattatcttgttcagtgctataatttttttttgagcttttgttcagtgctataattggggccatgctcttagtattgtgttgtttttacgcactcaacacctactgcaggtgatagactccgtaaaaaaaatctaaggttaatatttatgctcaaggagaaatggagaaatctacacatcttggtgatgctgagatgtgtaggctttctaatattgcttattcctgattgatatgtcatcaaatcaagtaaaaacgagtatgctttgatccatgccacatccgttgaatgtaacctcttggtacctcggccgcgaccacgcta

SEQ ID NO: 101653 - DNA, 441 bp, Triticum aestivum
  Clone ID: PAT_TA_101653
tcgagcggccgcccgggcaggtacagaagcactcaagaagagttgctacgactggagtttcacggatctttacattttacttcatcgacaatcgcttgttcggacgacctttttgataccccagtcggagcacaggatttttaatggtggacggtgggaggcatgattttgtgatttgcgcatggagttcatggcgcattgagaggagattgccggcccggtggtcgaaggcaagttgcacattttgcacatatgtatggataccacgaaagggacatgtctgcgagaatgagatggtcacggccatgtcggctggcaatacatcggagaaaggaggatgtcgatatccatcgcaatcagcgcgatgcctgtcgtctgtgtatcagaccccagcaagaacgatgtcatacaacccaaccgcttcgtcacaaaaaaaaaaaa

SEQ ID NO: 101654 - DNA, 667 bp, Triticum aestivum
  unsure (1)..(667): unsure at all n locations
  Clone ID: PAT_TA_101654
tagcgtggtcgcggccgaggtctcaaggaagtttggatccaggttagagggttgcttccaagatggtgtgagtggtctgtcttagatcaatgcacctcagcttttgggctgttgattgacttggactggcaggggatgtttcagtctctgtttgaatgtgttagagttaaagttcagtgtagggaccccaccaaaatccctactgaaagagtgttttgcattggaggaaaaacatttaaggtgaggatgactgtggaagttcctatagtggatctagttagcaaggatgctgaggttaatggaggaggtgatgataatagagaggatccaagaaaccagaaagatatggatactgatggcttggcaaatcagaataacactgctaatgattctgcttctggaagtaatggagggtccttatctggaagaggaaatggcagtggagctgatttccagaaaaggtctattgatgcaattgaatgagatggctggggaactggaagatctggaaattgctacccaagaggttggtgtgatgacccaggctgatagcctccctgaggatattatgcccacttttcactctcttggtgataatgaggtgcttcaagagaaaaaggtgcctgnnnaacagggggttcagaaaaggacgaagcagaagaactgn

SEQ ID NO: 101655 - DNA, 336 bp, Triticum aestivum
  unsure (1)..(336): unsure at all n locations
  Clone ID: PAT_TA_101655
gcgtggtcgcggccgaggtacctgtccctggaggtgctctactccaccctcatggacctcatcaacctgtgtggcaccggcgcccacccgctgagatgatgatagaagtgtgcagcagctctggattcgtttcttactgtgcgcactgactgactgatgctggatctggagttgtcagaggcataagccgttgaattaaggaaagcacgttggactagttggtagcatcagtgagaaggttccaaaatttagacctcttttttggcaccctaaggatagtttgtgggcaaatcaatctgttacaagttggtaccnnnnnnnnnnnnngccnntcga

SEQ ID NO: 101656 - DNA, 362 bp, Triticum aestivum
  unsure (1)..(362): unsure at all n locations
  Clone ID: PAT_TA_101656
tagcgtggtcgcggccgaggtacgctgcgttttggggtcagggcaagccgattggtaagaacgagacggtgattgaggcattgagtggtgtattgggggagcaagaggcgaagaacattgtagaggtggagatcaagaaggatgagaccaagaagaagatgaatgcgaatacacagctggcttgggaggcgggagcatttgggctgccgtggtttgtggcgacgaacgagaagggcgagaaggagggtttctggggggtggatcatttgggacagatgctgaactttttggaggtgaagcgcgtgcaagaaggtgggtggaaggccatgttgtgagggtccnnnnnnngnnnnnnngctcga

SEQ ID NO: 101657 - DNA, 273 bp, Triticum aestivum
  unsure (1)..(273): unsure at all n locations
  Clone ID: PAT_TA_101657
tagcgtggtcgcggccgaggtacttcttcgattatttatggatgcagcttatctcaacttgtgaacctagacctgaacatcaacactaaaatgttattcctgaagaccttgtctacaaacatcaatctatctattaaattaaaatcaaagttcaaaaaagcgctaggcgctaattatgcgtttgggcacctacttgcgcttttctagcttaggcgtgattaggcgaaattagacgcaattaggcgttagtacctnncnnnnnngnccgctcga

SEQ ID NO: 101658 - DNA, 419 bp, Triticum aestivum
  Clone ID: PAT_TA_101658
tcgagcggccgcccgggcaggtaccaaaggccatgtgcctgtgcaccgacacgtcaatagtcggcaccgacttctacatcatgtctttcctcgacggccgcatcttcgccgatccgtcatttccggatgtcagtcccaaagaccgcaatgctatgtggaagagtgcggtcgagacattggcgaagttccacaggacatctccaaagagcgtgggcatggaggactttggtcggccgaataatttctacaaccgtcagttgaagacctttgcgacgttgagtgtcgctcaggcaaagaccaaggacattgaatcaggtaagccagtgggcatgattccacactacgatcaaatggtggagttcttcggcgataagaactcacagccagtcgaccgcggtacctcggccgcgaccacgcta

SEQ ID NO: 101659 - DNA, 549 bp, Triticum aestivum
  Clone ID: PAT_TA_101659
tagcgtggtcgcggccgaggtgaaatgtgaagaagactatgttgttgccagaaatgcagaggaggcacttgcgaaagctcaggaaaaatatggaaaatcagttgaaatatatcaggatcctgatgttctcgatacttggttctcaagtgctttatggcctttcagcacacttggttggccagatgtgtccagggaagattttaagcatttttatcctgcaacagtccttgagaccggccatgacattttatttttctgggttgcacggatggttatgatgggaattgagtttacaggaacagtaccccgtggttccaaccacacgtgttgtttgtgggttggtgccatgctcatacagctttgcaagcccaaaatcgcctagccgtccattcatttccttgtcaagaagcacattgcttgtcttgacgtctcggtggatgacgactttctcccacctctcgtgcaggtagtgtaatccacaagcgacccctttgatgacttgcaatctttgagcccagtccaaagtgagaccatctccatctccttggc

SEQ ID NO: 101660 - DNA, 162 bp, Triticum aestivum
  unsure (1)..(162): unsure at all n locations
  Clone ID: PAT_TA_101660
agcggccgcccgggcaggtacgatgatgtttcctggttccannnnnctctccaccaaatttcttagcacccatatacttggggttagagtcgagntcatttttcgttgacccatcnnncttttttgtggcccaacgcctaaacaccaagctcattcctacnn

SEQ ID NO: 101661 - DNA, 470 bp, Triticum aestivum
  Clone ID: PAT_TA_101661
tcgagcggccgcccgggcaggtacacggactcaaggcggccttttgtggtggtgaaaatggtgtggatcgaacaaatcaaaaagtccgcgtatgatccatggaaattgggcagtctcagaatggcaggcagagtctctggatatctgaacgccgtattcaacttctctgcgaagagcccttctgcgctgagtgtttgcaatacgaagacgcacattcgcaggataccatgcttcgaagggtcgtctttggagtccagtgcatagtagagaatcaagacgacgtagtcgagagcgcagccggtctccaccagataccgacggaatcgtcgattgcattgcaggagctcccaaaggagactgatcatttcaggcgcccaaggcagggctttgtccttgccaaggttgtatatgaagttccctattgatgagacgggttgcgcaaggacggtacctcggccgcgaccacgcta

SEQ ID NO: 101662 - DNA, 371 bp, Triticum aestivum
  Clone ID: PAT_TA_101662
tcgagcggccgcccgggcaggtactgcccgtgctcgcgagattgacatgatgcaagagctcacgaagcaggttgagggccacaccatctgcgctttgggtgaggctttcgcatggcccatccaaggtctaatccgtcacttccgccctgagttggaggcgaggatacagggcaacacaaaggctgcgggtggtgaggcgttggctggtggatggcagcacgatgctgtcaagaagggcatgttgatctcgcctggacagtagaggtgagaggaatggattgggatgtggttacagactacgtggtttctgcttattgccagtctatatggtctgcgtcgcaacgtgatgtacctcggccgcgaccacgcta

SEQ ID NO: 101663 - DNA, 471 bp, Triticum aestivum
  Clone ID: PAT_TA_101663
tcgagcggccgcccgggcaggtgacatgcaacacgacatcaccgacatgacttcgactcgatagcatcacctcccatcatggtctccttctggcccttcggcggcggcaatggcaccgacgcagcctccttcgaaaaggtcctctcccagctctccacaaagatcaacaagacgagcgcccagaacgacagataccgccagaaacaacgccgctacaaagccttgtggactctctactccacattcgcatacatcctcatcgcggcgatcctcaccctcgtcacaggctgggagaactggaacatcctcgaatacagcgccatcgccggtgcacccgtcctgatctacagcatacgaacgggactcgatgcatattacaattaccgactggcgaactcgcagaatcatctcaatgacttgacaaagcaaagagaggcggcgattgagaagttgaaggccgcgaccacgcta

SEQ ID NO: 101664 - DNA, 605 bp, Triticum aestivum
  unsure (1)..(605): unsure at all n locations
  Clone ID: PAT_TA_101664
ttcgagcggccgcccgggcaggtacgcatccgtgtggcacacgccggtgtaggcgacctttatccggacctcatgagcgcgcggtgggagcacctcgacatcctcaataacgaggtctttgccggcttcccaggccacggcggctttgcaggtgatggtctggccttctgtggacatggctgaatatgccgccaagaaaactacaaagccacagccagcgaaggccaagaagaattgggctcagttctgcttcttctccaggcccaacaaaagaaagcatgaccggatagacactgacatgatcgattgaaggtaggtgaagaattccagaaatgttttctttgtttactgcatcagaaatgtttctattgtgatggacccggtgcttccccttcgacaatggttcgatggttcgggtttctgttgtagaatcaagatgattagattacatcagatttattcataagaataattggatacttcagagatggttactctcatttgcgctagggataagcattctttggcacacatcttccttgtcatgctgtggcggagaaaggactaaccctctgaatatccgtacctcggccgcgnnnacgcta

SEQ ID NO: 101665 - DNA, 437 bp, Triticum aestivum; identical to SEQ ID NO: 101604
  Clone ID: PAT_TA_101665

SEQ ID NO: 101666 - DNA, 523 bp, Triticum aestivum
  Clone ID: PAT_TA_101666
tcgagcggccgcccgggcaggtacgccaggatggctgtttcgaatatgccgattgagattgtctttcctcgtggaagctggcccgaagcctctggactttttgcagcccgcaactggacagtagtatgcgttgttcgacgacatcgcttccggatgctgagatgcgcagtggcgacgaacgtcggcctcgaggtctgatgcatatacgcaatgcggacatttggctgggcgggtgtgctttttgatgtgtttgttgaggagatatgctttatcgaaagtcttctggcagtgttcgcagcgaaatgcgcctggtgctggagcggtctgttgcgatgtggaagattctcgaggtggtggtggatttggtgtttgatgggtgaaagagcgattaggctgttgcagaggaactgcaactggaacaaacgacggctgactgcgctcatgaactgcgttctcctgtccagcagaagaagagttgcttggtctcgattcccacggccacacctcggccgcgaccacgcta

SEQ ID NO: 101667 - DNA, 396 bp, Triticum aestivum
  unsure (1)..(396): unsure at all n locations
  Clone ID: PAT_TA_101667
tagcgtggtcgcggccgaggtacggttccatgatcaacggactgggatctctgatcggaaatttgggagccattccttgctgcatcatctgtccaaacccctacaagcccgtggcacagggtaacgtcggtctcgtcaccaaattcggtcgtttcgcacgcgcagtcgatcctggccttgtcaagatcaacccgctctccgagaacctcatccaagtagacgtcaagattcagattgtcgaggtgccgcgtcaagtatgcatgacgaaggacaatgtcaaccttacgctcacctccgtcatctactaccacatcacatccccacataaggccgcctttggaatctccgaccttcgcaccgccttggttgagcgtacctnnnnnnnnnnnngctcga

SEQ ID NO: 101668 - DNA, 415 bp, Triticum aestivum
  Clone ID: PAT_TA_101668
tcgagcggccgcccgggcaggtaccggagcgggagacgatgccgatgcggccgcgcttgtggataaagcctggcatgattccgattttgcattgaccaggagcgataattccggggcagttgggcccgaccagtcttgtcttgttctgtgtcttgagcatatcggtaatgcgaaccatgtcgtgttgtgggattccctccgtaatgcagacaacgagaggcatctctgccttcaaagcctcctcaataccagcggcagcaagcggcggtgggacgaagatggcggatgcatcggcgccagtagctttcctggcctcctccacattggcaaaaactggcttgcccagatgttcgctgccggccttttttggattcgtgcctccaacgacgttggtacctcggccgcgaccacgcta

SEQ ID NO: 101669 - DNA, 586 bp, Triticum aestivum
  unsure (1)..(586): unsure at all n locations
  Clone ID: PAT_TA_101669
ttcgagcggccgcccgggcaggtacatggtaaaatggatttaggatgatttgtttcctgatagagtgatagtcatgggattatccttggtatgctacactgttactgttatgtcaacatgaagcctatgatttttgtgttgttctgtgcagatgagttatgtagatctaagcttcctcaacaagaggagcaaccagcagcagcctgacactcaattaattaagtgagcgaaatgcaccaaagagattaaaatatgtcgtcgcggtgaaggccaaggaaaactggatgtgtgcttagagctggaggaatcgctgttttggtggacttttgagcaagaagctgttggggctgttaggtctcctgacgattcggtgttgaagtatggcgagttcgatgtgagggtgctttttgctcccaaggacttcactgtggttggctgaaacctgaagggaagtgacgaagatgcccccattctataatatccgtgatttatctggtcggaatttgaattttctttgtaagccctcatttggcagaacagcagacatttgaggacttactctgtggtttaaatatgttcaactgnn

SEQ ID NO: 101670 - DNA, 378 bp, Triticum aestivum
  Clone ID: PAT_TA_101670
cgagcggccgcccgggcaggtacagcgcaaccatcctggctcattcttgggattttccccataagctcgcgaatccgcctcgtcacaacgtggattcctgctgcttaccagcaagaagtcactcccagctgctcgttctttgcagccgacagatattggaaattctcctaaacatgttcgcagaatccttttagcgacgaccgaatctgttctgcttcttctctgcaggcttcaagatctggaaggagcacagtagagactcatccacgctcatcatcgcaccagcattgtcaaactcgccgcagtagtttggtgcagagaacaacgtgacgagctgtcgcttggagaagaattcgtacctcggccgcgaccacgcta

SEQ ID NO: 101671 - DNA, 610 bp, Triticum aestivum
  unsure (1)..(610): unsure at all n locations
  Clone ID: PAT_TA_101671
tagcgtggtcgcggccgaggtcaaagtcgcatttgtcgcatcacaacagctagcgtcgcggagatggtattcagcagaaactgaagcgaagaaggaagaggttctgaaggagcaggcagaggcacaaggtgctcaagagacacccaagaaagatgcagcgaaggaggatccagtgcagaaggagttggaggctaagaagcaagagaatgttgatctgactgaccgtctcaaacgacaaattgccgaatatcgcaacctccaagagcagaccaagcgtgaggtccaagcagcgcgagacttttccctgcaacgattcgcaaaggacctactagagagcatcgacaacctggatcgtgtacttgaggccgttcccaaggagaaactcacctccgagaatcaggacttggtcaacctgcacagtggactcaagatgaccgagcgcatcctgatgggcactctgaagaagcatggaatggagaagtttgatcctagcgttgaaggcgacaagttcgatcccaacaagcacgaggcgacgttcatgacaccacaaccggacaagcctgacaacactgtattccattgtcaatcgaaaggctttctctataacgna

SEQ ID NO: 101672 - DNA, 176 bp, Triticum aestivum
  unsure (1)..(176): unsure at all n locations
  Clone ID: PAT_TA_101672
cgggcaggtaccccggcacnagatactacggaggaaacgaatacattgatatggccgagncgctgtnnnataaacgtgcnngnnnaggctcttcannnnnnnncccagagcaagtggggagtgaatgtgcatacctctatcggggtcacctgccaacttccatgtgtacactgctc

SEQ ID NO: 101673 - DNA, 517 bp, Triticum aestivum
  Clone ID: PAT_TA_101673
tcgagcggccgcccgggcaggtactacttttatgagcaccttcgttctataccaacgagttgaagttagtcccctagcatgccatatactattcctttaagggtcgatcacattgtggaggaacctacgcccagaaatcgatcatgacacatgaacctgcaacatgtatcccgcctacgcgaattcactggtcactcgaactccccaatgtccttctggccggcaaggatccttgagatctggaggccccggctgaaggcttggttgaagagcaaccgtgtctggaactctgagacgaagggaaaccacgacaagaagccgatgggaaggaagaggacaagacccatgatgttgtcgtatgccctccctagctccatgatggagtcccacagcgtagtcttcttaatcagtggagcgcatgcctgcccaatcagaagaatacaccaaccagttggtaggaacccaagaatactagcgaagacatctgaaatcgtgaacctcggccgcgaccacgcta

SEQ ID NO: 101674 - DNA, 356 bp, Triticum aestivum
  unsure (1)..(356): unsure at all n locations
  Clone ID: PAT_TA_101674
tagcgtggtcgcggccgaggtacgtaattgccgcagcatcttgaannnagcgatgacgaagaagagagcattcgtgcatcctctgcagcaagctggacaatacgagaaaaagtatcttgaacgtatcaatccttttcgtcgtgacctttatcttctccttggtccatacctcaacccaatactataaccaccaaagcaatcccgacaacnnnaccactatggccacccacatacctcgccgcaacgtcacaaccggcaccatccccgaactcatctccctctcctatgcccatcccaaactcaagacccacaactcctaccacgccagtgacttcgcactcaagcgtaagtaccnn

SEQ ID NO: 101675 - DNA, 177 bp, Triticum aestivum
  Clone ID: PAT_TA_101675
ttcgagcggccgcccgggcaggtacgctccaattcaaagtgtcaaacacaaatcgacaatcttacattgtggggatcaattatatgtcaaattccatgacatatatcaactaatcgccaccagtggaatgggttagaacgagtgtatttcttcttcttgttggccgcgaccacgcta

SEQ ID NO: 101676 - DNA, 675 bp, Triticum aestivum
  unsure (1)..(675): unsure at all n locations
  Clone ID: PAT_TA_101676
tagcgtggtcgcggccgaggtgcttccagcaggaggagaacctatatggcattattcttcctaaagggattggtaaattgaagacccttcatgcactaggtgctgttgatgtttcttggagaaatggaaatgccattgtaaaagagttccgagagcttactgagctacgtaaccttaaagtgggtggtgtgagctgcagaaacatcaatgagttatggtctgccattgctggctatagtcaacttaaatctctgtcagttcaaataggtggcccggacaagaggaatgcgttagatggctgtttgggtgagggtttgttaccatcaaacagccttgagagcctccatctgtggggtaagcttgtcaatgtaacaaagtggatcaatacgcttcagaatctcaccaagttggtgctaaggcggagcagattggagcaagatgacgccatacaagcccttggatttctaccgaatcttgtagttctacgactgaggatggattcgttcgatgggacacagctccatgtcaagagctcatctttcccgagtctcatagtgctggagttgcaatggttagncnacctccagtcggcgctgtttgaaaaagacgcaatgcctaagctcgagttgctacaaattggtcagtgcaaaaatctgaatggattctccgggctgn

SEQ ID NO: 101677 - DNA, 476 bp, Triticum aestivum
  unsure (1)..(476): unsure at all n locations
  Clone ID: PAT_TA_101677
tagcgtggtcgcggccgaggtactcacctactttgaagcatgcatctggcaaggtgttcattggtgtggaactctggcatctggcaaggtgttcattggggcagggatcgatggagatgaagttgtgcatgacgaagtccctgaagtggcccctagatactgctgaatgaccgggtcacaggcggcatccatccaatctcgccgttccgccgacttagcaggaacactatccgctcgtgctccacccttcaccggaactccgtctgaccatgtttcgcctgagaagcgacaataaaacttctcttgagaatctagcacataaggcaattgtatgccgggttttagacatagacaatgcagctgggaatatcaatcgtatgttgggtttcagacataggcaatgcagctacctagaattgacttgaagttgtttctttggctgaggtaggatgtaggaaacatgcagcttgaaccan

SEQ ID NO: 101678 - DNA, 366 bp, Triticum aestivum
  unsure (1)..(366): unsure at all n locations
  Clone ID: PAT_TA_101678
tagcgtggtcgcggccgaggtaccacctcggcgacgaaccgcggccgttgacggacgactgggagtggtattcgtatgtgctcaagcagatgatgggaccgatgcaattggacttgggcacgtttaatcacgcggatgagatcatacgggatgagttgggactggtcgagtgtgagaagaagacgctccgcatcccgaggggtccggatgaggacatggaggaggggaagagggacgctgcgagggtgattcgcaatgggtggagggatgtgttggttaggatggtggagacggcgacgaaggatgtggaggaggagaaggcgagggaggtgagggagcaagtacctnnnnnnggcggccgctcga

SEQ ID NO: 101679 - DNA, 278 bp, Triticum aestivum
  Clone ID: PAT_TA_101679
cgagcggccgcccgggcaggtatatatattctaggattaaatcagtcataactgacaataatataaaggatacccttagaaaaactttagaagtttatatacaaatatatgatacatgtagcaaaaataattggaacagggttagcaacaacatgtttaatgggtgtaggaatgagtatacttttaacattagcttactatcagtatattggattccctgttatggagttagcttctgatataagccctactagtgtacctcggccgcgaccacgcta

SEQ ID NO: 101680 - DNA, 339 bp, Triticum aestivum
  Clone ID: PAT_TA_101680
ttcgagcggccgcccgggcaggtacggcggtggaaatggaggtggctatggtcgtggagagcaggaagagcatggtcgtcgcggtggcgatgagatgccgggctctttcggtggcagcgatgagactggcggatacggcaaccagggagacgatcagagtggaggatatggcggtggatatgagaggcgctattgagccgggtgtcgtggctctgtgtcggtgacagctttggtcgctcatgtgaacgagcgatccgacatcaacttcagcgttaggtaacgatagatcaaaagttttgcggcgtatgcgagctgggtgttcttacgaaaaaaaaaaaa

SEQ ID NO: 101681 - DNA, 652 bp, Triticum aestivum
  unsure (1)..(652): unsure at all n locations
  Clone ID: PAT_TA_101681
tagcgtggtcgcggccgaggtaccaacacaagccctagatggcctcttgcacaaccaatgaggttgcttggacacaatggagagattaacacgatacagggaaacttgaactggatgcgatcaagggaagccacaatacagtctcctgtatggcgaggccgtgagaatgaactacgcccatttggtgaccctaaagcatccgattcagcaaaccttgacagtgctgctgaattactgttaagaagtggtagaagtcctgctgaagctatgatgatgctcgtccccgaggcatacaagaaccatccgacattatcagtaaaatatccagaggtaattgacttctatgaatactacaaaggtcaaatggaggcttgggatgggcctgctttacttttgtttagtgacggaaggacggtaggggcatgccttgatcgaaatgggctgcgtccagcacgctattggaaaacatcagatggttttgtttatgttgcatctgaggttggtgctataccgatggatgagtcgaaggtagtaatgaaaggaagattgggtcctggaatgatgataacagttgacctagagactggtcaggtccttgaaacacagaagtgaagaagaatgtggcttcagcaaaaccctatggaacttggtn

SEQ ID NO: 101682 - DNA, 413 bp, Triticum aestivum
  unsure (1)..(413): unsure at all n locations
  Clone ID: PAT_TA_101682
tagcggccgcccgggcagggcnnnacgattctcggcaagatcnnnaaggacatgcnntcctannnaggcgaccggctacgcaagatcgagnntctgaagaaaatgcttgccgatcctaaacacgagctgattcagttcgatccaccccttccacttcctctcgacccgnncattcacatcactggtgtcataccatctngattgcaacgtcttcaaatcgactttgctcccgttgctcctcaagttcaccacgaccgaaggcgaaatctatcccctcatcttgangactggtgacgatcttcgtcaggatcagcttgtcgtccagatcatcgcacttatggaccgtctcctccaaaaggagaatctcgatcttaagctcaccccatatcgcatacttcgcgacctctaccnnn

SEQ ID NO: 101683 - DNA, 335 bp, Triticum aestivum
  Clone ID: PAT_TA_101683
ttcgagcggccgcccgggcaggtgcgcgattccgtatgttcgctcgtgcccgtggcgtgcctctgatatttgcaaaattcgctagatctagatccggtgcctagctttaattgttgcctgcttgatctgacggattttttgttgccaagcaagatctaatccatattttttgtcaggattcgtgccacgctatggtgcaagttgcgccccaaattgtgttgcaggggaggccgtgggacgctacgagatggttcgaattagctagtcgtgacgcgaatttcgatttggatcgtgtggcaggtcttgtgtatggtacctcggccgcgaccacgcta

SEQ ID NO: 101684 - DNA, 338 bp, Triticum aestivum
  unsure (1)..(338): unsure at all n locations
  Clone ID: PAT_TA_101684
tagcgtggtcgcggccgaggtacagaacgatgacgccgcattgcaagtccccatgtagatcggatcggcggtgtggccaaagtggtaaatacccaagctggacctcgactgatgagccccgatcttgtagccaggtggagcgggaagaccaagtcgtgaagccgccaacgcatccgggaaggcctcaaaagtcagcgtcggcagaccatatgtcagtccaagcagagagctgaccacccctccaagtgaatgacccgacaaccatacatccgagttgggatacctctccgtcacattatggtagagatctcgtacctnnnnnnnnnnnnnncnctcga

SEQ ID NO: 101685 - DNA, 673 bp, Triticum aestivum
  Clone ID: PAT_TA_101685
ttcgagcggccgcccgggcaggtaccaacaactcgcgtagtctttgcatgctgctggttttcaccaaagatccttgccataccgaaatctgatattttgggattcatttttgtatccaataaaatgttacttgctttgagatctctatgaatgatagttaatcgtgaatcttggtggagataaagaagccctcttgctacacctttaattatcttaaaccgtgtgggccaatcaagcacagattgtcttgcagcaccaaaaaggaaagcatccaaacttttgttgggtaagtattcatagatcagtaacctctcatctccgtgaatggagcagccaagaagtctgactaagttcttatgctgcaatttagcaaatagaactatttcattcttaaactccgcaataccttgcctagaaccctcactaagccttttgacagcaacttccttgccaccttccagcagtcccttgtaaactttgccgaaacctccccttccaatttggttggagtcagagaaattatccgttgctgtagcaatgtcttcgaagctaacaaagggaaactccacatattcgcctccaatttcatttgaagagctggcatatcttaacatctgtctttgttcgatttccttgtttcgccacttgcctctgtatatgcataccgttacaa

SEQ ID NO: 101686 - DNA, 294 bp, Triticum aestivum
  unsure (1)..(294): unsure at all n locations
  Clone ID: PAT_TA_101686
tagcgtggtcgcggccgaggtactgaaggagatgcaagccaccggcaagaagagcggcctctcgccgtttgagatcattgaaggtgtggtgcttgttgatgacgagtgggcccctgagagtggacttattacttccgcccagaagctgcagcgaaaagccatcaccgagaaatacaaggacggcatcaacaaggcctacggaaagaagtaaaagacagacacgaaaagagatcagagaccaagtcttagctttagcagacacgagaacggtacnnnnnnnnnnngnnngctnnn

SEQ ID NO: 101687 - DNA, 370 bp, Triticum aestivum
  unsure (1)..(370): unsure at all n locations
  Clone ID: PAT_TA_101687
tagcgtggtcgcggccgaggtacaacttaacgaagcatgggcggataccgaagactgtgaacatggtgaaagggtcgaggatacacaaagtcaaagagatggaagtgcatacagaagtgccagtggagattgctacgaaggaagacaagcttggtctacgactgtggaatgtcattcaaggcttgcggactctacgagcgacgggcctgactcgggaactggaagtttttggcgtggtagagggcgaagtgttcattgggatcatcgacgagatctcgcacacatgtccagatgaggagaaggaggagagcatgctgaaatcaggggacacctcgacttcaccgannccnnnnnnngncnnnnngctcga

SEQ ID NO: 101688 - DNA, 206 bp, Triticum aestivum
  Clone ID: PAT_TA_101688
ttcgagcggccgcccgggcaggtgtgaagcatgataacttggtagatatgattgacaagaccagtaacgatatgcaagcacacgagcaagatgtcattcagatgatgaagctcgcgatgtggtgtttacaaattgattgcaaaagaaggcctaaaatgtccgaggtagtcaaggtcttggaaggtacctcggccgcgaccacgcta

SEQ ID NO: 101689 - DNA, 161 bp, Triticum aestivum
  unsure (1)..(161): unsure at all n locations
  Clone ID: PAT_TA_101689
tcgagcggccgcccgggcaggtacctgatatgatacagctgattgcactgggcgctgtattcatttatnttttatttaacgggaggcatgagcactactactactatcactcgatnnnngatgaaaaagagctnntgtacctcggccgcagacgcacgcta

SEQ ID NO: 101690 - DNA, 468 bp, Triticum aestivum
  Clone ID: PAT_TA_101690
tcgagcggccgcccgggcaggtacccagccgaggactcccgcaaaggcttgtcgttcttcagcaccgttacgaagaacaagttcctcttctgggcggtcatggcgggtttggtcactccatttccgattatctatgttccgttcataaacaaagttgtgtttaggcacttgccgttgacgtgggagtgggggttggtgtttggcagcgtggtcatcttcgtggcgcttgtggagagctggaaggctggcaagcggtatcgcaaggcgaagaaggtgaagaagggtggtggcgtgctggttgggagggtggttgttgaggagaaggggtcggtctaggacgactgactgaaggagggaagggaagggcagacgtctgaggcgagctgctggtgagaggctgatttgatttggaccgatttgtttttggggttgcaatgctgcaactgtacctcggccgcgaccacgcta

SEQ ID NO: 101691 - DNA, 274 bp, Triticum aestivum
  Clone ID: PAT_TA_101691
tcgagcggccgcccgggcaggtccgggcaggtacaatctgtttacaagagaaaatccgacaaagcggagcacgctagtgtttcacttacctacctacaccaccacaacaaacgaaaactaaggacgagtgcactacgagaaagcattgttgcaagcatcatgcagcaaggcatgtaggaaggcgacgaccacctagctagctaactagcactacaaacttaaatacagactaacagaaatgcaggcatcatgcacctcggccgcgaccacgcta

SEQ ID NO: 101692 - DNA, 474 bp, Triticum aestivum
  Clone ID: PAT_TA_101692
tagcgtggtcgcggccgaggtacattacctatacttgttatgtgacttgtttctgacagaacaccatctcatatatgagaactaacaaatgataagttgttattgtgcacgttataagcattgtataagttactccccatgttatcacccgctagtgtttgtgcttctaaaagtgatttgtcactaagggatcctagcttgtgaggcacgaaaccatattcattgcttgaaaaattgttaggtaaaagtttgtataatgtaaggttaaatatactacctatcattatagccaatggtatactattgttgttatctgtaacaagttcactaattctaacattaataagcattaagataaataggaataatattgatactgctcctacatacactagtagataagacagacctataaagttaattcctaacatcattaaatatcctgctatgttaagaaataaacctattaaaaac

SEQ ID NO: 101693 - DNA, 361 bp, Triticum aestivum
  unsure (1)..(361): unsure at all n locations
  Clone ID: PAT_TA_101693
tagcgtggtcgcggccgaggtacgacgatggcactccggccactgcttcccagatggccaaagatgttgtcgagttcttgaactgggccgctgagcccgagatggacgagcgcaagcgtatgggatggaaggtcatggctattggaggtcttttgttcggcatgagtgtttgggtcaagagatacaagtggtccaccgtcaagacccgcaagatcacctacaccgcgccacccaccaactctcccaagcagcccggcggtgttttccgaagatagagagtagcaagcatgagggagcatgagggaatggttgggatcaagaagagtctagtagacttgtacnnnnnnngnnnnnncnnncg

SEQ ID NO: 101694 - DNA, 572 bp, Triticum aestivum
  unsure (1)..(572): unsure at all n locations
  Clone ID: PAT_TA_101694
tcgagcggccgcccgggcaggtgtnnncaatggcttcttgtctgttgatgctggcgctatgatcggcactagcaacactccgctttcaatgtcgagccatggtgaccctgtcatcgcggatcactcgcctcctctcaacggagttggccgtagtcaaagcgccgatatctttggcaaccacggtgaagggtctcaacttggcgatgaaggtctttacctctcggagaccttcaacaagcagatggcgctgccgttccgaagcccgggtctgcaggaggactttcaatcgcccatgcacgatggcatgttcaattttcaatcgccatccaacagcggccaagactctcagaacaacatgaacatgtccggccagcagcaaatgcacttccaatcaagtcctcaacacaacgcagacagcagcaactatcagtcgccatcccagcaccaaagctcaatgcaccaggacagcggcgtctccttttccactccatcgcacatttctcacgaccagtcatccatgttcaatagccctcaggacaacggaatgctgtacctcggccgcgaccacgcta

SEQ ID NO: 101695 - DNA, 342 bp, Triticum aestivum
  unsure (1)..(342): unsure at all n locations
  Clone ID: PAT_TA_101695
tagcgtggtcgcggccgaggtactttgaccgctggacagtttgcgatttacggtgatatcaagaaggctattggtgctaccggtggtgtcgagattgcgaagtaaacgggttgaattcacggtcgggagcaggggaggatgaagattggaggatgaaaagtgtgacaagacaagagcaacgatacacaagtgagatggaggttcgggaaacaggtctgctacaagacctgtgatcctgtgaggaaggaggacgttgggcatagaaattcgcgtagagagacgagggacacttctctttgttctcttcgtgcgggtttgtacctnncnnnnnngnnngctcga

SEQ ID NO: 101696 - DNA, 313 bp, Triticum aestivum
  Clone ID: PAT_TA_101696
tcgagcggccgcccgggcaggtacgaaaccatgacccgacaacatcaccacgagcagctcgcccagcagcaagaggaggacttcaagtcctatatcgccgccacctcgaaccagcaacagccacaacaaatacaacagcagccgcaagtgcagagtcgcccgagtagcaatcatgatacccaacccgtcactctacagacgtctggcctcgacctcgactacgcaaatatgctgcgaggtgactggccatatcaactgcaacaacacccgacgcatcagcagcagcagcagtacctcggccgcgaccacgcta

SEQ ID NO: 101697 - DNA, 353 bp, Triticum aestivum
  Clone ID: PAT_TA_101697
tcgagcggccgcccgggcaggtacttgtcaacaaactggtactgactgtcgttccacctacgatagcccacttctccgcctcattatatcgttccttcctggccttgctgtcatgtcgaagctcgatttcacccttttgacgtttctcctcatcaatggtcacgcgagcaactcctgattcgtagaaggcgagcttgaacgggagacggatggtctctgagctcgcgagcttcttgttgacaatcccggtaaggatgccatcgttgaacttgatcgttgatggctcgagttggtaaggagattcccatgtcgaggtcgagagagcattatcgacctcggccgcgaccacgcta

SEQ ID NO: 101698 - DNA, 550 bp, Triticum aestivum
  unsure (1)..(550): unsure at all n locations
  Clone ID: PAT_TA_101698
tagcgtggtcgcggccgaggtgacaagtccacttggaaataccaccactggctctacgacattctcaacgtccacccgaccgacatcaacaagccggttcccgtattccagaagtccgacaagatgccctacctcgctcactggtcaacacaccgctggatcctcacgcattccctgtggcccatcgccgtggcacaactctacacatattacttcggcaagaacatgccagtcatcggagcatttgcattctacaccatcgcgttccacatcaacgccatcaaccacatctacatcctccgccgactcggacacaaatggggcttcctcgacggcgacaaacacgagcgcgaccaagtccctgatgtgagcgtcaagaaggttttcgactcgctgtctttgaccgccgtcgtccgaccattgatcaccatcttcctggcgtatcgcaaaaacgtcgccccgatcgaatctttgagctggtggcttccggtcgagattggagtgtatggcatcgtcctcgatttctttttctactggtatcacagggtnt

SEQ ID NO: 101699 - DNA, 249 bp, Triticum aestivum
  Clone ID: PAT_TA_101699
tcgagcggccgcccgggcaggtgacgagtgcaaacgagctgctcttttcttcctaaaaagtatttcttccggcaaaggcaagacggaaagcaattacagtaggcagctgccccagaaatgcttgccaaacttgattcagttgaggaatatgcaacaaataaaagtgagatcagagctactgcatctggttcctgggaaggctttaagacgacactgctgtgacatcgtacctcggccgcgaccacgcta

SEQ ID NO: 101700 - DNA, 257 bp, Triticum aestivum
  unsure (1)..(257): unsure at all n locations
  Clone ID: PAT_TA_101700
tagcgtggtcgcggccgaggtactctgagaggcttcaaagatccactaaggttgagctggatcgatggatgggggagaggtggtgggtattcgtcgtggtagttctgaggtccttccgatcgtctgttgtgcgacggttcgttcatcgttcgagattcggcaacacatccgatgatgaatcgctcgtctcggtggtcctgggagagcgcggatttatacgaatggtttactcgtaccnnnnnnnggcggccgctcga

SEQ ID NO: 101701 - DNA, 636 bp, Triticum aestivum
  unsure (1)..(636): unsure at all n locations
  Clone ID: PAT_TA_101701
tcgagcggccgcccgggcaggtacccggagaacctcgattacaccttcatgcgccagttcaacgccttcttcggcgcggtcttgattcctctgtcctacttcaccgcgaaagagatgcacttccggaagccagttgtctggctcatcacgttggcagtcctctgcgagaacagctactgcacgatcagcagattcatcctcctggacagcatgctcttgtgcttcaccttcactacggtcttcaccttgttcaagtttcacaaccagaggcatcaaccgttctcgctccagtggggtttctggctcggcatgactggaatatccatcggatgcgtgtgcagtgtgaagtgggtcggtatgtttggcaccgcgcttgtcggtatctacacgatcgtggacctctggaacaagtttggcgaccttaagatgccaaagtgggagctgggagcgcatgtggtctttcgcgttatcggcctgattgtcatcccgctcatcgtttacatgttcacattttacctccacttcctcatcttggagaactctggtcctggtgatgcgcaaatgtcatcgctcttccaggccaacctccgcggcactgaggttggaaaggacagcccattggagattgcgtatgnn

SEQ ID NO: 101702 - DNA, 344 bp, Triticum aestivum
  unsure (1)..(344): unsure at all n locations
  Clone ID: PAT_TA_101702
tagcgtggtcgcggccgaggtctgctaccttccgaaggttgccatgctatggattgacaaccatgggcgtgtttcttccatgcgctgtagagcaggtggacgaggagaaggggccagcccgagctggacgacggagtgtcttcggaggcggaggagaggaccaacaatagcagcgacacggtggtgtctagcaggatcaataagctgacccgcagggcttggcaaggccgtgagacatggccgcagcaatggagcacgtctttggaaaaacgaacacgtcaggccaataatatagacctattagcatatatgcatgagacagtacctnnnnngcnnncgctcga

SEQ ID NO: 101703 - DNA, 257 bp, Triticum aestivum
  unsure (1)..(257): unsure at all n locations
  Clone ID: PAT_TA_101703
tagcgtggtcgcggccgaggtacgaaagttatcgcattattgcttaatcatctcctaggtatcctcatgtggcctcggaaaaagtgccggccaaagtatgagaatggtattatctgttggatgcaacttgctctgttccagtcgtgggctattggaagatctatctctcaaggacaaagagagaagtagctgtggttcgcccaatatgcctccaagccacacgcctcaaagtggtacctnnnnnngnnnncgctcga

SEQ ID NO: 101704 - DNA, 473 bp, Triticum aestivum
  unsure (1)..(473): unsure at all n locations
  Clone ID: PAT_TA_101704
tagcgtggtcgcggccgaggtactggcctcatctggactcgatggtgcttcgtcatcaagccacgaaacttgttccttgccagcgtcaacttcctcctcttctgcgtgggagccactcagaccgggcgtgtcttgagctaccaggcaagtcagaagggaactaccgttggggaggagatcaaggatgcggcgaaggagcaaggaaagaagatcgagcaggcagttgagaaggtggaggccaaggtttccaagtaaatgtgtctctacgtggtatctggcaaaaaggaaagtgagaggaggacacacggtggggcatgtcgagctgtcgtcctagaatctcagccgccgatgcatctcaagctggtatctctggttttcgacgggacgccaaagcgcttggatctcctatgttttctcagaagcagccgcttggaggttcgaatgagttgcagtagacctactaggtcgcagnn

SEQ ID NO: 101705 - DNA, 482 bp, Triticum aestivum
  unsure (1)..(482): unsure at all n locations
  Clone ID: PAT_TA_101705
tagcgtggtcgcggccgaggtacatgagtgaaatcatggatgagggcattaatatgagcatcaatactgtagtgcctgacctccttgatgataccattgatgagatctgtggtttatccaaggatcctcgggcagatcttgatgcagcatctgcaaggctcagagaagacaatagttcaggtaaaattggccttcattctccaactcaaaccaaggagtgtccaactgctggaatgcaagcaatgagagctcaggatatcggtgtgaaacctgtactgaagaggaaggaggagcaagccgattcaaaaccaaggaaacgtgtgaggtttaatgccgatgttaaagaacaaccagtggagcttcttgaacatgatgaagattctcccatggttcctcagtcaatggatgtggtcacaacaaagggcaacttgggcaactcctccacgccgtctggggttcctgactatgttaggaacccttnn

SEQ ID NO: 101706 - DNA, 661 bp, Triticum aestivum
  unsure (1)..(661): unsure at all n locations
  Clone ID: PAT_TA_101706
ttcgagcggccgcccgggcaggtaccttatgtggtggtttctctttcttgcactaacggagcttatgagatttcctgttgagttttgtgttgtgaagttttcaagtttggggtaaatatttgatggactatggaataagaagtggcaagagcctaagcttggggatgcccgtggcaccccaatatattcaaggacaactaaaagcctaagctttgggatgccccggaaggcatcccctctttcgtcttcgtctatcggtaactttacttggagctacatttttattcgccacatgatatgtgttttgcttggagcgtcttgtgtgatataagtctttgatttttagtttacgacaatcattattgcttcacataccttttaggagacacacacatgatttggaatttattagaatactctatgtgcttcacttatatcttttgagctnnncgagttttgctctagtgcttcacttatatcttttagagcaaggcggtggctttattttgtagaaattgttgatctctcatgcttcacttatatcattttgagagtcttttagaacatcatggtatttgctatggttaaaaaattggtcctagaatgatggaaagtgcattaaacactatgatcaatttgatgcttgataactattttgnnn

SEQ ID NO: 101707 - DNA, 306 bp, Triticum aestivum
  unsure (1)..(306): unsure at all n locations
  Clone ID: PAT_TA_101707
tagcgtggtcgcggccgaggtacttgatctcatcgacgttggtgttgagcatgtatgtgcctccgtagatggcactgagacgagcgaaaccctgaggcagctcccccaatccgtagagagggtagatgtatgggctctttccgtatctggccatgctgttgacgtagaggcggatgcgctcgatgcagtcctttgccattcccttggcgtcgacgtagtcgtctgtggtgtagagtgccatgctgtggccgatgaagtcgcgggtggtggcctcgaggccgtaccnnncnnnnnnnnnncgctcga

SEQ ID NO: 101708 - DNA, 220 bp, Triticum aestivum
  Clone ID: PAT_TA_101708
tcgagcggccgcccgggcaggtacatcagaagaaagttattacttctcacaagattgtcccaatttgctgggcagtcaagactcgtcattactgtgttatacgccttagggtcagtgcgccttagaatctctacagtatgatcatagatcataatgaagagaatcagtctgttgattagaggaactgtagctgcatggtacctcggccgcgaccacgcta

SEQ ID NO: 101709 - DNA, 649 bp, Triticum aestivum
  Clone ID: PAT_TA_101709
tcgagcggccgcccgggcaggtcaacagcccaccaaccataaccttccgcacaccctgctgccacccgaacgtgtctttcaaaaccggagaaatctgcctggacttgttgaagagtgcgtggacgccggcgtatgggattgtcaagacgttggaagcggtgcagcagttgatgtccgcgggtggagagccggatagtccgttgaatttggatgttgcgaagttgatgaggggtggggatgtgttgggtgcgcaggctttggtgaggttttatacggggaggtttgctgtgggaagaagatgatggggatggtgggaggaagaggaggaatgttcgttcctgagaagctgcttaaaacagtcaggcgagaatgatatggcatggcgtggaatggttcgaatatggttagagtgcacatacgcagcatttcgacaagaagatgacatgaacactcagcggcgaggatgcatatatgcgtcctcacactatggttgcgtcgcggcggaagagagcgtcgcgggacggagtatgaaggagattgttggatcacagaagtcgtgccattccttgggatctcatgactgggttcatggagtaaggctctcgtagtcctttcgaccctctagcgtacctcggccgcgaccacgcta

SEQ ID NO: 101710 - DNA, 589 bp, Triticum aestivum
  Clone ID: PAT_TA_101710
tcgagcggccgcccgggcaggtacacaccttcacttccatgcctcgttttagttctcctgcatgcagtcgtccaattgctatccttcctttatgttcatcatattcggtacattgtaattgttagagcatctcatcagaagtgggatagattcagtccacatcaacaccaatgtcactagcttgagtgtatgcagttgcaatgtttgctgcattaggattgtgtgcagtcgaataagaatgttcctaagccttaactcccaatctgtcagtgtaaactagggtgaactgccagctattctatgagaactatccacctaaccagtgatggtttttcattcttttgcagtaattgatgcgacaaggatttgcaacacccagtaagggcgttgatcttcttcagacctggagatgcgacggagggattaaggcattcttttctgcaaaatatagtaatgacataaatcattttttcggcaggagccagccactgtaattttcttttttgcctttgtgctgttgagatcttgtaaaataatatgctccaaaatactcaactatagcagagtttgctcctccaaaaaaaaaaaa

SEQ ID NO: 101711 - DNA, 341 bp, Triticum aestivum
  unsure (1)..(341): unsure at all n locations
  Clone ID: PAT_TA_101711
taangtggtcgcggccgannnacatgccctggtggctttatctgagttgggggtgatggagtcctaaatgaggttgtgaatggtttacttggtanngacgatttgaaagaggcgcttctacttgctatcgggataattcctgctggctccgataattcattactatgtnnnnnnncttggcntcnnngatcctgtgtcnnnnnnaactgctttagctannggtggnnnnacaccgattgatgtgtctgctgtataatggatccaaactggagttactcatttcggtttgacggcttcctactntggctttgnnactgatgttctgcaattatctgaaaacn

SEQ ID NO: 101712 - DNA, 689 bp, Triticum aestivum
  unsure (1)..(689): unsure at all n locations
  Clone ID: PAT_TA_101712
tagcgtggtcgcggccgaggtgcagaagactccttgattagccctaagacttctggtgacattgccacatcagatgccagtgccttagactctggcgatctgtccccattggttgattatctaagcggcactgatcctgaattcagttggacattaggatcatctcatgatgatcctgagcaaactgtctacaatccacggcgaaggattcttgaagcaatgaacagagagttgaatctaccatgcgacgaaccagaagtcacagaaatgccttcagtcaatacaccatctgaagcatacttagtggttggagcaactgaactggaagttgctaaaaatgagcccgggacagctaaaactgatgctgaaatgatggctgttgatgccaagtccctggaggacatagagatggcctttaaacaagcgagtggtggtggtgttgatgaggctgaaactgcacgcatctcaggcgttgatattgacttagagcctttagagggttctgaagaactccatgtgattgatgcaaaatctgttgaagacatttctgctgctttgaaggaatactctaatgttgatgtgaacaattgcttcgaacaaaacgannntgaagttggatgtggagaggttgcagaatgcnnnnaacacgacagtcttccagnannnncacatgttgaaagtctacagaa

SEQ ID NO: 101713 - DNA, 520 bp, Triticum aestivum
  Clone ID: PAT_TA_101713
tcgagcggccgcccgggcaggtggctgtggctgtgcttaccggcagtgagggtgtcaagggcaccatcttctccacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatcccccttactggaccaaattcaattgttggccgtgctgttgtcgtccatggtgacgctgatgatcttggcaagggtggacatgagctgagcaagagcactggaaacgctggtgcccgtgttgcttgcggaatcatcgggctccagggctagatgtcatcttcgccgaccaacgtcgtacctcggccgcgaccacgcta

SEQ ID NO: 101714 - DNA, 540 bp, Triticum aestivum
  unsure (1)..(540): unsure at all n locations
  Clone ID: PAT_TA_101714
tcgagcggccgcccgggcaggtaaacttgtggcnnnaggaactttagagagtaaagagaaaacatatgtggttggaggaaacatgcttggagtgcaatacgttgcagttcgtgttcgcggctgtacatatctaggagatgagaaactagttagaccatatgaaaaattccaaactgtaagggatgatatgggttctgttattgcttggcctcgctcacatgtaaaaatagttaagccaacccctccaacacaatcacagagcactgggcggtgaggatttgaaaagtgagtgcattaaaggagctaggagtggctggggagcacttgaaaagggagtgcactagaggagtcgggagtagttgatgaatcaatctttaaatgaacaaatattctagattatgtatagaatttagcttcatagacaaaattagttccagtctgtaggatcttttcttatttatttgcatcatcgcatgtttcatatgaatgttacatattattcagctgtgaactccaagtacctcggccgcgaccacgcta

SEQ ID NO: 101715 - DNA, 301 bp, Triticum aestivum
  unsure (1)..(301): unsure at all n locations
  Clone ID: PAT_TA_101715
tagcgtggtcgcggccgaggtactgcaatgtttgcacacaggtgtgggtttccttggacaaaactaccacttctattagcaaacactccagcagtgggaagtggcccttggaagtcattgagggacatattcaaatacatcagagaggtgaaggtcccaaggaactccgggattgtgccagatagattattactggagcaatccaacactttgaggcctttcaagtttgctagtgattgtggaatgtctccttgcannatgttctcttctacacgaagtgcttccaaccgaacacatgcgc

SEQ ID NO: 101716 - DNA, 255 bp, Triticum aestivum
  Clone ID: PAT_TA_101716
tcgagcggccgcccgggcgataaccatgatcccaatgcggcgagtctcgaccaaaatctgttgttggacctgcccgggctggagcgaagaactgaccggactggctttgaatttgttgctggccaggcggtgtccaagtagtggtgggctgcgtcatcatcgtggcatcctgttccattttgcggcgcttaccacggttttcgtcttctgatgtgatggaacgaccgtggatgtacctcggccgcgaccacgcta

SEQ ID NO: 101717 - DNA, 660 bp, Triticum aestivum
  Clone ID: PAT_TA_101717
tcgagcggccgcccgggcaggtactgggagatgatgcgaatcgcccgcgagcccgatcaatacatgtggccagctctgcaacggttgcgagcggcggcggacaagagcaatggacaattgatactaggagcattgagcaacacgagcatttttccaccaggccatgctttcaacgatgaaagcacacccgagggcaagcagaacaaggagttgaagagtgtatttgacatcttcgtcagcagcgctcatgttggcatgaggaagccagcggaggacatctacaaatatgccatcacacgattacatgagatggtgaagctgaagggctacggcatgggtgtcaggccgcaggatataacatttctggacgatataggcggcaatttgcggacggcgaagaagttgggaatgggcacaatcaaggttcagctgggacgggcggatttggctgtgaaggagctggagaagctcactggactcgatttggggctcaaggagagcaagtcgaagctgtgagtgatggaagtccattcgtttcatggagaagcatcacagacgggtccgctcaacacgctctgccaacgagctcactccatggcttcttgacttgatgcgtgggtcttcacggctcgaacacggcaagggctcagagtatgccag

SEQ ID NO: 101718 - DNA, 525 bp, Triticum aestivum
  unsure (1)..(525): unsure at all n locations
  Clone ID: PAT_TA_101718
tagcgtggtcgcggccgaggtacagagcagtagagaataatcaggaatggtagaaagtaattggtatgcagagtaaatgttagcaatcaacattttgtcaaaatagacatgtaactataaaaataccatttgagattttacatagcatgcatccaccgtgaacaaaacaaacaactctatcaaactaggaggaactaggtgttgcagcaagcaataaattaaataaaaaatggaaacaagcgcacacacactaagacgatgcaaaaagcacaacgaagatatttaaggatcaacaatgatatacacacgacacctgcatggccgatgcttgcacgattctgccatgatagtgccaacagcgagcatgctcacaaaggcgttgttggggagggaacatcgttcataggccgtgcagctactgtcatgtgtgagggaacatccttcaaggataggaacatgaggacaaagaagggtgcatagtttgtagtgctagctaattattttgtacctnncnnnnncnnnngc

SEQ ID NO: 101719 - DNA, 630 bp, Triticum aestivum
  unsure (1)..(630): unsure at all n locations
  Clone ID: PAT_TA_101719
ttcgagcggccgcccgggcaggtactgtttgttctcagattgcaagtgaaacccttcaggacgacattgctaagacactggagaatttccgtgatatgatagcaatggacgatagattttctttctgtgcataggtggatgatgacaacgggctaaagtcactaatgtggactactgggaggagtagatcattatataatcactttggagatgcaataacttctgacactacttatggaacaaacatctacaaaatgccatttggtatgtttgtaggagttagtaaccactttgagagtgtaatattcgctggagtgttcttgactaatgagaagggagagaatttctgttgggcttttaagaaatttgttgctatgatgggtggaaaacacccagtaactattcttatagatcaggctagagacattggaaatgcagtccggaaagttttcactcatgcagaacatagatggtgcaaatggcatgttcttaagcgggctcatgaacttcttggtgctgtctatagcaagcacaaaacatttgccgatgatttccataagctagtgaaccacatgctaactgtagaagagtttgaatatgcctggaatttcgttacggtaaaatattnnn

SEQ ID NO: 101720 - DNA, 359 bp, Triticum aestivum
  Clone ID: PAT_TA_101720
tagcgtggtcgcggccgaggtacgcacagagctcgggaataatctgcttggtagaacatactggtaattaagatgcgacgtcttaaaagagctcaacagaaaaagattacatttggaaacgttcttgacagagagatgcaagatgacgaagcttcaatgtattcacgcaacagcatgtcaacaactcagatcgaagagagtgcacgcctgctccggcaatggcagagtaattattggatcgacacaatcccccgccggcaatggaaagacaccatctttaattagttaccaactgtgaccgcgacgttccactttggataaagcaccttagtgatgtacctgcccgggcggccgctcga

SEQ ID NO: 101721 - DNA, 303 bp, Triticum aestivum
  unsure (1)..(303): unsure at all n locations
  Clone ID: PAT_TA_101721
tagcgtggtcgcggccgaggtaggcctacatccaataccgtatcgctctctgtctccatctggaaatctacttggtcacctcgatcatcatcattcgcgaggtcatcgcctccgagctgatcgtcttcatcgccctgttcgccgatttggccaccgtcgccattgcctacgacaacgcccactccgaacagcgccctgtcgagtggcaattgcccaagatttggatcatctccgtcatccttggtatcgaactcgctattgctacctggatcgcccgtggtacctgcnnnggcggccgctcga

SEQ ID NO: 101722 - DNA, 215 bp, Triticum aestivum
  Clone ID: PAT_TA_101722
ttcgagcggccgcccgggcaggtacggcctcaccttcttctactcgccgtcttccaccttggctcatgcccaatttggcggcatcggccaggaacagcaatttggcttcgacaaggacaacaagctctatgttccgacttactacgacgagtccgtctaccctcccaaaagcctggggtcgtccaagcctgagtacctcggccgcgaccacgcta

SEQ ID NO: 101723 - DNA, 307 bp, Triticum aestivum
  unsure (1)..(307): unsure at all n locations
  Clone ID: PAT_TA_101723
nnaacaagggaacaatttcnnattttggccacctatccaaaatttatactnntcaacaacaacatgccccacgccccatttaattttggggtaacttttcttcttttctttgcaaagtagtaaatgtaaaggaccacttccatgcttgcccccaccttccattttgggaaatgggaacatatatcctggggcaacttcctccatgggggcagtctttcctttgacagctttccgctccatgcttatttccacacatgattaatcatcacctccccgcaaaaaaaaaaaaggggtannnnnnncccgc

SEQ ID NO: 101724 - DNA, 288 bp, Triticum aestivum
  Clone ID: PAT_TA_101724
tcgagcggccgcccgggcaggtatcgtaaagtttatgcattagttacgctgtcggaatacaccaaaatggaaacccatatgatacagaacgagatcctttgacataggatgaattagaaggacgtcaatgtgcatcctctgtccatgccacatccgacaactctaggcatcagattatagatactttgcatctatcagactagctggaggccgtccgataaggtgcatgaaagtcgtctgatctactaatcaaacccacgcgagatttgttgagttaaaaaaaaaaaa

SEQ ID NO: 101725 - DNA, 444 bp, Triticum aestivum
  unsure (1)..(444): unsure at all n locations
  Clone ID: PAT_TA_101725
gtggtcgcggccgaggtacaagnnnccccccccccccccccccccccccccccnnncncccccccccccccccccccccccccccccccccccccnnnnntncaatttaaaacccccttcccccccaggcaataaatttttttcccatcaaatttttttggtttttttttcccttaagggaaaccccctccctaaggcaatccccaaggactttaaacaaatcccaaacaaaggaaatcaacccattttttccccccaaggcttcaaaattttcccccccaccttttcaaaatttttaagggatccttcccttttcnaccccccccccccctnnaaattccaatgccaaatttaaatgcaaaacanntttcccnnnncctttttttttttgcccccaatatccctttgggaaactgcattccttccaaaaccnnnnntttccca

SEQ ID NO: 101726 - DNA, 376 bp, Triticum aestivum
  unsure (1)..(376): unsure at all n locations
  Clone ID: PAT_TA_101726
aaaagttttttgacccngtcggtcagcagcaanctttgagtgtgacatgaggattttcagtccaaantanngtgtcaacgagtccttttttaagtcgttcctacacctcgatcccgcgacgtttgtttatacccttgcttttttggcataaaactcctccngggcgaccttgaccacttttgtcccgtaaatgattttttgcacgtttgcttccgcccatttatccgggaccggtcctttgccttccttggaagccgcaaattgcttgtttttttgctcctttgccgctccgtttcccaaatgcaaagnttttccattcgcagccgccaagttcaccagngngtannntgcnnnggcggccgttcanannnnnnnn

SEQ ID NO: 101727 - DNA, 321 bp, Triticum aestivum
  unsure (1)..(321): unsure at all n locations
  Clone ID: PAT_TA_101727
nnnnagaaacaatctttgcaatggaaattcctgttcatatctgaaatccaaaggaaagggggcaaaaaatacaacccccaacaaatttgactgggaaatattcggtcaaaacgcagcagttaagnaacaaactccgcatccggggccgtgcagcgtccataataaacagttccgttaaagcaaagccaacgtccatcatttcctcgtcggggggacccggggtcacatggctaccatcgtngtcaacttcggcattgcaagcttaaactggagcgcggcgttcctnntgggtgtaaatgtacctcggccgcaaccacccta

SEQ ID NO: 101728 - DNA, 344 bp, Triticum aestivum
  Clone ID: PAT_TA_101728
tagcgtggtcgcggccgaggtactgtatttggcgaactttcataagcaactagttgatcaaacaactcagagaattccacatattcctctacagttcctgtctgcgatatgtgaaattttttcctcaacactgactggtgaaggttccggccaaacctgccccgaagcaacctacaaaactcatcccatgtggaattgagtgctcgcctacgcactgattcgagccatctagcagctggtccttcaaacaatgatgtggcgagagagatccactaattatgtggtgtgccccaaaatctgaaataatcctcgcaacgagtctacctgcccgggcggccgctcga

SEQ ID NO: 101729 - DNA, 269 bp, Triticum aestivum
  unsure (1)..(269): unsure at all n locations
  Clone ID: PAT_TA_101729
gacnanacaacacccgggacttaattttcaactcaatacaagcgaatttcgctacctaacggcaccccatttcttttttatggtacacgacaattccaaaaccttcaccaaacaagcacaataacagtcacattttcttgacacaaacaaggatgaaaaaaacctttcctggggatgccgcccgcatttctttaaaatgggcaatgggttggcattcaaggctnngggaaggnnnnnggggccccagccaaaaaccagcnngtaacaag

SEQ ID NO: 101730 - DNA, 166 bp, Triticum aestivum
  unsure (1)..(166): unsure at all n locations
  Clone ID: PAT_TA_101730
nnacaactggaacctcgccggtctcattttcttnnnacacaaaaaagtgaaacatgtcagggggtatccaaactcgaaaacacacacttttagtagttccacagttacaaaagcaaaacgaatcgntcactggaaatttttatgtacctcggccgcaaccacgcta

SEQ ID NO: 101731 - DNA, 362 bp, Triticum aestivum
  unsure (1)..(362): unsure at all n locations
  Clone ID: PAT_TA_101731
aaaaactaatttttcctttaatttttaaaagaaacccccttttaacttttttccaatgcttacaacaatggttgatgttttttaatcgggttttaccctgtttttttgatctcatgacaacaatccactttaggatttaatnanctttggactttttttaccccaaccnnntcnatttatacttttattcaactgctaattgttgctcctttttaaatactccccccccccaaaccaatttttttttttgaacaaatttggttaccctcnnncatttaatttttttttttttaacggaaaacaaaaatgggtgcttaactccaaagnnnttnnnaaaaaaagncccccaaaggccccacttt

SEQ ID NO: 101732 - DNA, 188 bp, Triticum aestivum
  unsure (1)..(188): unsure at all n locations
  Clone ID: PAT_TA_101732
caaacccacaaagcgtcttttgaaaatccaaatcacnaccaagccttccacccgttcacaagcaaactcttgtccgtcttgaatgcttggacgcgctacggaacactgcgacaaacccacggacagcccaatgacctttcctcactcccacccgccatttttggtacctgcccgggcggccgttcaaa

SEQ ID NO: 101733 - DNA, 166 bp, Triticum aestivum
  unsure (1)..(166): unsure at all n locations
  Clone ID: PAT_TA_101733
tagcgtggtcgcggccgaggtgttttttgtcccatntgttatactcatatcatattataacnngtgggttttcctggcggatgtcaaactcgtgaacctttccctgtttccgggtattgttgccgagtataaccggtgctacatgattctgttgaaaaaaaaaaaa

SEQ ID NO: 101734 - DNA, 196 bp, Triticum aestivum
  Clone ID: PAT_TA_101734
tagcgtggtcgcggccgaggtggtcactttgcataagtagattctgccgtccaagtgtctgatcgagtagtattaaattagcagttttattttggcatttcgtccagattactattcgagttggtgtcctgttgagttgtgctgctgtatagatgtgttggccgccgagtcagtacctgcccgggcggccgctcga

SEQ ID NO: 101735 - DNA, 208 bp, Triticum aestivum
  Clone ID: PAT_TA_101735
tcgagcggccgcccgggcaggtgtgagcgcagtcagctcaacctctaggccgacaacttcatggctgatggatgctgctgcatgtgtgtcgtcgtcgatctctgcttcttcccgttctgagattgagtagtccggactgatagatgttgcatgtgagggcgattcgagatgaggagttggtgtgtgtacctcggccgcgaccacgcta

SEQ ID NO: 101736 - DNA, 176 bp, Triticum aestivum
  Clone ID: PAT_TA_101736
tagcgtggtcgcggccgaggtacaatacacatcgctggtgcatattttggtatgccgcacaggcttcaagaagccaaggcactagtattgtagacaagaagagcaccacccaacagaattccagaaagagtgactgcccagagaaacagccctgacctgcccgggcggccgctcga

SEQ ID NO: 101737 - DNA, 251 bp, Triticum aestivum
  Clone ID: PAT_TA_101737
tcgagcggccgcccgggcaggtacagcgagtgagtatgctccaattcctcgactccattatgcacactattcacaagccttcgaatccaccgataatctcataactcagctcttttcccaaaccgtcgtccaacccaatcaatgtctctcccctctgcccatgcatcaacttctctcttacaaagcagcaaccaatcccacaataccggcagcaataccggccccaacacacctcggccgcgaccacgcta

SEQ ID NO: 101738 - DNA, 277 bp, Triticum aestivum
  Clone ID: PAT_TA_101738
tagcgtggtcgcggccgaggttccgcctaaaatgaaataaaagctcagacgagatgagcagcgtcatcgtgcctatgcgtgtgtgtgtgaccaacaaatatgtataccagtatgtcgtgtcttcgtcgctgtgttttctctctcgagaaaaagttggtgttgcttgttgttcagctatccggaatatcctccgtgaataaacacctgtagtgattgtgcgtggctgccaataatgtgagttctcttgtccacgcagttacatgttaaaaaaaaaaaa

SEQ ID NO: 101739 - DNA, 314 bp, Triticum aestivum
  unsure (1)..(314): unsure at all n locations
  Clone ID: PAT_TA_101739
aaatnnctttataaaaactaaaagcaaaaaggttaaaaattatccaccgtataaaaaaaaaaaggccctcataagggcaaatngcccatttgcttctgcaaaaccaacccctaatataccaaaaaaaaatagttgccctctaaaaaaagggtttttacntccccccaatataagggccccaaaaactactccaattcctacccctgccccaataaaacctgtggttgcaaaacctgtcccaattattttggcggctggaannaaatcttaaaaaaaaaaaatttnnaacctgcccgggcggccgttaaaaataa

SEQ ID NO: 101740 - DNA, 213 bp, Triticum aestivum
  unsure (1)..(213): unsure at all n locations
  Clone ID: PAT_TA_101740
nnnnttttttttggagcattaattgatccannacatggagcgcgcgatgccaatgcagaacagnnnnggacggaaaaggaaggatctatccgatgatctggtcgaggacaccggtgttcttgaggccgatcactatgcctacgcccattatgaggccgaatgatccgcatgcgatcgtgtttgcgaacgctaagccggacgggtcgcccgnnn

SEQ ID NO: 101741 - DNA, 411 bp, Triticum aestivum
  Clone ID: PAT_TA_101741
tagctggtcgcggccgaggtacatgtacttggccaggatgggattcacgagacagctgcccgtggaatcaactccagttgatggaatgctgattgagtaaagtgaccgctttttcctcgaccatggctcagcctgtcttccatacagacacattcatcaggctcttgcatcctcctcgaacacctcgaactcgccatcagctctgccaacgctatgcgacacgccaccattcgctttaccctgccttcgacgagtgttgatgcggatgtcgccgacttcttcgcttctccggcgcgcggacttgattgtcaacttgctttccatctggctggaaacatcgtgctcgtcttcgtcttcgagatcgccgcccggtgcatcaaagtcgctgtacctgcccgggcggccgctcga

SEQ ID NO: 101742 - DNA, 250 bp, Triticum aestivum
  Clone ID: PAT_TA_101742
tcgagcggccgcccgggcgggtacggcacataatctttggagggaagacgcggtcccttaaggttgagcagtgggatgctgggctgcacctctggttaattcattggaactatacaccgtttattctggcttatggttatcagaagcaactaggatcccgtgcttgtgtgtataaagtgttatagattaatgtaaaccggcggatcttgcgaaaaaactggagagatgtttatactttaaaaaaaaaaaa

SEQ ID NO: 101743 - DNA, 313 bp, Triticum aestivum
  Clone ID: PAT_TA_101743
tcgagcggccgcccgggcaggtttttttagttctcaatcatgaattaagtagtatgataacaagaaaaaaagttacaaagccgtgactcatgatctttgacaaacgcaaaataaacgcaagggatatctcgtttgaagcacgaaaaagcgcccagtagtatgcctgccttcttttctcatcccttcttccacttcgttctttcaatcaacatgccctcaaaagcagtcgcttaaacggaagtgccatagtcgttggcagcggcgttctcgtgcgtgacgttggaagtgttgcacctcggccgcgaccacgcta

SEQ ID NO: 101744 - DNA, 380 bp, Triticum aestivum
  Clone ID: PAT_TA_101744
ttcagcggccgcccgggcaggtacgcgaggtagttccggctcaacactgtaagacccagagagctctttccaagagcattcttggtagacttatcctggaggaacttgcagagcgccttgggctcaccgggagcaccactgcccggaagagcaaggtagtatgcggcaagaccacaaatgtgaggagaggccattgaggtgcccgaaatggtgttggtagaggtatcactgtccttccaggtcgacagaacattaacgccgggcgcgaaaatgtccaccaagaggccaaagttagagaatgaggcacgctcatcgttggcgtcagaggcaccgacagtgcagacatccggctccgaggcacctcggccgcgaccacgcta

SEQ ID NO: 101745 - DNA, 331 bp, Triticum aestivum
  unsure (1)..(331): unsure at all n locations
  Clone ID: PAT_TA_101745
ccgggcggccgcccgggccgccttttaaaacactgccgaccgccgggcccccctaagggaaaacccccaacaaatcgcctgcccacctggaaccccccgggggggcaccaaaaaaaccagccaaaaaactgggccaaaccggggcccnaggggaaaacactgccacccccaaatccccccaccntaccacccaaaaacaaaaacggaaaaaccaggggggcccccgggggggcccaaccaacaaaaaaagcgcggttctccccgccccccccccaaaccggaaaccanncgggaaacntggtntaacaaaggggccaannnacggggaaaa

SEQ ID NO: 101746 - DNA, 395 bp, Triticum aestivum
  unsure (1)..(395): unsure at all n locations
  Clone ID: PAT_TA_101746
gttttattaatttnnnttgggcccctcccgcgggaaggtaaacctcgggcgcgacccccccaaaaactaatgaaatcgcgggcccccgccgggcgacnntaagggaaaaccccccaccccggggaagccaaactggaggattccaaaagggcccccaaaaaacccgggggaaacatgggcaaaaccggttcccgggggaaaatggtaacccctcacaattccccacaaaaaaccaaccgggaacctaaagggcaaaacccggggggccccaagggggaaccaacccanntttatgggggtgggcccactggcccctttccanncgggaaacccggcccgccccccgccttaaagaaaaaaccaaccccccgggaanngcnggttgggtattgggg

SEQ ID NO: 101747 - DNA, 249 bp, Triticum aestivum
  unsure (1)..(249): unsure at all n locations
  Clone ID: PAT_TA_101747
tagcgtggtcgcggccgaggtacctcagtgcaaggcnnacagccacttgactgacatcctcccattgtcaatctcagcagccatcgcaccttttctcaatccttccattcgtcgaaaatcgtgaagtcgtcgtaatggtgaggtggacgtcgatgaagacatctacctgcagcagtagccaccgtcgacgaggaggtcggagccggtggtgtaggtggaggcgtccgacctgcccgggcggccgctcga

SEQ ID NO: 101748 - DNA, 274 bp, Triticum aestivum
  Clone ID: PAT_TA_101748
tagcgtggtcgcggccgaggtacatctaccaggcgttgttggagtatgctccgcgctacttcgtggtggaggctggcaacaaggcgattacgcctgctgagatgacggactggctagatgagttgaagaagattgatcctctgagagctggcaggtgggaggatctgggcagagcgctgaagctttgaggagatgacttggaagccacaagctccctgcattgtcgagccagagctgcggcttaccacatgtacctgcccgggcggccgctcga

SEQ ID NO: 101749 - DNA, 330 bp, Triticum aestivum
  Clone ID: PAT_TA_101749
tcgagcggccgcccgggcaggtggcgccccaccggctggcagcgacccgaacaacccttatggataccagaaagatccggctgatcccaaccacccacaagaaggcgagaggggtttcatgggtgcggtagcgggtggtatcggtggacatctcttgggcaagcaggcaggacacggcattctaggaacactggccggcgcattccttggatcgaaaggcgaggacaagttcaagcagagccaccacaacaagcacagcaatcagcgctggtagaaggtgaacgagccagagcagcagagcatgacagtacctcggccgcgaccacgcta

SEQ ID NO: 101750 - DNA, 368 bp, Triticum aestivum
  unsure (1)..(368): unsure at all n locations
  Clone ID: PAT_TA_101750
aaccccgggcggaacccccctaaaaaataaaaaattcccggccccccggggggccaccattggggaaaacccccaacccgggggaggcaaaattggggttttttaaaggggccccaaaaaagcggggggaaaaaaggggaaaaacgggtcccgggggaaaaatgttatcccctcaaaattccacaaaaaaaaaaaaccggaaacaaaaagggaaaacccgggggggcccaaagggggggccaacccacattaatggggggggccccacggccccctttccaaagggaaaacctggggggccccctgantaaaaaaaacccccaacccccggggaaagggggtttgggaattggggccttttccccttt

SEQ ID NO: 101751 - DNA, 173 bp, Triticum aestivum
  Clone ID: PAT_TA_101751
tcgagcggccgcccgggcaggtgaaatttaataattgttcagcagaagacacgtattcaagcttctagctaagctcgcatgcagttgtaataagattgaataagttagcctcgcggtttagccttcagagccaatacgagaaatcaaaatgtacctcggccgcgaccacgcta

SEQ ID NO: 101752 - DNA, 237 bp, Triticum aestivum
  unsure (1)..(237): unsure at all n locations
  Clone ID: PAT_TA_101752
gcctggccaagcanaaataaatcaacagccgcaagtaacactgaaggggtttgtttattgacccccactttaaaaataataatttattttccctcgaacattaagggaaccaacatttaaattaacgcctcaaaccctaaatacaatgatgggtacccacaaacatccacatgtataaacttgcatccagggggggccccctatttccttatgttcaatacctgcccgggcgggcgg

SEQ ID NO: 101753 - DNA, 396 bp, Triticum aestivum
  Clone ID: PAT_TA_101753
tcgagcggccgcccgggcaggtacagcccaccctcttccacctcctcacccattccgttccattccgctcctcaaccctcgcaccatcttcacattcattccttccgctttcccctctctcccttcctacacctccttccccgctcaatggtcccaaggatgcctcatcccaagcagaaccggaagatcgtatcgtgcgcggtagaagaggaagaaccacattgaagctccgagcccaacggcagcgaatcggtagagtggacggacgggtgggatagcgatggggtgcgcgccgccgtgtcgggggcctggaccgtgtcctcctgccatttttggtttgttgggtgtgtcgtggagtgttctgcgactggttgcacctcggccgcgaccacgcta

SEQ ID NO: 101754 - DNA, 448 bp, Triticum aestivum
  unsure (1)..(448): unsure at all n locations
  Clone ID: PAT_TA_101754
tagcgtggtcgcggccgaggtactagccctgctaatgaccttcagctctctcctcctctctcagcgccgtccatcgacacccacggtggaagcgcaaaccagccattcacttctaatcattgcacttggcgtcctcgctcgggtagccgtttggagaggggtcgcacggatggtcatctaagagacacgaaaagtccgtggagcatgcgttaccgtctccttggccgttctggcagaccccgttcttgtagaagtctgtgactttgcaggaccagccggagggccagtcggcggagacggcggagacgagagcgaacaggatggagatttggaggatctgcatgtttgcttgacagggttttctgtgacttcctgtcgttgcgttgggaagagcagtcagtcggatgtatttgtgactgtcgagnngtngtcgacctgcccgggcnnn

SEQ ID NO: 101755 - DNA, 212 bp, Triticum aestivum
  Clone ID: PAT_TA_101755
tagcgtggtcgcggccgaggttgcagctcggcttgctgcggcctgcagtctgcttgagtgggagcatagttcgtcactcgatgggtgcaagagtctgccggccagccgagcttgcctttcttatgtcttttttcttcagtttggatggttgtatgtctcagtttgctccgcgcatcatgcatttcagcaccactttcggcaaaaaaaaaaaa

SEQ ID NO: 101756 - DNA, 371 bp, Triticum aestivum
  unsure (1)..(371): unsure at all n locations
  Clone ID: PAT_TA_101756
gaaagttaaattgcgtattgtaataaaactaaagtaaactaatgttactaggtataatttcgaagctataaacgatacaaggaattaaaactataaaagctataattattggtaaaagtattgttcaagaaaaggacatcaattgatcaaaacgtattctagggaaagatgccctaactcatataaatataaatatcattatacacgatttaatacctataattagccctgtcactagaccttctaataatggactattaaaaatttcaagtccttcataagagccttgcacaccatattgagggtaaataggactnncatattcgaccccccctcacaaaggtgatggtacctcggccgcgaccacgcta

SEQ ID NO: 101757 - DNA, 234 bp, Triticum aestivum
  unsure (1)..(234): unsure at all n locations
  Clone ID: PAT_TA_101757
aaaaaaaaaggatgaactagggctttaccaacataccccccatgccccgccttgaaaggcccattgacaaaaacaaattttggcttaactgcccaaatttggaaaacattattttcactgggacccatacaattttggactttggaggctacggttttaaaaggaaatttatcactttanntagcttggtaacttcaaattcatgagggccaacctgggttttttggggacctc

SEQ ID NO: 101758 - DNA, 245 bp, Triticum aestivum
  Clone ID: PAT_TA_101758
ttcgagcggccgcccgggcaggtaccaatatacaccagacgcaatgctctactgccctctcacaggagcccagtagaagccaccttggtgctgctcgacgccctcagcagcactgcaccacttcacgcggttcttcgcgtattgctcgatccttggcttgacctttgtctcgtgcagatcgaagtcgtcgatcgttcctattctcataatgagcttccctgggtacctcggccgcgaccacgcta

SEQ ID NO: 101759 - DNA, 240 bp, Triticum aestivum
  Clone ID: PAT_TA_101759
tcgagcggccgcccgggcaggtacttagcgggcatatgttgttaaatattttaagtggtttcacttataatattatgacttctgggtttgttttcttctttttagggttatttccacttgcctttataatggcattttcaggtcttgaattagcaatcgctttaatacaagcacaagtttttgttgtgttatcatgttcctacataaaagatggtcttgatttacactaaaaaaaaaaaa

SEQ ID NO: 101760 - DNA, 600 bp, Triticum aestivum
  unsure (1)..(600): unsure at all n locations
  Clone ID: PAT_TA_101760
tcgagcggccgcccgggcaggtcagacatcttgactcagcatcgacatcatgttctccctcctcctccagttcttcctcgcggctttggccttcgctgctccaattcacgacgaaatcatcaccattcaggccgatgcatggcaatacggcaccggcggcggcattatcggattcattgttctgatcctggatgtgatcgtgtggatcgaggtagccaaatccaaccgccctgtcctccacaaggtcctctgggctgtcggcgtcttcctcttcccgatcgtcggcatgatcgtctactggctgttctccaaccgcgaggcccacaaccaaggagctggatacgagccgattgcgtaaagtctggacgatgatacaacctggcgtaggagcttacgaggaagatgggaaaggtttactagatgaaagcggaggaagcagtgcgtggcgttcaggcaggctgcgaatactaatggcgacggagacgatagggggggtttggcactttgcatacaacaggggttgacgctcggcggattcgaaacagctcattttggcagcgccaggtagcaatctctaagtgggtatcagncacttgtttg

SEQ ID NO: 101761 - DNA, 484 bp, Triticum aestivum
  Clone ID: PAT_TA_101761
tcgagcggccgcccgggcaggtactcagccacaaggaaggcgcaacgaagaagttcaccaacgactacttccacgccggcctgggcgagtatcacgcaaaggggtggtgatcgcatctacaatctccggtgcacatcccacgccggagactcttttgattttgattttgaacagtcctgcggtttagcgatttgattttttgaaatttctgcgacctcagcgaaaaatggagagaggactcgaggtgtccctcagaggagcgacatcaatgcgctgccttttattgcttttacttttacttccaatgataccagcatcggcacagattttacatatgcgaattctccggagaaggcagagatgggagacaacgccgcggaaaagtgtggtgctttccgcgatggcgatggcagatggagatcgggttgcgaaacgggtgtaataccatcatcgatatgggtgtacctcggccgcgaccacgcta

SEQ ID NO: 101762 - DNA, 229 bp, Triticum aestivum
  Clone ID: PAT_TA_101762
tcgagcggccgcccgggcaggtgtgctgcatactggcacaagttttctcagtaggttctatatctgtactattgcttgggtggagctggacatgtagatattttgttgttttgtaatttgagatgtaaacacatctgaccctgccctgtgcatgtgccactagtagaaaaagggtcaaacgtgaatcacattagtgtcggtttgtatttgagctggcaaaaaaaaaaaa

SEQ ID NO: 101763 - DNA, 397 bp, Triticum aestivum
  unsure (1)..(397): unsure at all n locations
  Clone ID: PAT_TA_101763
tagcgtggtcgcggccgaggtacccagngggcaaggacgttcacgtcaactggaccggccgtggtggtaacatctcagcctcgacctacactgcttaagtgtgggagactgaaagaatgtgtttgtgtgtgtaaatgcttcttccgcttccaaccggcaactttactttcatcttgagttggcccagcatcagatatggttggattcggaagtcagatgaatggaagatacgatcgatggatacgaaacgatgaagcacatgtcaggtcctctggtgagatggatacggactcgagatagaaaactgcacaagccacttttggtagcttcggcagattgagatgagattacccaacaatgcaatcgaacgatgaaactgaatgtgaaaaaaaaaaaa

SEQ ID NO: 101764 - DNA, 317 bp, Triticum aestivum
  unsure (1)..(317): unsure at all n locations
  Clone ID: PAT_TA_101764
tcgagcggccgcccgggcaggtaccgtggaggtattcggacaaggaggnncatggggcgatgcgtttggtcaataccgtggagcgatcatttgtcaaggaattgcggcgaggtatgcagtgaggcaggcgagtagtgagaaggcgggcgactatggcaggatgatgggaccttatggagagcaggcgtgggaaagtgtgcagaagtatatgcggcaggcccaggcagagggtggaaaagcgaagctatgagatgactatgatatgtagtgggagagcggtggaattcgataccagtacctcggccgcgaccacgcta

SEQ ID NO: 101765 - DNA, 282 bp, Triticum aestivum
  Clone ID: PAT_TA_101765
tagcgtggtcgcggccgagtacacatgcctctatggagtccgaaggagcactgtagcggacgcctcttgtctatgcaccgtttctaccaatcaccgagtcagacaccagtccctcgtcgacctcaacaccccatgtctctacctcgtctacgccttctcatccctcatcttcctgaagaaatccataaccccggtaaacaccacgaggagaataccaccacccggtcccaacctcaacaccttgggcaagaaccccttgtacctgcccgggcggccgctcga

SEQ ID NO: 101766 - DNA, 169 bp, Triticum aestivum
  Clone ID: PAT_TA_101766
tcgagcggccgcccgggcaggtacataaaatgttacaaccaggcaccagcaccagcacaagagtgctctttcagagtgacaagactaaaaatacagacctcgtggaatcacagaaaatggcatccaaagccaatacaggaaggccggaacctcggccgcgaccacgcta

SEQ ID NO: 101767 - DNA, 524 bp, Triticum aestivum
  unsure (1)..(524): unsure at all n locations
  Clone ID: PAT_TA_101767
tagcgtggtcgcggccgaggtacatttccgcatctcatagcttacaaaactttccgatctcatgaccnnagaaaacgaattgggtcaaaggggtatcgtgcaactcctcctcattcccacctctcagttcacatcgcatccgcatgaaagatcgcatccgcatcaaagaccagcgattgaaccccatcgcatcctaagaaaccccccctgcgttccatactccacaattccaagaaactcccgcaaagagtcccacccgcccaggatcgattcgaagctcactaacccacgaaccgctccagcgccagagtctgactcaaactatttccccgactccttcccccacccatacccttcagacttcccttcctcgccaatggacttgccatcgcgcctttcctcacgccagcagcaagcacagcacccaggtccgcactcgctctctttttccgagccggcgtcatnnncgccatagccgcgttctttctgcctttctgcagcgcattcgcctgactcgtcaccnn

SEQ ID NO: 101768 - DNA, 454 bp, Triticum aestivum
  unsure (1)..(454): unsure at all n locations
  Clone ID: PAT_TA_101768
nnnngggaaaaaaaaaaaaacccttttaaaaaactttccctttttttttcccccggtttggggagggggccgggccgttttacnctatttttccaaggaaagaaactggtcccccccggggggccccaacaaaaacccccccccgggcccacaaaatttggggacaagccccatttttgggccggtttaaacggggggaaacttaaacgccccccgggccttttgggaatccaaccctttctggaaaaccctttttggggggaaaaagttttttaatcccaaccccgggggggtaatcgggccggggcccggggaaaaacccgggnncaaaaaaaagccccccccccaaccccccaagaaaggggcgggggggggggacccaaaaaaataatttccccggggcccaaaggggttggccnaacccaaaacccccggtttggggggggggccccct

SEQ ID NO: 101769 - DNA, 542 bp, Triticum aestivum
  unsure (1)..(542): unsure at all n locations
  Clone ID: PAT_TA_101769
tcgagcggccgcccgggcaggtacgccgtcagccaaggcgaaatcagcctgcgatggtgcatcgaccaggacatcgtggcgttgacgacgtcgagcaaggagcagcggctgagcgattacctgcgcgcgatgaagttcaagttgacgcccgtggagatcaagcagatcaacgagctgggcagccagaagcactaccgtggtttctggaatcacaagatcgacgagaatgatcgaaggtagacgggaatagcgcaccaggattcaagaatcgcgagactcgagtcctaatcgctaccagaccatcgctgtcgtccttcgccgtccttcgtcgtccttggcattgatgttgctataggcatcctcttaatttgctgatgatcggaagtagatcgaggtcacgaggagacacgtgcggatgtccggtcgtggaggctggagtggcagggaatgagcgcagagtctgtaatccaccggctctcgagtctttctgcagttgtatgtctttctgcagttgtatgcaattccggctgtgtctattcnnn

SEQ ID NO: 101770 - DNA, 437 bp, Triticum aestivum
  unsure (1)..(437): unsure at all n locations
  Clone ID: PAT_TA_101770
nntttttttttttttttttttttttttgggggaaaaacaaaaaccccccttaaaaatttggagaaaaaccccgggcgggaacccccctaaaacttntnaaattccgggcccccggggggggacccaatgggaaaaccccccaccccgggggaggcaaacttggggattttaaaaggggacccaaaaaacctgggggaaaaaaggggaaaaagggttcccgggggaaaaaggtatccccccccaaatccccccaaaaaaaaaaccgggaaaataaaagggaaaacccgggggggccaaagagggaaccaacccccaataattggggggggcccaccggccccttttcaaaggggaaaaccggggggccccctggtttaaaaaaaacgcccaccccccggggaaagggggttgggtnatgggggccttttccccttccc

SEQ ID NO: 101771 - DNA, 494 bp, Triticum aestivum
  Clone ID: PAT_TA_101771
tcgagcggccgcccgggcaggtacaccgagccgaagcttcctgcaccaaggaggttctctgaagcaaaaccattagttgcagtgactagttcagcataagaaaccctcaaatattgctcgtcgatggatgatgtctgcatgtttgctttcatcttcctgctcttactgtagaatgtcgacagtgcaaataccaatgcaataaatacaactgcaccacatatggagaatattatggccagcttctgagttggtttcttggtggtgaggttggaacagtgtggcagtttcagttgagggattccattacacagaccatcatttcccataactgaggctgaggcagaagctgcgttgctgaagatcccatctgttggaacccgggcaggtactttgtgtgtttatttgtacaagcttttttttttttttttttttttttgacctcaaatatctcaaaatgctgagcagaactcaggacctcggccgcgaccacgcta

SEQ ID NO: 101772 - DNA, 232 bp, Triticum aestivum
  unsure (1)..(232): unsure at all n locations
  Clone ID: PAT_TA_101772
tcgagcggccgcccgggcaggtgtttcgattaagtcgacgcgaatgagagttcacaacagactgttgatggctgaacgatactnnncgtgtatcatagtttcctttgttcggttttggccgcgggtgttctgggatcgtatataggttagtctactagttgctgatggctatccggcagcccatcttgtcaaaattcagaattcaaattcaaaaaggctgaaaaaaaaaaaa

SEQ ID NO: 101773 - DNA, 342 bp, Triticum aestivum
  Clone ID: PAT_TA_101773
tcgagcggccgcccgggcaggtgtgcaagggatccgcaaggacgtcggcgagggactggaggccacggatgagcaggcctggttcgatgagaaggccaaggtgtgctgggagaactcagaccctactgcggccccaatttacgaggagcgtgtcgagtattagagtgaatcaaaaacgctttggaagtgggaaggtatggaacgatgaaggagcagcgttttttacttttggtcatggtttgctgtttttaatgttttagtgttctcgaacgatacttgataccaccacggcagttttagagagagagaaatgcaatcagtgcaaagagtaaaaaaaaaaaa

SEQ ID NO: 101774 - DNA, 349 bp, Triticum aestivum
  unsure (1)..(349): unsure at all n locations
  Clone ID: PAT_TA_101774
tcgagcggccgcccgggcaggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtacccgcagtcaataataccgacaattaattactaatgttctcctgtaagcagcatggtgcaagcatgattaagttttcagtgcnn

SEQ ID NO: 101775 - DNA, 269 bp, Triticum aestivum
  Clone ID: PAT_TA_101775
tcgagcggccgcccgggcaggtccgggcaggtacttggtcacacttcgcgatcagggcacacccgcacagcacgagaagtatctcaagccagccgagaactttgagcacattggatgttatgctcagaccgagctgggccacggctcaaacgttcgtggtctcgagactcttgccatctggaatcctgaggaccagacctttatcatccactctccacacttgacgtcctccaaatggtggatcggatccctcggccgcgaccacgcta

SEQ ID NO: 101776 - DNA, 443 bp, Triticum aestivum
  unsure (1)..(443): unsure at all n locations
  Clone ID: PAT_TA_101776
gggtaaaaaaaaancactgggccccnncaaggaaagggcccccccccccccccaacaaggggcccccggccggaaccccccaaataacaggggaattccggcccccccccgggccaccctatgggaaaaccccccaccccgggggggccaaacctggggtttttataaggggacccaaaaaacctgggggaaacaagggcaaaaacgggtcccgggggaaaaaggtattccccccaaaatccccccaaaaaaaaaacccggaacaaaaaagggaaaacccggggggccccaagagggaacccacccccattaattggggggggcccaccggccccctttcaaaggggaaaaccggggggccccccggattaaaaaaancgncnnncccccgggaaaaggggggtggggattgggggccctttccccttnncngtnnaaaannc

SEQ ID NO: 101777 - DNA, 209 bp, Triticum aestivum
  Clone ID: PAT_TA_101777
ttcgagcggccgcccgggcaggtgtgagcgcagtcagctcaacctctaggccgacaacttcatggctgatggatgctgctgcatgtgtgtcgtcgtcgatctctgcttcttcccgttctgagattgagtagtccggactgatagatgttgcatgtgagggcgattcgagatgaggagttggtgtgtgtacctcggccgcgaccacgcta

SEQ ID NO: 101778 - DNA, 169 bp, Triticum aestivum
  Clone ID: PAT_TA_101778
tcgagcggccgcccgggcaggtacagagcagaagcttcctggcgtgcttctttacaaggaaaagctctcctaaatgctcccaggcttatttttttgcgatacagactgcaaacacttttacagactataggatctgcctgctactcaaacctcggccgcgaccacgcta

SEQ ID NO: 101779 - DNA, 274 bp, Triticum aestivum
  Clone ID: PAT_TA_101779
tagcgtggtcgcggccgaggtgccgcaagaagtcgacgaggtgcgtgcgaagcagatcttggagatggaagatcttgagatactggtgagactggaagatggtccaccggaagtggaagagcaagatgcggaagggaggaagcgagcgccaagaaccgtcaaggaagcagtcttctggacatgcgatttcagccacgagtatgtcacgatcaatggtgactacaggacgtgagtggtctcagggtcttgcgtacctgcccgggcggccgctcga

SEQ ID NO: 101780 - DNA, 180 bp, Triticum aestivum
  Clone ID: PAT_TA_101780
tcgagcggccgcccgggcaggtgccggcttctatgctctacactaggaacgtcggtgccgactccggaaacgggttcaatatgtagaccattttcagtggatgatgctcctaacaatcgatctgtttactgagttaaatctctactcctaatataacagttggtgaataaaaaaaaaaaa

SEQ ID NO: 101781 - DNA, 257 bp, Triticum aestivum
  Clone ID: PAT_TA_101781
tagcgtggtcgcggccgagcagcagaatggtgccgccgaggaggatctttacgaataagtgctagactgatgctacggtaatgggatggaagatatgagtctcttcagcatgtcatacaggacttcgtcgtcgccaatgggcacaggaagtggacttgcatggaggcagtgacacgtttgcgatgatagaatgttccaatagctcgcctcgaggcgaacagcaattgaaagcatgtgatctttcgaaaaaaaaaaaa

SEQ ID NO: 101782 - DNA, 355 bp, Triticum aestivum
  unsure (1)..(355): unsure at all n locations
  Clone ID: PAT_TA_101782
atttaanagggttcattggccccctttttcgtttaaaatttgtttcccgatgcccccccccggccaaaaaacaaggaggggggaaaaacccccccaaccaacccaaaaaacggggggaaaacggaaaacaaaaagggcaaaaacccggccggatttccccccatggaaaaacaaggaacaagttggggaaggggcccccccccgttatgggtctaaccgttttagggggggaaccccgctttttttatatctttttcggggggggagccccctttttttatttcaaaaaaaaaaaaacaagggtctgaaaagctccaaaangggctccggggccaggttccggaaaaaaaacttt

SEQ ID NO: 101783 - DNA, 625 bp, Triticum aestivum
  unsure (1)..(625): unsure at all n locations
  Clone ID: PAT_TA_101783
tcgagcggccgcccgggcaggtactttattttaactccataaaatagtcctatataaatcaagaatttttcttattcttcaattgccccaattaacttaataaatttaataaaagtctatagggtcttatcgtctagtaaaatctaaagagtattttcactatcattccaaattcaattaatctatttatacaatatttctttgttcaacctttcattccattccttaattaaaagactaatgattatgctacctttgcacggtcataataccgcggctcttcagatccaccagtgagcaggttatactttaaaactaattttaaagaaatgtttttgttaaacagtcaaaaaaaaattgttgaattcattaatcctcccttataataatatttaaactaaaatttatctactaatttttaaattgttataaaaatattttcgtttaattatacaaagcccatattttctaaattaatcataaatttcataaatcacttattaaattttaattcactttataaaacactataaattctttttataattaaatactaaaattacaattatagacaataatcaagataatccccaattatattttttatcagncactattattgacn

SEQ ID NO: 101784 - DNA, 567 bp, Triticum aestivum
  Clone ID: PAT_TA_101784
tagcgtggtcgcggccgaggtactcaagtgacaaatttaactaattaacacatacaagaacatagagtcacatgccccaacaccattcacatatgaccgatctaacactacaggaacacaagtctgaaactgagcagtaagtggacgcttgagagaaggtagcagcagcagcgtttgggagattcagagaagaagcagggaagcagcggaaggaggaggttcagatcagaggttcagctagtgaggaacagcaaggggcgcgggagagaagaagtagcagttttaagcagaggagcagcagaagtggcgtggggaaagaagagcagcaacaggttgaagataaaggagcagcagtaaggaagttcactagggatcagactccatgatacccttgtctggtccagggcatgagtagcaaggggaatcagcagggagaggaggcgcggttgcactggtggatggaggttgctggcgctgggtggaaggagatggtcgtggccggcggcgccgtgctgacggtgcaggtcatcaacgccatggccggcaactccgacttcgtctacatga

SEQ ID NO: 101785 - DNA, 478 bp, Triticum aestivum
  unsure (1)..(478): unsure at all n locations
  Clone ID: PAT_TA_101785
ctttttgtttttttattcttgtttttcttttgtttctttttatattatttacccgtgctcgatccaaataaacgactcgcctccaacatcatggaaacccaccattcaccgcaatgaccgacaacaacacaacacaccagtcacgcgaccaccacacaagctcggcaagctgaaggaaggatacgatacacctgacagcgccttggaggctggcgttcaatgcacacggaccactgcaacattactgggtgcggaggatgaatgggatggatttggcatcgacgaggtgtcaatccaggcagcgtttacttgaacaacaacaaactgagtcccgagagctctaaaaccggcagttggcttccgattacggcgtgcctttgagacttgaggattggctctagcagttagcttttttgtcaaatgaagcttctatctgctgaaaaaaaaaaaaaaaaacctnnccnnggcggccgctcga

SEQ ID NO: 101786 - DNA, 361 bp, Triticum aestivum
  unsure (1)..(361): unsure at all n locations
  Clone ID: PAT_TA_101786
attaaccgggtggcatatatttctttgaaacagggaatggcaaaataaaaatatacaggactgcatacatatttatgggtttgcctacatttttttgaaacaggaaataacaagataaaaaaatcccctgcatactttgaggtttggctgaacatttgggaattaacaaagcatcggtcaatattacatgtccaactggactttttagggtcattttacccaaacaaatgtaaaatggaattaccattagggcatcaacatcaattggcaggaacatcagttgaggataattttttgacatttcaacataaacaggggcaatgacacggcatggcctatggaaacggngccctttttgacc

SEQ ID NO: 101787 - DNA, 193 bp, Triticum aestivum
  Clone ID: PAT_TA_101787
tagcgtggtcgcgccgaggtacaagccctgctcgacgagaaatacatctgatctgagcacatgaacactatagcagggcatccaagcccggacgcacgcacgcacgcgcacacacacacaatgggaaacagccaaacatccaggccgcatctcctccgtagtataggatcgacctgcccgggcggccgctcga

SEQ ID NO: 101788 - DNA, 267 bp, Triticum aestivum
  unsure (1)..(267): unsure at all n locations
  Clone ID: PAT_TA_101788
ttcgagcggccgcccgggcaggtacaagcagaagaagctcacacacgcccagaggcaagagcgtgtgcaagagaagatcaaggctcttaccagctagatgtggatacttnntactcgagctttgcgatctctgtgtcgacaacgctcccaccactgtttcagcgatgggcgttcttggcatgattaaggaaaatcaatcgaggatagcatgtcgagggacaatgagatatgcagaaatacgatcaaacgtcacttgtcacttgtcgc

SEQ ID NO: 101789 - DNA, 368 bp, Triticum aestivum
  unsure (1)..(368): unsure at all n locations
  Clone ID: PAT_TA_101789
gggccccccgggcgggaacccccctaataataaagaaaacccgggcccccggcgggggaccctatggggaaaccccccaccccggggggggcaaacctggggaatttataagggcccccaaaaaacctgggggaaaaaagggcaaaaccggttcccgggggaaaaaggtatcccctcacaaattccccccaaaaaaaaacccggaaccaaaaagggaaaacccgggggggcccaagggggggccaacccccaataaatggggggggcccaatggccccttttcanannngaaaaccggggggccccccgcctttaaaaaaacgcccaccccccgggaaaagggggttggnnaatgggggccctttnnn

SEQ ID NO: 101790 - DNA, 481 bp, Triticum aestivum
  unsure (1)..(481): unsure at all n locations
  Clone ID: PAT_TA_101790
cctttttttttttttttttttttttttttttttttttttttttttttttttttttttaaaaaaaaacctttgggggggcctatttttgggcccaaaaaagggcccccccaggggcccccaattgggggggggggttttccaacccccccccaatttttctttaaaaaccatgggccctttcctttccggggggccaaaaccccccaaaaggggggggccccctgggcgggttggaaacggcccctcgcccccaccccccctatttcttttgaattccccgccccccggcgggcccccctttggggaaacccccccccccgggggaccccaacctgggtttttctttagggcccccaaaaaacctgggggaaaccagggccaaacctgttcccgggggaaaatggttccccccccccattcccccccaaaatccaacccgaaaccaaaaagggaaaccccggggggccnnaaggggggcncn

SEQ ID NO: 101791 - DNA, 188 bp, Triticum aestivum
  unsure (1)..(188): unsure at all n locations
  Clone ID: PAT_TA_101791
tcgagcgcccgggcaggtcgccgcgcctgtgaggcaactgcttcatcccatgcgtttttnagaaaaannnaattaatnaacnntttatatnaagaaaaatacactatacannnattttattcantcctgggtgccaatcatatcacctnnnctggaagttttgttgtacctcggccgnnnccacgcta

SEQ ID NO: 101792 - DNA, 346 bp, Triticum aestivum
  unsure (1)..(346): unsure at all n locations
  Clone ID: PAT_TA_101792
ttcgagcggccgcccgggcaggttgtttatgttttatcgaaaatgcnnnnncacggatgaataccggctgattacgggcccttaacgctaaatatctccctcccttctttttcnnnggatgggccctgttgacaccnntattttgacatggtcaaaaatataaacnnnanngccttaaatgaaaaagtgcttaaagtgataaagtcctgtatccacaaacaaataaactttgatatttgggcnnnagccatctgatcttatctctaaggccgaagttgtgttcgaaatattgacattttgtattcannccactattcggctgattactccccctaaaaaaaaaaaa

SEQ ID NO: 101793 - DNA, 320 bp, Triticum aestivum
  unsure (1)..(320): unsure at all n locations
  Clone ID: PAT_TA_101793
tagcgtggtcgcggccgaggtaaaaaaaaaaagcttgtacaaaaaaaaagcttgtacaaaagagctcgttgctcgtgctaagcagctcggcgtcaaggtcaccaacggcaaggccaagatcacctccgagtcgtagatggagcgagtgggagttgttatggtgggcgacggatgacgaagggcgagcaggaacggaacggcgtctcaaaggtgcatgggaggatactgcatttcgtagctggccaaatctgaagagccggttttatctgcgtaaacaccgccaacgcctcgctagagtaccnnnnnnnnncgnnnnnnca

SEQ ID NO: 101794 - DNA, 254 bp, Triticum aestivum
  unsure (1)..(254): unsure at all n locations
  Clone ID: PAT_TA_101794
ccccccccccgccttttaaaaacattgaaaatccaaaccccccgggtaagggacccccggccaaaaatccttacccggccttatttatngcccatgtccccgtcaatcaccggggcccccataattgatcggaaaccggaaggcaacacacggccatntaaaaaatgtccaaaggggaaaatcgggggcccccgttnattaaaaaaaaacccccaagtgggggcccccctcccggttgaaggcgggggggnnnn

SEQ ID NO: 101795 - DNA, 209 bp, Triticum aestivum
  Clone ID: PAT_TA_101795
tcgagcggccgcccgggcaggtacacatatactcctgagaagtcgattttcatgtgtttacttgccgggcacaaagttggtggcgaaggcccacgcgttgttgttgacagggtcggcgaggtggtcagcgaggttctccagcggacccttaccagtgacgatggcctgcacaaagtatccaaacatggacctcggccgcgaccacgcta

SEQ ID NO: 101796 - DNA, 233 bp, Triticum aestivum
  unsure (1)..(233): unsure at all n locations
  Clone ID: PAT_TA_101796
aaaaagggcacatccacgtaaacttatttttcacgccgctgggtatgacactaccagcagggaaaactgacaacagactgataggaaaagcccaaggcaaggcagcaggggggcatcaacaaatacatgccttacacatatagactactcagctccttccttccttttggtccctaggactgagggagttcccgcccctcgcgcctttgtttcgttgcgccaacatttgnnnt

SEQ ID NO: 101797 - DNA, 247 bp, Triticum aestivum
  Clone ID: PAT_TA_101797
tagcgtggtcgcggccgaggtactcgacgtagacgccggaagatccgttctccttgatgaacttggagagatccgcaatggagcggtcgccgtcgtaggcaattggagcgtccttggagccagccttgaagagcttgatggtagggaaaccctggatctcgtctgggacgtcgttggcggtagcgtcgaccttggcgatgatgatcttgtcgaggtgaggcttgtacctgcccgggcggccgctcga

SEQ ID NO: 101798 - DNA, 235 bp, Triticum aestivum
  unsure (1)..(235): unsure at all n locations
  Clone ID: PAT_TA_101798
nnnaaccccccgtttgttttaaaatacaacccccctttttcaacccttgttgttacataaacatggccttccccttttttttaggaccaattaaaaaaaacaaggggaaaaggaaaccccaaagcatggtcaaagttgacaaaacggcaagggccttttatttgggccccggggggaggaacctgttaaggccttgccgaactccncaaacccggggggtttaaaggcaataaac

SEQ ID NO: 101799 - DNA, 323 bp, Triticum aestivum
  unsure (1)..(323): unsure at all n locations
  Clone ID: PAT_TA_101799
ncaaggaaaaaaaaagtttgaaagggatattattaacttttacacacccaaatttgggaaagtttaacctgggcctgggctaaaaaaaaaaataaatttacctttcggggaacccatggggggaaaaaaaaggggggaaaaaaaccttttttttaaaaggggggggttaagaagcctttttggaaaaaacaaacctaaaaaccccccttgaaggcttttaaagggctttctgaattgaacccccccgggtggaacccttttggtaacctttcaaagggggaaaaaagggccttcaaaaaaagaacccaggggtttttcccaaa

SEQ ID NO: 101800 - DNA, 488 bp, Triticum aestivum
  Clone ID: PAT_TA_101800
tcgagcggccgcccgggcaggtactgcgcaaactgctgaggattcctcgtctgcatgaagacagttccagggcccgtaaatttgcagaccagcccctcgccagcactcaggttactgatgataccgccactagcgacacgctccagcacgtagtcacagttccaggctacaagatgcccattgtcgatgatatacttctctccgtccctcaggtccttccgaatgattgcacccatactctggatccagcagattcccacaccagcaatcttgtaaatgaagaagccttctccggagaacatggccttgctaaagttctgcgacacatacgtcttcgtcacgccctgcgtgctcgccaaaaacgcatccttgccgacactccactgctcttttccggacaacctcaaattcgtgatgtcacccaatgcgaacggcgcgagcaacaattctcccggtccagtgaaggtacctcggccgcgaccacgcta

SEQ ID NO: 101801 - DNA, 233 bp, Triticum aestivum
  Clone ID: PAT_TA_101801
tagcgtggtcgcggccgaggtctccatcgactgcttctactcggcatctcaggacctctcatgcctcctgcgctgcgaaacccagtggatagctctgcaatgcatccacccggccatgtattcagtctggcgcctgtcccaactatcgcccttgccacatctcaaccatacttccgtatgcccgtcaaatctccagatcaatccccaagtccaacacctgcccgggcggccgc

SEQ ID NO: 101802 - DNA, 344 bp, Triticum aestivum
  unsure (1)..(344): unsure at all n locations
  Clone ID: PAT_TA_101802
tagngcggtcgcggcnncannncactgtttttatcgttgatgaaacttattaataattcagtgatttgtgttccgttgatccatgatatttctatagcctgacttctttccccaaattcagatggaacgtgtgcttataattaagggctttgctgcttgtcggttcagttgtctgtctactcactggtcatcttaattcagaggaatccgcaccaggagttgctgtaaaaataccgcgacagccaacgtataagaaggcgtagtgattaaataaataaatatgtttatagctaggaatttggtgtgttgtggtttgctcccgttgtacctgcgcgggcggccgc

SEQ ID NO: 101803 - DNA, 386 bp, Triticum aestivum
  unsure (1)..(386): unsure at all n locations
  Clone ID: PAT_TA_101803
tncnacgggcggccgggcaggtactatacaaacnntnangatgcaggntcttacncctatgctgactgctgagtatacattaagttnnntctgccctgaacatttgaggttctaccaatgaanncataacaaacggacactnntgtcatnnnncacgtannattaacttgcaaatggtgattgcttatatttttgacaaactgatgaagggaagaagcctaactacactactacggagaagtgacgttgctttcatctccttcctcgggctcgagccctgcccatctgatcatggagaagaggaactccttgaggttcaccttgccgttcttgttcnnntccatctcctctgcaacaaggtacacacctcggcngnnnccacgcta

SEQ ID NO: 101804 - DNA, 402 bp, Triticum aestivum
  unsure (1)..(402): unsure at all n locations
  Clone ID: PAT_TA_101804
tagcgtggtcgcggccgagatacgaagatctgtgcccatccacccacaacatggatgtgcccaacgtctcccgccgcgaattccagttgctcgacatcaccgacgatggcttcctctccctcatgaacgacaacggagacaccaaggatgatgtcaaggttccagatggtgaggttggcgacaagatcaacaagctgttcaaggaggaggagaaggacaccaacgtcattattctcaccgccatgggtgaggaggctgccatcgatgccaaggaggctcccaagggtgcttgatcgcattgcgattcaattccaatataagtgcctgtggagaggtcgggagattacttatggatatacgggagcaatgagcgtggcatgagttggtgttttgcaagcggnn

SEQ ID NO: 101805 - DNA, 302 bp, Triticum aestivum
  Clone ID: PAT_TA_101805
tagcgtggtcgcggccgaggtgccgctctttctttccctgttttttggtttttagtattaatgtgtatgagagcagtgtctttcgctgcggaggaaagaagaggggactggaggaatggaggaaggtctggagatgggcaagatgggaggaagaaagagagggaggaaagggatgggatcgatgaagaggggaaaatgaggagcagtgggtgtaaggaggactgggaggactgaggggacggccgagtgaatctctggcataggggacggggttgtgtgttggtacctgcccgggcggccgc

SEQ ID NO: 101806 - DNA, 655 bp, Triticum aestivum
  unsure (1)..(655): unsure at all n locations
  Clone ID: PAT_TA_101806
tagcgtggtcgcggccgaggtacattttcatgacaatctactcactgtgccacggtctcgcctccgaccgctaccaaaagcgtttctggttctacgtttacccgatcccaatcgtgctggccggagcactggtgtttatgttcactgaatccttcggatcgcgatacttcagtctgttcatgttgaactttgttttcgccatgaatggaacgatctacgcctggattgcaaacggcattcctcgtccgccagctaagcgagctgctgcactcgcatttattaacagcgtcggtaacgccgcctcgatctggacacctttcacctacaacgacggcgacagaccttactaccggtccgccatgggcatcaatatgggaatgacagttgtcgcgggagcttctgccgttgcaatgaaattcattcttgagtcgcagaatcgccagcttatccgcatggaaaacgaagacacgccgctgacggacaaggacatgaggaaattggaaagaacagccgagattgagggcattgatatcgccagcgcaaggatgttgcagnnnngctatcggtatattgtctagcgttcctggacacgaaagactatgattcgacgaccaaggagtagncgacttgtatcatatgatgatcttgaaannnn

SEQ ID NO: 101807 - DNA, 494 bp, Triticum aestivum
  unsure (1)..(494): unsure at all n locations
  Clone ID: PAT_TA_101807
nnttnntttttttnnnttttttttnnnttttttttttnnnttttttttttttttttaaccggaaaaaaaaagggggggcaccaaaaaccaaaacggggccttataacccccccaaaaaaaaacccgcccgggggggcggtaaaaaaaaaaaaaaaatcccggccccccggggggccaccataggggaaaaccccccacccgggggaggccaaactggagttttctaaaggggcccccaaaaagcggggggaaaacaggggcaaaacgggtccccggggaaaaatggtatccccccacaattccccacaaaaaacaaaccggaaacaaaaaggggaaacccgggggggcccaaagagggacccaacccccattaatgggggggccccnnncgccccctttccaaaggggaaacncggggggccccctggattaaaaaaaccccccccccccggggaaaggggggttgcgtatgggggccttttccccttccnnnn

SEQ ID NO: 101808 - DNA, 465 bp, Triticum aestivum
  unsure (1)..(465): unsure at all n locations
  Clone ID: PAT_TA_101808
nncctcgggcggaacccccttttttttttttaaattccgggccccctggggggccaccttttgggaaacccccccacccgggggaggccnnnnttggttttttttttggggccccaaaaangttgggggaaaaaaggggcnnnnntttttcttggggaaaatttttttcccctcaaaattccccaaaaaataaaagccggaaaattaaagggtaaacccgggggggcctaaggggggacccacccccctttttttgggtgggcctcactgccccttttccaaggggaaaacctttggggcccctttttttaataaatccccccccccccggggaaagggggtttggtttttggggcctttttccttttcnngntaaataaatnnntggcctgggggtttggggtggggggaggggttttattttttttaagggggggatttcggttttccccaaaattgggggat

SEQ ID NO: 101809 - DNA, 181 bp, Triticum aestivum
  Clone ID: PAT_TA_101809
tcgagcggccgcccgggcaggtactcgcaactcaggcacctgctacggaccggataccgacggaggagcaaagcacgtcggaatgtctttctcaccaaggtccaccactatgccacactacactgctccacaaaggtgcaataccttctagttctgaatgacctcggccgcgaccacgcta

SEQ ID NO: 101810 - DNA, 486 bp, Triticum aestivum
  unsure (1)..(486): unsure at all n locations
  Clone ID: PAT_TA_101810
ggnnnnncaaccgaaaaacggggcccctttttccctccccaacccccaatttttttngagggcaaaaaaaaacccctttgggtttttaaacccccaaacccccccttttattttcttttgtgggttaaaaaaaaggggtgttancttttttttcccccccccttntttatcccccccccggaccccctttttactggggtgggcccccccnnccgggggggcnnntnnnaactanngaaatcccgggcccccgccgggcccccctttggggaaaccccccccccccggggggcccaacctggggatttttttagggccccccaaaaacctgggggaaacatgggccaaaccggttcccgggggaaaatggtttccccccnncaattccccccacaaaccaacccggaacctaaaagggaaaacccggggggccccaagggggggcccccccccctttattggggtgggccccccggccccttttcc

SEQ ID NO: 101811 - DNA, 386 bp, Triticum aestivum
  Clone ID: PAT_TA_101811
cccgggggcggccccttttttttttcaatcaccccagcaggggggcaagggttccaaaaccaaacaatcaaattttttttaacaactttttaatttaaatggaagggaaaaaaaaaccccaaaaaaagggcttgaaccccccctattaaaactgttttcacaaaaaaaaaaaaaaattggggcccaattaacaaaaaaccccccaaaccagggcaaagttcaggggggcctaaaatttttggcccccccctacggccattagggtcccccccgcccaaaagctgcccccataccctttggtttttccccccattatgggggggttcctcacccccaaaaaaagttttaaatttttccgacggaaggggggggcaattttccccctg

SEQ ID NO: 101812 - DNA, 289 bp, Triticum aestivum
  unsure (1)..(289): unsure at all n locations
  Clone ID: PAT_TA_101812
tggtcgcggccgaggtacggctgttgaagctcgcgtgttcattctgcaacccatcnnngatcangggccgcgagctgcacaatttctcgaaactccctgctgttgaagctcgtctccttgggtcttccagctgtttactgctgggcttcctcttccggcttggtgatgaacgagtagccgctgtcgcgagggtagtcgtatgcctcgtctcgcttggctttctgttcagtctcctcttccggcttggtgatgaaagagtagccgcaccnnnnnnnnncnnnnngctcga

SEQ ID NO: 101813 - DNA, 322 bp, Triticum aestivum
  Clone ID: PAT_TA_101813
tcgagcggccgcccgggcaggtgctcgcaaaagccgttttgctaatgtgcccctacttccagctgtcttctccagacaccttgaaaggccaacagggatgctatggaacaacgacaagcttgcacctcatccttcaaagaagagtaagtttgcaaggtaaagacttgggagtatggttcgctcaaatcgaagatgatgtttgtcaaaggtgcaacttttgggattctcaaaccgaagatgatgtttggtgcggtgcagacagaaatgtgggaaaatatcatatttatgtgatgaagatgatgtacctcggccgcgaccacgc

SEQ ID NO: 101814 - DNA, 176 bp, Triticum aestivum
  unsure (1)..(176): unsure at all n locations
  Clone ID: PAT_TA_101814
ttcgagcggccgcccgggcaggtggttgagagtggtgtgattccnngcgtttcgggtggagtttttgatttgatttgaggcnnatggtcggtgaatagctgaggtgtgggcgatcaaggcgagaggaactaccatactccaaaatgcaaattctgtctttgatcaaaaaaaaaaaa

SEQ ID NO: 101815 - DNA, 226 bp, Triticum aestivum
  unsure (1)..(226): unsure at all n locations
  Clone ID: PAT_TA_101815
nnncgtggtcgcggccgaggtgtatcgcatgcgcattgggagaggtcgggcctgttgggaggcnnnngacgagcgaacaaaacgtattcactcgaggcctnnntccggctttcttccacacgagggttatgttcaaggcgtgctgcacggatgggggcttgcttctgggcttttttcgtgtctctcgtcatcacaaaaattgaaagagtttcacaaaaaaaaaaaa

SEQ ID NO: 101816 - DNA, 452 bp, Triticum aestivum
  unsure (1)..(452): unsure at all n locations
  Clone ID: PAT_TA_101816
nancaaaccaaaaaaataagggttttttttttggaaaaaccccttggttnnacaaaaacaacagggggggcaaccccctttccccaacccaaaatcgggccacctttcaacnnnttggatcccccggtttgccaaactgaaaggggaaaagaccctgggaaacggaaagaacccaccccgggcgggacccccctaaaaaataaggaaattcggggcccccggggggccaccctttgggaaaaccccccacccggggggggccaaacttgggtattttaaaagggcccccaaaaaactggggggaaacaagggcaaaactggttcccgggggaaaatggtatcccctcacaaatnnccacaaaaaaaaaaccggaannaaaaaagggaaaacccgggggggccaaagggggggcccaccccccttaattggggggggcccaccggcccctttc

SEQ ID NO: 101817 - DNA, 324 bp, Triticum aestivum
  unsure (1)..(324): unsure at all n locations
  Clone ID: PAT_TA_101817
tcgagcggccgcccgggcaggtaccctggcgnctgatgncngnnnnnnntgnncttacaacatgcgccaggtgcagtgcgtcagcttcattgccttcaggccaccaggctgcgaggaatctggcaaggcctnnagtgcgagaccnannnncacatatacatgccatgnnnnntcacatttgtcagcatctgtgatatctccgatctacttgtaggtctactcatatgtgaatatatgagcatatgtatgtaagngcctaccaacggnngtcgaggacgatgcgtatgaaaattacaacactggctatacctacacacatatatt

SEQ ID NO: 101818 - DNA, 338 bp, Triticum aestivum
  unsure (1)..(338): unsure at all n locations
  Clone ID: PAT_TA_101818
tnncgtggtcgcggccgaggtactgtcatcggattatcggtttgagatgtattttaaggatgctagaaaagaaaacagccgtggatttcgtgaggtgaccctaaaggctgtatgtgcaacaacgtgtgagaagacgacatctgaggttagttgttggtcttgatggatttgaacatgatcaaatagacagtggctnngatattatacttttttccgtatgtttcaccttctgttttcggcctgagttggtgcatgttttgagcaaccatgcttacttcaggtcatacttcatgatgattattactannnactanggtcaatggatgtgcaccctannn

SEQ ID NO: 101819 - DNA, 401 bp, Triticum aestivum
  unsure (1)..(401): unsure at all n locations
  Clone ID: PAT_TA_101819
gggggaaaaaaaaannnccctttttaaaaatttttcttttttttttcccccgttttggggggggggccggggggtttttcnttttttttccagggaaaggaaangtttcccccgggggggccccattaaaattcccccccggggcccacaaattttggggaccanccccttttttgtttcggttttaaaggggggaattttaaacgccccccgggtcttttgggaattcaaccttttttgggcaagcctttttgggggggaaaggtttttttatcccaaccccgggggggttattggggtggggcccggggtaaatccgggggccaaaaaaatggccccccccaaaccccccagggagggggcgggggggggggtccccaaatttttttttccccggggcn

SEQ ID NO: 101820 - DNA, 290 bp, Triticum aestivum
  unsure (1)..(290): unsure at all n locations
  Clone ID: PAT_TA_101820
nnnaannncacaagctttcntnnnnacaaaaattcgtttacaacatagncnnnncttggaagaaaataaaattcnnaaagggaaataccgaatagttgcctttgttcaggcttttacagctcaaatcacacacaaaaatttgcaggaagttgttaattgatgttgtttgccgaaaaacgaccagggggacccancagcatnnaaacgggtggccggagccaaggggcgtatgaaacctgtacaataaaccggcaacgccccgaatggggcccaggaacattgccatgggc

SEQ ID NO: 101821 - DNA, 451 bp, Triticum aestivum
  unsure (1)..(451): unsure at all n locations
  Clone ID: PAT_TA_101821
gggggaaaaaaaaannacccttttcaaaacctttcccttttttttccccccggtttcggggggggggcgggcgtttctacnctattttccccgggaaaggacctggtcccccccggcgggccccggcaaaaacccccccccgcgcccccaaaatttggggaccagccccatttttggccccgtcctaacggggcgaaaccaaaaccccccccgggccttttggggatcccaccctttctggccccccccttttggggggaacccgttttttaaccccaaccccgggggggttatcgggccggggcccggggaaaaccccgggncaaaaaaaaangccccccccccaccccccaagaaggggccggggggaagggcccccaaagtatattttccccggggcccaaaggggttggccnnacccaaagccccagttttggggggggggcccctt

SEQ ID NO: 101822 - DNA, 275 bp, Triticum aestivum
  unsure (1)..(275): unsure at all n locations
  Clone ID: PAT_TA_101822
tcgagcggccgcccgggcaggtcggactcggacgtccttaacnnngtgcaagaacggtttgaggtggacatcaaggagctgcctgagcagattgacacttaacatacatgccgtcgtagacccgcgccgacattgcaaggaggacggaaggagaagatggaatccttgaatgttttgcttgaagtgatgctgttttttgcctgccctgccctgccctgctgccaagggagggaggcagcaggatcagcagctgtacctcggccgcgaccacgcta

SEQ ID NO: 101823 - DNA, 349 bp, Triticum aestivum
  unsure (1)..(349): unsure at all n locations
  Clone ID: PAT_TA_101823
nncnnnncanccctttttttttggattccctaaaggccccccatcctggatagcgcgaggancnnnntttttacatgtttcggttcaggggggggtttttccccccccaaaaagcccattaaaaaccccccccccgggcgttattttttttacccccgccaaaaacctttttaaaaacaaaaaaaacggggtcctcccccaccgggtgnngacagggtttttacnatttaatttgattggcccagggtaaacttttggagcttttttttttaccnngttggaccccggggcccctttaaaaaagggccctttgaaaaagtaccnnngccccgaccccccttattanntt

SEQ ID NO: 101824 - DNA, 217 bp, Triticum aestivum
  unsure (1)..(217): unsure at all n locations
  Clone ID: PAT_TA_101824
gccaaccaaccttggtctgattttttcttttntnnctaacccacgggggccggaccgggaacaccgaaccggagcgggggcnnctctaacgggagcccaaacattttggaaccctccccaaggggcgagaactaaacccgccccggcgggccctttaaatcactaaagaaattccgggccccttcaaggccaccctttgggaaaaccccccaccccg

SEQ ID NO: 101825 - DNA, 565 bp, Triticum aestivum
  unsure (1)..(565): unsure at all n locations
  Clone ID: PAT_TA_101825
tnncgtggtcgcggccgaggtggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggtngnntacctgcgatacttggtatctnnn

SEQ ID NO: 101826 - DNA, 358 bp, Triticum aestivum
  unsure (1)..(358): unsure at all n locations
  Clone ID: PAT_TA_101826
acccccccgggggggggtttaaaaannnnaaaatttccggcccccttgggggccaccttttgggaaaaccccccacccgtgggaggcctnacttgaattttttttnngggccccaaaaaaatngggggaaaaaatgggaaaaattttttccttgggaaaatttttttccccttaaaattcccaaaaaaataaaaaccggaaaaaaaaagggtaaacccgggggggcctaatgaggggcccaaccccctttttttgggttggcctcactgcccctttttcaaagngaaaaacttttgggcccctttttttaataaattcccnnncccccggggaaaaggggtttggtnattgggccctt

SEQ ID NO: 101827 - DNA, 266 bp, Triticum aestivum
  Clone ID: PAT_TA_101827
tcgagcggccgcccgggcaggtactaagggaggcaagaatcgaccctccaatccagacactgtactgggggaatagatcaaagcaagaacccaaagaacccataacccaaaccggaacgaaatatccagtttgttccaacacccggcaagccagtttctatcccatcgtttgtgattcgtaatcgggtcgttatcgaacctccgactggtgacggcaggcagctcagcgcgctcagacagccagtacctcggccgcgaccacgcta

SEQ ID NO: 101828 - DNA, 306 bp, Triticum aestivum
  Clone ID: PAT_TA_101828
ttcgagcggccgcccgggcaggtacccattgtgtttgtcgattctttaggaaacagagatgagagcatctacagctcctgagatgggcccttgccgcccttggtgccggtggtcttctttggcagaaggttctggtggatgttggggagcacaccaccctgggcgatggtgacgtgtccgagaagcttgttcaactcctcgtcgttgcggatggcgagttggagatgacgggggatgatgcgggtcttcttgttgtcacgagcggcgttgccggccaactcgaggacctcggccgcgaccacgcta

SEQ ID NO: 101829 - DNA, 376 bp, Triticum aestivum
  unsure (1)..(376): unsure at all n locations
  Clone ID: PAT_TA_101829
ggtttttttttttttttttttttttttttttttttttttttttttacggaaaaggggcccccttgtttgacaaactanataaccttttacaacttataatttccaaaaccaacaacccccccaaagggctcccattcttttggaaaggaacatggaaaaacttttgggtcgtcaaaacgtaatggcccccgaatgaaaaaccccttttaacaacaaaaaactttgggaaagttgacaaaccaaacaggataacccctttgggcccgggaaccctccgaattggtaaccctaacaattttgacaatcaaaaaaagggggttacaaaannnnntgggggactaggccccccaaatttaccctttgaagctttgccttg

SEQ ID NO: 101830 - DNA, 253 bp, Triticum aestivum
  unsure (1)..(253): unsure at all n locations
  Clone ID: PAT_TA_101830
ggnnnttttttttttttttttttgantnannnaagggacatatatttttctctttttatgcgaatcccacgcaaattatttctttatctatatatgctatacangctatatactctatactcactgggctacaatcacaactagctnnnnnnnnaacagataaccgactgggtagaaaccccagataccgccgagaatnnattttttccgatgaagaggaatacccctactggttacacacgtaaacctatac

SEQ ID NO: 101831 - DNA, 502 bp, Triticum aestivum
  Clone ID: PAT_TA_101831
ttcgagcggccgcccgggcaggtacgaagagttccgcgccatgccatgccagtgcagctgcgtatgtgccgagatggatcagcttcgtcaggatgttgacgccaccctccttcgcggggtgggtgtatgcgctgatggagaatggaggtaggcccaggaggtatgcccagagtgatgtgagtacaaggtaaggcatccgaagttgatccctcgcgaggagtgggaacaaggtccagttggcgatgaggttggcgtaaccgacccatgctctgatcgacggtttcataccaccctcggtagcgaggagaagcgtcatgggaaggagtgggaggagaacgttcttctcgtggacttgatatgagcagaggaagaaaccccacgaggttgcggcgaaggcccagggaatcagttccttcttgggtcggaggaaaatgatcagacatggcgggatgatggacgccagtgtcaagccgagcgctgcacctcggccgcgaccacgcta

SEQ ID NO: 101832 - DNA, 552 bp, Triticum aestivum
  unsure (1)..(552): unsure at all n locations
  Clone ID: PAT_TA_101832
gggnnnntttgttctccttatttttnnttgannnngacgtttgaatctgcnntcgagccncgcaggctgccctctccacgaggcgctgggtataaaacgtcctcgccggttgtcgaactcgctaacaaaaatacgcgaaacatnntttgctctnntgtcgctcaannnaaatnanncagcaaaactttttgataggctcttcgcctccatgcattcccagaaaacaatgacaacgccatngcaggttcccaagaacatgccgcttttctccagaaaatgcaaaaaatgattattttggggtnanattcaccgccagcgccaacgcttggtttttggggatgcgagaatcaggccacctcgctaatgttggaacaaggaagcaaatcgcaaaagnncgtatantnnnacgggtgcaagcgcgagccgctctatgatgagcgacggctgaaaatgctgagnncaccgccgttcatttggcgtgtgnnnacgtttcggatgctcgcgcgctcggagtcggatgatgcgccggatncctcnnccgcgaccannnta

SEQ ID NO: 101833 - DNA, 284 bp, Triticum aestivum
  unsure (1)..(284): unsure at all n locations
  Clone ID: PAT_TA_101833
tcgagcggccgcccgggcaggtcgagtgcgagcccgacttcacggcnnngttcgcgcctgctggagcgcggaggccgtcgatcacttgctgtcgttaggagagctnnctcatcgctgtttgtagttccggcccggcgtatgtggtggtggtggtggtattgttgttaccttccaagtatatatctctcgcgtgccggcgtgcgtgtgtagttactcttggtagtaatcgaggtcataagtctatattgtggctggatgggtgtacctcggccgcgaccacgcta

SEQ ID NO: 101834 - DNA, 273 bp, Triticum aestivum
  unsure (1)..(273): unsure at all n locations
  Clone ID: PAT_TA_101834
tcgagcggccgcccgggcaggtaccattcaatattggcgttattcggattcgagcattacgacaangctggaccgcnntcggctggcggtcaacgactgggcatggggtttcatgggcgcaatctggagttgagatgtcacaggtgtttctgctgtctgttcgttttccactgtgggacaaaagatgaatgtgcgactgcgacgactactgcattgctgatttgctctagcatgaggattattaaaacatacattcgtttgaaaaaaaaaaaa

SEQ ID NO: 101835 - DNA, 471 bp, Triticum aestivum
  unsure (1)..(471): unsure at all n locations
  Clone ID: PAT_TA_101835
tagcgtggtcgcggccgaggtacgtagacctgtccaattacagcagtcctgtctcctgtgctcctggcaatttcggcgactccgaaagccacgcttgaagtccaacaaccctcatgaaagcaaacgcaatctcgtatatcatcaattgttgatagaaacaatctggtcttgctcgatcaagacgttgtgctcttggcccatggcttgcacgctttcaaggaccttggccgggaccttggctgcgaagcccatgatcaagctgtattcatgagtgatgactccgcccgcgtcgaggatggctttcttggctccttccaggacagaggcgggagtgttgttggggtatgagatgatcacttgttgagtctgatcctttgccatggcgccggcggctaatccgaggacgagaagcggagccagagagaacttcattactgagatatcgagtaccnnnnnnnggcgnnnnntcga

SEQ ID NO: 101836 - DNA, 173 bp, Triticum aestivum
  Clone ID: PAT_TA_101836
tagcgtggtcgcggccgaggtacattttgatttctcgtattggctctgaaggctaaaccgcgaggctaacttattcaatcttattacaactgcatgcgagcttagctagaagcttgaatacgtgtcttctgctgaacaattattaaatttcacctgcccgggcggccgctcga

SEQ ID NO: 101837 - DNA, 347 bp, Triticum aestivum
  Clone ID: PAT_TA_101837
tcgagcggccgcccgggcaggtacagctggaaaaggagctgatgcgcatgttcgcaaatgcatacatgtttaatcctggcgaagacggaatggcactctctactaaggagttctttcatgacgtcgagcagaagattagcgattggcgcagcaccgaacgtgaggctggtggggaggacgatgaggaaggcaaaagtaaacgaaggaaagcgtgaagctgcgttggatgaagaaagaagtgaagcgaatgtgacttgtacgaagcagatcctttgatcctgcaatggacgacccgcaggtgtggcgtccagctgtgatgctagagtacctcggccgcgaccacgcta

SEQ ID NO: 101838 - DNA, 163 bp, Triticum aestivum
  Clone ID: PAT_TA_101838
agtttaaatttagctgcattccattgtcgattatgcaggtttaatgcaaaagcaacagtttcattgattatgatgctgacactgcacccccggcgtgcgacaaacaaagaaaccaatccatctgcactgaaaaataagtgtacctgcccgggcggccgctcga

SEQ ID NO: 101839 - DNA, 214 bp, Triticum aestivum
  unsure (1)..(214): unsure at all n locations
  Clone ID: PAT_TA_101839
tcnngcggccgcccgggcaggtcgatttcgtcgtgccaagtggttcgtccccggcgacggcgaggcttcaatctggnnngncggnnngtcaaggacnncgatcgcgtttcttgctttcagtctggggtcctccttgtaaaagtcagggacttaatgtaatgttcctttctattttggtcctgttgtaatatgtacctcggccgcgaccacgcta

SEQ ID NO: 101840 - DNA, 255 bp, Triticum aestivum
  unsure (1)..(255): unsure at all n locations
  Clone ID: PAT_TA_101840
ggttggttggttggttggtccctttacccccttttgggnnccaaaaattttttggaagggctttccccccagggantaaatttttttacaaacaaatttttttgggtttttttgaccctaagggaaacccccggcctaaggggatgcccaagggcttttaacaaatgcgaaacaaagggaattaaaccaggggtggaaccccagggtggaaaatttttccgcccaactttggaaaatttttaaggggtcctttcg

SEQ ID NO: 101841 - DNA, 318 bp, Triticum aestivum
  Clone ID: PAT_TA_101841
tcgagcggccgcccgggcaggtcataccaagacttggagatgactcaatctcttgccactgaccacaaaacggattcattgatgaagcggtcaggtgctgtcggcgagaagatcgaggaggacacaagagcactcgtggaggtgcttacaagggaggtgtgttggaaccgtggcctctcccccgaaccctagctagccctagctctaccttgctcaatctctctgtgcacgaacaacagcaggaggaagaagatgatcggaggagacagtggacacacggattttgctggcgcacgtacctcggccgcgaccacgcta

SEQ ID NO: 101842 - DNA, 276 bp, Triticum aestivum
  unsure (1)..(276): unsure at all n locations
  Clone ID: PAT_TA_101842
tcgagcggccgcccgggcaggtccggcgcccagtgctggccttcttgcnnacatgcnnccgagctgtcgcagccgtcgaaaggttttgcagctcaaggctgcactgcactagagcgtgagagctatatctcgcttgtagttttttttttttttgagtatctctcgcttgtagttagtattagctctcgtctcgcctgaagcaaccgcattttagggtcggcccattaacgtaataccataaagaagagaaaagaaggaaatgggagttcccaggnn

SEQ ID NO: 101843 - DNA, 238 bp, Triticum aestivum
  Clone ID: PAT_TA_101843
gggaaccaacatacccctccccgtggtgctttttttccgcctcaaaaacttttttaaaacggtgaaagccaccaaaaaaatccgggggaccaaaaaaaacctggtccgggagaactccccggtccccaccccgggctcgtcccgggtcccgtaataattcccctgcccccccaactgggcgaaatacccggccgggggggcggttgaaataataatgaaatcccgggcccccggcggg

SEQ ID NO: 101844 - DNA, 177 bp, Triticum aestivum
  Clone ID: PAT_TA_101844
tagcgtggtcgcggccgaggtacaaattagcaccaaagataaatttacaaccgtgccattgtggcaaagaaccacactctggagtctggacatataacgccggagataaccacgtggtggactgttagccttgattccatcgaccagttcatcctcttcacctgcccgggcggccgc

SEQ ID NO: 101845 - DNA, 251 bp, Triticum aestivum
  Clone ID: PAT_TA_101845
gccgggccgacgtgcaaacaagtgctagagaacactctatgctactttacagtcactgccgcccagcgcataatagacatcaaccgtgggtcaatcccatgccatcctggacacagatccagccacccctgccgacaccattgaaggaaagccagcatatcgcctcaacatatgctcccgaggaacggcgcgacgttgccttggatgcgcagcgagcacgcagccgcacctgtacctgcccgggcggccgc

SEQ ID NO: 101846 - DNA, 223 bp, Triticum aestivum
  unsure (1)..(223): unsure at all n locations
  Clone ID: PAT_TA_101846
aaccaagcaaaatttcataacaaaacaaaacaaatttcagaaacccccaattctggaaaagccaacaaaaattttggtaaccggatttcccantttccactttgtttaaaccaagggggggcccacctgatttttcacccaacaggaacaaagggccccctactaacattgccaaaaaaacaaatggggggacaaaaaaggaaaaaggcccctgcccgggggg

SEQ ID NO: 101847 - DNA, 174 bp, Triticum aestivum
  Clone ID: PAT_TA_101847
tcgagcggccgcccgggcaggttttttttttggtcagccaataaacaatatagttccccgggtttgctagtttacaagacatatttttttcagtgaactttcctcagcaaaagtttgtcatcgccacatatattagtgtggttgcaaaatagtacctcggccgcgaccacgcta

SEQ ID NO: 101848 - DNA, 264 bp, Triticum aestivum
  unsure (1)..(264): unsure at all n locations
  Clone ID: PAT_TA_101848
aaaaggggccaggggatttttttggggggaaaaaaaaaaaaaccctcccccgccaaaaaaaaaaaagggaaatataaagcccccggccccccccaccctaaaaaaaatggaatccccggcccccgggaggttaaccaaaaggaaaaacccccaacgggggggaggcaaaacttgaaaattttaaagggaaaccaaaaaagctgggcgaaaacagggccaaacccggtcccggggggaaattggtttcccctcncaatnnnnnna

SEQ ID NO: 101849 - DNA, 276 bp, Triticum aestivum
  Clone ID: PAT_TA_101849
ctggggaaataaaccttggaattgcatagtcatgcagtttctgaaactttttggaaccacaactccgtaggcaacagcatcagcatgaagatagagaaaagagaatcgacagaatttcacaggcaacaacgcggaagatcgagcagccaactataagcagaaccaagccaccggataccgggggcaaaagccatgccatctcatgtaaaaagaaagcttttacatttgaacaatcctcttctgaacagcagcagtacctcggccgcgaccacgcta

SEQ ID NO: 101850 - DNA, 548 bp, Triticum aestivum
  unsure (1)..(548): unsure at all n locations
  Clone ID: PAT_TA_101850
tcgagcggccgcccgggcaggtcgactctccctacgcagatgatcaagcgattcagacgatgttggacaacctttacattccttcagcgtcaaccatattggaagaattccatgcacagtcccgcggtgcaacattggatgcgcgcccggaagcagtttcaatcccacgccctgcactgcagcgttctcgcgcggacaggagcacatccacgggtaggcactcgcactctcgagggtttggtgcctacatcaataacttcatcaatggtcctacccgcgagccagtcgccggttgggataagaaccttcaaagcgcgctggagggtcgggagtttggagagaaagatcgtggtattcgccattgaagactcttctgtcgaagtcaattactggacggtgcgaagcatacattgtttaacaacatggtgttacacagaacatcattagagcgttgcaggaggcaatgaagttgactttcttcctnnnagtcaaggctggtttctgtatcatcgagaagcggtctgcgtacctcggccgcgnnnacgcta

SEQ ID NO: 101851 - DNA, 320 bp, Triticum aestivum
  unsure (1)..(320): unsure at all n locations
  Clone ID: PAT_TA_101851
tagcgtggtcgcggccgaggtacggattcggtggttaagcggtttccggtctttggggttctttcacaacacaacacacttgcatgctttcacgactcagaaatatccatcagcacggtgctgcggctcagggaaagctggtgatggatggcgcagatgggaatggttttttcaagcaggctgctctcggccgagctttatggttttgattgatgtgtagcataacggctcgaggagttcaatggggagaataattgaactcaaacaatgataccacagtctattgttcaaaaaaaaaccnnnnncgggcggccgctcga

SEQ ID NO: 101852 - DNA, 279 bp, Triticum aestivum
  Clone ID: PAT_TA_101852
tagcgtggtcgcggccgaggtacaggctcgctcacagagcaaaaggaaataacagcaaaagcaaagaacaagcaccggggtatgggggtattaagcgctgttcaatgaaaacaaaaccgagaccgcaggacaacatgaacaaaaagcaaagccggacatggaaaccgcaaaggaagtggtgagggtggaaggggtatagtggtcgggtgccatccaagcaagcagccagtgtgctggagagagactccaagtcagaagatgacctgcccgggcggccgc

SEQ ID NO: 101853 - DNA, 592 bp, Triticum aestivum
  unsure (1)..(592): unsure at all n locations
  Clone ID: PAT_TA_101853
tcgagcggccgcccgggcaggtacacaattacttattcacgaggtttacccatcagatttgagaaaaatagccacccaatcagctctgattctgcatttcgcagttggaaaaaaggcaagtagctatatctcttaacatgtacagattcatgtctgttggaatgtcagaacttgcttacctcttctggaaattaagtttctcaatggacaacgaaaacaagattatcaacacaaaaggaaaggcaacgaggacagttgctactatgctcaacttgtcttgatgaaacccaaaatagtcattcaagaagattgaaactgatttagtttctccaaatgctttcacctctttttctatgtttccgtattgtgatgtcaagagggcattgagtgcccaagatgtaggagtgagatagtagagccaagtccaccactttgggatttgaggtgcaggtaaaataaatcctgagaatagtgtttgcatggtgttgaaaaatgaagccagtatggtagctacttgaacattnnnggttattgaaacaagaagcaacccaacataaacataggagagaattgaacaaaatgtagtgtnnnn

SEQ ID NO: 101854 - DNA, 172 bp, Triticum aestivum
  Clone ID: PAT_TA_101854
tcgagcggccgcccgggcaggtggaagcgctgcgcgttcgtcaattgagaatagaggatgggggaccacgtgcggatatacactacaagtgtgggtgtggcatgtgatgtgtgtgtgatcatggacgtaaggatgaattcatctcctattgtccaggaataaaaaaaaaaaa

SEQ ID NO: 101855 - DNA, 155 bp, Triticum aestivum
  unsure (1)..(155): unsure at all n locations
  Clone ID: PAT_TA_101855
ccgcatgctggttggccgaaaaaatggctcggctgctcatgtgctcagtgatcatgttggtgctacaacaaccaggaatatgtgccgaccatggcctaactctttgtcccagcaaagctcagatctttgagcatgtacctnnnnnnnncggccgc

SEQ ID NO: 101856 - DNA, 289 bp, Triticum aestivum
  Clone ID: PAT_TA_101856
ttcgagcggccgcccgggcaggtcggaaggcggcgtttgagcgcatggacaacctcggacggtgcattgcggacgtggagaacagcggcgagagcgtcttccgggccctggtcaacaccagagtctccctgctcaacattctcagcccaagcttctgaagaatagcaatccccggacgttggagccataaacaatctcgacttatgtgatgaaatttgtatatagaaaagggcagtgtttttagaacggaggctcaagaagagcccgactttgaattaaaaaaaaaaaa

SEQ ID NO: 101857 - DNA, 209 bp, Triticum aestivum; identical to SEQ ID NO: 101777
  Clone ID: PAT_TA_101857

SEQ ID NO: 101858 - DNA, 233 bp, Triticum aestivum
  Clone ID: PAT_TA_101858
tcgagcggccgcccgggcaggtgaagattgcagggtaaccagtccgtagacagagttcatccatagaagggcgagtttgatgtaaaagtgaaatcttcatgtagcatagatgtaaaattttgtgtcaagtagagaaagagctattgctcagagtgtcctgactttctaacacagatagcactgaaggaactaatatggctgctgcatctgacgactttggtaaaaaaaaaaaa

SEQ ID NO: 101859 - DNA, 344 bp, Triticum aestivum
  Clone ID: PAT_TA_101859
tcgagcggccgcccgggcaggtcaagcacaatctctgctagaaatagtagaagataaggaactccggaaacaccttactacctttctctcggatacaaagattgcttctaggtcctggcacctagcaagaggcgaagacgagaccgtctagcctacactccttttacttttccttatttgtctttctttaaagtccttcgatactagcttgctactatcctaggcacgggtctttccctaaggtcaagagatacgagagaacaacgattgtaccacctggcgcagatcatgaagtagacaaagttgaagacgccaatgccggcacctcggccgcgaccacgcta

SEQ ID NO: 101860 - DNA, 351 bp, Triticum aestivum
  unsure (1)..(351): unsure at all n locations
  Clone ID: PAT_TA_101860
tagcgtggtcgcggccgaggtacctcgccttgccagcagtcatatcctggacaacatcgttcgcctccttcatcggacgctcattgagccaaggctcaatcttcttgtccgcagcgaactgcaacatctcctcaatctcctttggcgaaccgatcgcgctgccgccgaccttgatcccgttggtgaggagggtgaaagcgttgattgcaggcaattctccagcatctggtgcgccgatctggatgtatgtgcccttggtcttgagcaggccgaggtatccctcaagaggcatcttcgccgagctgaccgtgccgacgatgagatcaatacctnnnnnnngcggccgctcga

SEQ ID NO: 101861 - DNA, 221 bp, Triticum aestivum
  Clone ID: PAT_TA_101861
aaaaacaaaaaaagaatcttccttttggcaccctgattcaagggggaacccaaaaacggggccctttaaaggggggccctgggtggaaaaccccccggccccaaccaccctttcactaaggaaatcccggccccctgggggacccccctaggggaaagcccccaacccgggggatgcaaaactgggaccttttaaaggggccccaaaaaaggtgggggaaa

SEQ ID NO: 101862 - DNA, 489 bp, Triticum aestivum
  Clone ID: PAT_TA_101862
tcgagcggccgcccgggcaggtacatgtgtatggagattgctatacaggcggatgctcctcgggtttctggctggctcgcatctttgcggtttcttttcattgaccaggcgtagggatactgtagcaagcgggaagccaaactcggattcctcccattgtctaccgtagctgcctgaacaacttcggtgcagcacactggctggcgcagtgcatcatgtggaagaactcctcaacacagtcctcctctgcctttccgtgctgctcggtttggtgctgcacacgctcggcgcactcatcgtagtggtgcttcaacggcgcacatacggaagtcttgaggcattcttcctcgagcttgggcttgatgtcttctggctcatcctcctcctcttcctcctcctcctcctcttcttcttcttcagcatcgtctccgccctcctcggcctcgccactctcttcgctgtcctcacacctcggccgcgaccacgcta

SEQ ID NO: 101863 - DNA, 263 bp, Triticum aestivum
  Clone ID: PAT_TA_101863
aaaaaaagggaaaatacgtttgcagtaacattacccaaagtattagtcgggggttacacagttttgtatacaaaaacctgcaaagtaagtaaaccccggccccgcaaaaaccccgaacagcataaaaattacttttttttactacacaaggacccacactttaggggtgttttaaaaaacaaaagcccaaatcgatcaacgggtcatccctgggtgcatgagggggggcatggtccccggagtgcgtccttgcctttccatgt

SEQ ID NO: 101864 - DNA, 431 bp, Triticum aestivum
  Clone ID: PAT_TA_101864
tagcgtggtcgcggccgaggtactggggcaaggtcaagggacgatcgcaattcgccaaagtcgccgaccttcaagacgcctacctcaaggagggctgggagggcgatgaaattctcgagtccttcgccgagagtcttgaaaatggctggaccgctgatcaggtctggggcttcgccgaggtcgagggtgtgcgtcgtcacgtccgtcgtatcttgtccaagaagggcaaggatgagctgcgcattcgtctggtctacgactgggctcctccttcgtagagaggattgccatgacgagctggacggcaaacgttagcgtgctggaacttgagtcgagtaatcggattacgacactcgcgagagatacacaacaggctataccacaagacaagaccattgagaatgaagcaattctttcataaaaaaaaaaaa

SEQ ID NO: 101865 - DNA, 463 bp, Triticum aestivum
  unsure (1)..(463): unsure at all n locations
  Clone ID: PAT_TA_101865
tagcgtggtcgcggccgaggtgcaccactccactcacaccaacacaccacccactcaaactatcgcaaacatgtccgacgatgaggagcgcgtgaccatgcccttcaagttcgttacagccggcttcgacgcccgcttcccgaaccagaaccagactaagcactgctggcaaaattacgtcgactaccacaagtgcattctcgccaagggcgaggacttcaagccatgccgccagttcttcctcgcctaccgctccctttgcccaattggctggtcgaaccgatgggatgagcagagagaggccggcacgttcccgtgccgattggaccaatagatgtgggatatatgttgagagaggagaagacatgagaggtggcgcggaggagaaagcagatacagtggctcgatatggcaggaatcactccgtcagggagtcggtgtacctgcccgggcggcnnntcga

SEQ ID NO: 101866 - DNA, 353 bp, Triticum aestivum
  unsure (1)..(353): unsure at all n locations
  Clone ID: PAT_TA_101866
gggggggggggggggcccacttacccccctttgggggcccaaaacttttagggagggcctgccccccagggggaaaaactttttacaaaaaaaattttttggggttttttgaccctaaggggaaaccccggcccaaagggaaggccaagggcttttaaaaaaggggggaaaaagggaaataaaccgggggggggaccccagggggggaaaattttcngcccaaccttggaaaaattttaaggggacccttccgtttgcncaccccccccccccgggaaatccaaagggaaaattcaaagggaaagaggggggccaacccgggggtttttttgggcccaaaaagcccttggggg

SEQ ID NO: 101867 - DNA, 460 bp, Triticum aestivum
  unsure (1)..(460): unsure at all n locations
  Clone ID: PAT_TA_101867
gaaaagaccttttacccttttattccccgtcccacaacaaacatgcctgcctgaaatggttacctttgggggacccccctcccaatttttgggggaaaacaaaaaaagaattcttccttagggccatgaacacccccccatcccatgccgcacccccatttggaggggttttccccccgggggggcccccggaatttcaattgacaaatgcccnnngcttccggacttttcccttggggggggcccttttcaccccggggttcccccttttgatcattgaattcccaaaggccctgaaaaaaggntcctggcttcccccaaaccgggcaaaaatcggggccctcttcccccccgggaggggggctgacttgagttcccgggcggaccggaagaaacccgggttcacnnnnnggctcgacnnnccnnnnnnnngnnnnnnannnnntnaggaattcccgnn

SEQ ID NO: 101868 - DNA, 274 bp, Triticum aestivum
  unsure (1)..(274): unsure at all n locations
  Clone ID: PAT_TA_101868
tannnnngtcgcggcngnnnnttttctttttgaatccatgcctgtattttgatagatgaaaatataataaagattgcatattaatccacgcctgtattatgagtttccagcctgaggaaagaaacgaatagatagtgccaaaccggggtttcatgcatcacaattcaattctgtaactcacacgtgtaaacaccaattgcatcgatatgtttgccagctccaccatagaaccccacgatgctggtgccctcgacctgcccgggcggccgctcga

SEQ ID NO: 101869 - DNA, 218 bp, Triticum aestivum
  unsure (1)..(218): unsure at all n locations
  Clone ID: PAT_TA_101869
tagcgtggtcgcggcccagnngtccagggctatcaccaatcgcctgaacggctggcttcttgtgcaagaggcacgtggccacggactatggacaagacgcaggcgaagaggtttagctggtatctctagacacgagtccggatgcttcagcaggactccgaggggtaaattgaaaaggacagcaatgatagtccagtacctgcccggcggccgctcga

SEQ ID NO: 101870 - DNA, 276 bp, Triticum aestivum
  Clone ID: PAT_TA_101870
ttcgagcggccgcccgggcaggtccgggcaggtacacaatccaaatctatagggtgtttttggcacttctgagggaaaaaggacatggcaagcatgcatatgcgtccgtgctacatctatggatagctacacatgcagcttgctgcgagggactatatatcaatttaaatcatgcatcacggagccggtttatggatgatacgacctctatggcttctccaagaggccatgcggcttcgatgaagtattcaccgtacctcggccgcgaccacgcta

SEQ ID NO: 101871 - DNA, 230 bp, Triticum aestivum
  Clone ID: PAT_TA_101871
ttcgagcggccgcccgggcaggtgcaccgttggtcgtctcggacacgagttcggctggaaataccaggacgtcgtcgcccgtctcgaggagaggagaaaggtcaagggccaggcatactacgagcgtaagagcgcggcgaggaagaacttggtcgaggcgaagaagaacgccaaggttccagaggctgttcagaagcagttggagcagtacctcggccgcgaccacgcta

SEQ ID NO: 101872 - DNA, 339 bp, Triticum aestivum
  unsure (1)..(339): unsure at all n locations
  Clone ID: PAT_TA_101872
tcgagcggccgcccgggcaggtgatcttctctaccgccgccgacaaccnncccaccgttttgatccaggtattcgaaggggaacgatctatgacgaaggataacaaccagctcggcaagttcgagcttaacggaattcctgctgctcctcgcggccagccacagatcgaggttactttcgaattggacgccaacggtatcctgcgtgtgtctgcgggcgacaagggcaccggcaagagcgagtctattaccatcaccaacgacaagggccgtctcagcgccgaggacatcgagcgcatggttgaggaggccgagaagtacctcggccgcgaccacgcta

SEQ ID NO: 101873 - DNA, 502 bp, Triticum aestivum
  Clone ID: PAT_TA_101873
tcgagcggccgcccgggcaggtggcttgtcatgcaatttgttgcactacatgcagaaggtgaattggacaaaatactagacccacaagttatagaggaagggggcagcgaagtgaaagaagttgctactctagccgtggagtgcctaaaactaagagcagatgagcggccaaccatgaggcaagtagagatggcgcttgaagctctccaaacacccaagaagcgggtcagggataatttgacagaagaaacagatgagaaggaatatgcagcaacgggctttccatcgaccagccaacaagcaaagacaaacgaagcaagcaggtgttatatccaagaagaagagttcctgttgtccgctgcataccctcgatagttttgcgtgcttgtaagtgaattgttagccatggtgcgttctttctgttactgtcaatcagtgcgtttttctgtatgaacatatgtgcccaactaagcttacgtgtattatttacaaaaaaaaaaaa

SEQ ID NO: 101874 - DNA, 345 bp, Triticum aestivum
  unsure (1)..(345): unsure at all n locations
  Clone ID: PAT_TA_101874
tagcgtggtcgcggccgaggtgccgtcagagagttactacggattctaccacacgagtggctcgacctgttattgcaagaaggcgaccaatggctatgacacgagttgcaagggcaagtgtcctacctcctaggtagtttgcgacttcagcaaaacgccgaactaccgcgtgttggcaaattcatcaccccggtggatcgtcttgtccttcttggatggagttgatggtcagcgatttgttttgaaggagggatgtggagggacctgtccctgagtggttccatggtcatcgtttgggtgagcgaatagtatacacaattggtacctnnnnnnncggccgctcga

SEQ ID NO: 101875 - DNA, 287 bp, Triticum aestivum
  unsure (1)..(287): unsure at all n locations
  Clone ID: PAT_TA_101875
tagcgtggtcgcggccgacgtacccgaggagaacttctactacccnnnccgcccggtgcaagttcccaagtctcctgcgcagacttanntgcgaggtatggcttgaggtgattggtggaggagaaagcannntctgagcgagagccaaggataccggagcgattgtatttgcatgcttcttgggactagaagaagcgaatggtatggcgctgggaactgtcactgttatacgttcttgtgtgctttacctggcattgttgttgtacctgcccgggcggnnnctccaa

SEQ ID NO: 101876 - DNA, 606 bp, Triticum aestivum
  unsure (1)..(606): unsure at all n locations
  Clone ID: PAT_TA_101876
tcgagcggccgcccgggcaggtaccaacaacggcgccaatcccactccgggcggcacactcattacgcaaatcgatgctgccgcccgggtcaacggcttcacctatgacggaacatactccaatcagttcgatgacttctttatctctcgcatcggcaacagtgactccaacgatggttccaatcgatactggggcgtgctccaagagttccagttcacccccgccggcggttgtgaagatgcaatcgatacaaacagtgaaggtctctgggcatacaatgcgttcaacgccaattacttccttcgcattgagcaggattaccaggtcctgcggctggggcagacggtgagtgtgaccgtgatagacgggcagtccggcattcctatctctgatgcttcgatcgccggcgtaattaccgatgccaacggtcgggctacgtttgtggtgccgagcacgccgggatgctaccaatacaaggccaccaggtcagattcgatcagaagcaatgcgttctacttgacggtcttgccagcggagggttgatcagcaaagcgtagcggtagtcgtcaatctctgaatgaagagtacctcggccgcgnccacga

SEQ ID NO: 101877 - DNA, 341 bp, Triticum aestivum
  Clone ID: PAT_TA_101877
ttcgagcggccgcccgggcaggtactttgaggatgtgtatcggttgacgaagagcccgaggatcgggaatattttggagaattgggagaagtatgagagtgatgagccggggttgcagaggcctagggcggggagtatggctgttccctcatcgtgaagtgaggggtcgtgaagtgaggggatgttgaaggaggaatagaaggaatagatgaatgagtattaaatggaggggaagagtgttagagtatgtttgtgcttttttgatcggtcgggcgttgcgtaaggtatgttagtgtagatatgtctagtcattgcaaacctctttctagaaaaaaaaaaaa

SEQ ID NO: 101878 - DNA, 224 bp, Triticum aestivum
  Clone ID: PAT_TA_101878
tcgagcggccgcccgggcaggtacatacagcgcagtcatcgacacatatcaccgacacatcaccttcctttcgatatgttaattccacagcttggaccaactcagacaaagatcacagtcgcagctatcaccttcaggattctgggagagggcagatccggtagctagcatatattcagcttctaatgcaatgcactcctttcggagctcacaaaaaaaaaaaa

SEQ ID NO: 101879 - DNA, 390 bp, Triticum aestivum
  Clone ID: PAT_TA_101879
tagcgtggtcgcggccgaggacggcggtatcaaagccgtgcagggcctgaatggtcgcttctttggtggaagacgtctgacggcgagttatgtcgcggatgcgttctaccacacgatgtggccgaaggcgaagggactttgagtgggagatgaagcagggctcgaaatttggaagacatcgatgactatccgacagatcattgcacctcggcccaaaacactgacaacaggataccggcatgatagtccgtatgcatgcgcttcgcaggttccatctgatcaggcctaggtttacaaagccgccacgatggtccacactcgagtcgtcttccgtaacgctgaatgaggaccgacgcaatgacggatgtacctgcccgggcggccgctcga

SEQ ID NO: 101880 - DNA, 281 bp, Triticum aestivum
  unsure (1)..(281): unsure at all n locations
  Clone ID: PAT_TA_101880
acccgcccggggggccgctngnaaaataaagaattcccggccccccgccgggcgaccatttgggaaaaccccccacccnncggaggccaaacttgaggattttataatggcacccaaaaaaactggcnnnnaaaagggcaaaaccggttcccgggggaaaatgttatcccctcccaattccccccaaaatacaagcccgaagcataaaggggaaaacccggggggcccaaagaagagaccaccccccattaattgggtggggccccccggcccctttccag

SEQ ID NO: 101881 - DNA, 251 bp, Triticum aestivum
  Clone ID: PAT_TA_101881
tagcgtggtcgcggccgaggtcggagaacgagagtgagaagagattcaaagcttacactactaccctttgcttttgattttgcgttctttttcttgtcatttcacgactacccacgagcgaaaagaaaggacggatgcactgaactaccttgcctttttactgctactgctgctgctgctttttgctgctgctgctagtttactgctgctgttttttgagttgcggcgtacctgcccgggcggccgctcga

SEQ ID NO: 101882 - DNA, 177 bp, Triticum aestivum
  Clone ID: PAT_TA_101882
tagcgtggtcgcggccgaggtacaaaatgcaaatatgagcccgaaccaaacctaaagttacagagtagtcctggaaattaacacaaaggaccctaacaaataaaactgaaaagcaatcgggtccttctccactccggtgctctgcccgccccgctacctgcccgggcggccgctcga

SEQ ID NO: 101883 - DNA, 170 bp, Triticum aestivum
  unsure (1)..(170): unsure at all n locations
  Clone ID: PAT_TA_101883
gacaaacacaacaaaataatggttttttttttggaaaaaccctttgattatacangaacagcagggggggcagcaccattttgccaacctaaattcggcctacgtttcaactagttggatccnncgttttgcaaatttgataggggaaatgaccttggaaaacggaaaga

SEQ ID NO: 101884 - DNA, 170 bp, Triticum aestivum
  Clone ID: PAT_TA_101884
tagcgtggtcgcggccgaggtacttaatgttcggtgttaaaactgttgcttacctcaaactttacaggtattcaaacagaaggaaaatatctgatcttgaattcctctgaatacaaccacgacggatatctgacgctcaatactaaccctgtacctgcccgggcggccgc

SEQ ID NO: 101885 - DNA, 483 bp, Triticum aestivum
  Clone ID: PAT_TA_101885
tcgagcggccgcccgggcaggtaccagccgcgcgcgggaaacgcaaggcctcagtcgcggcaccaaccactgacggcacgaagacatatggtaggactacagcatcggacaaggaaaatgagggctacgagtcgtttgaagaagccgacgagtccaccctgccggagctgtcggtgtcaatgcatgaattggctaaaagccgggagctggaggaagccaaacgaaagttcgcagaagttgacgactgggatatggagttcgaaagcatgagccaggacgatcatctgaggtccagtcaaagctggcggtgagagaggcgtctctcgggacttcggggagatggtctgtccgctctagatgtggtcgtctgcaacgacaacgacttggtatggaaatgctggagggtagtcactattgccgaacatcgccctgcaaccttattgcctatagcctcctttgatagtacctcggccgcgaccacgc

SEQ ID NO: 101886 - DNA, 409 bp, Triticum aestivum
  Clone ID: PAT_TA_101886
aaagaaaacttcagtcgttaccacaagaaatttgaaatatatgagaaagggcgccggaccaattgattagtccattttgggttcacattgagatttgaaatgtgaaaagctgagaactgtaaatgcactccgcaattcgcattatacgtcgagggcggccaactccgctacgaaggcgtcggcatgcttcggcttgacgcagcgggacacgacggtgacgccgtgctcccccttgcacggcgggcacagaacgcagacgagccccaccgtcgggtgcgccttccacatcacgcgcgccggactcccacgcccaaaatccaccgcttcgaatcctaggttcctccagctcgatactccaagcgtgttgtacctcgggggcgccagctgccctatagggccgcgaccacgc

SEQ ID NO: 101887 - DNA, 274 bp, Triticum aestivum
  unsure (1)..(274): unsure at all n locations
  Clone ID: PAT_TA_101887
aaacagcaaaaaagttatcgggacatttccaacatataggagtgtccacgacctaaaacacggagcacatacaaacgtataaaattattgtcctaacttaaaaaggaccaacacagcgtnnnnagtctgaatttcccccatgcatcaccatgaactgaactggcagccaaacacttgatcaccatgcagaggaaaaaaaaaatgatgaatgtcatgaatgggtaataaagggtgcnnatattacaatgggtacctgcccgggcgggcgctaaaa

SEQ ID NO: 101888 - DNA, 266 bp, Triticum aestivum
  unsure (1)..(266): unsure at all n locations
  Clone ID: PAT_TA_101888
tagcgtggtcgcggccgaggtacggcactgacgaggagggtatcaagtattggctgataaagaactcgtgggggatcgactggggggacctgggctacgtgaagatcctgagggacgtggaatcgaaagccggcttctgcggccttgctagcgacgcgtgctaccctgttgcgtagacaagaatattatggcaagattcgcgtcgcattcccctagtgtgtgcaagctagggttaatagacaacaaatgtttatgtcttatcgann

SEQ ID NO: 101889 - DNA, 184 bp, Triticum aestivum
  Clone ID: PAT_TA_101889
catgtgccgcgcagtctacgtgcattactaacgaaacgtgacatccgtacaggtcacagacacccttaaaaaccccttcggggggggggggaagggtgctcgtatctcaccctttctcacgcttgccctatatggttgggtcgatagcaatatacccatcgagtctgggtaacaattccttgca

SEQ ID NO: 101890 - DNA, 207 bp, Triticum aestivum
  Clone ID: PAT_TA_101890
tcgagcctcgccgggcaggtgacaggcgttcacgacgagacgcccacgccgtgcagtgccgcccgaaactggtgggagttctggtcgaacttaccgcccgcgtcagctggtcatgactgaccctcgtgccggcgacccaccgctacactcacctacggtgacacttcgcgtggccgcctggcacgggttcgacccactacttgggac

SEQ ID NO: 101891 - DNA, 185 bp, Triticum aestivum
  Clone ID: PAT_TA_101891
cgcgttgtcttgggcgcgtctcatgttgccttcctctcgcgccctgtcctccgtcgtggtaccccctaccctgtctcgcgaccggtctcgatcccagctcccgttccctattggtgggtgacctcggcctgctgacccacgcttcccttgattcggcgctggtcaccttgacgagcctcccaaac

SEQ ID NO: 101892 - DNA, 123 bp, Triticum aestivum
  Clone ID: PAT_TA_101892
tagacgtgtgtcgccggccgaaggttagctgctcttagagagcacgacagtctacattgagactcgcacatgactatcgatagattactaaaggatgatatcactacactgaggacctgcata

SEQ ID NO: 101893 - DNA, 157 bp, Triticum aestivum
  Clone ID: PAT_TA_101893
tcgagcggtcgcccgggcaggtactagaggaaaaggtcctctcagagtgcgtcgtagactgccctacatccgtgattatgtgaaccgaagctggtctcactgaccggttctgagaccacacgcctcagctgtacctgcggcgcgcgaccacgtcgta

SEQ ID NO: 101894 - DNA, 311 bp, Triticum aestivum
  Clone ID: PAT_TA_101894
agtgggttctatgatcttcgcggtgactcgctcgcgcctgtaatgagggtagatgtcgtgagcttaggcgtaatcatggccatagctgtgtcctgcaacactagtgaattcgaggccgcctgacacgtcgaccatatgggcagagctccgcaacgcattggatgcataggttgagtacttcgtatagtgcctcctacctaaatcactagtgaattcgcggccgcctgcaggtcgaccatatgggagagctcccaacgcgttggatgcatagcttgagtattctatagtgtcacctaaataggggggagaag

SEQ ID NO: 101895 - DNA, 315 bp, Triticum aestivum
  Clone ID: PAT_TA_101895
tagagcccgacgatcgacatgctcccggccgccatggcggccgcgggtaattcgattgactagttctagatcgcgagcggccgctcgcgataaagaactagtcaatcgctttcaggaagcggcaatggcctgcgggaccatccatatgggaaagctccccacacgaaggaacgcataacaggagtattctataatgtctccttaaataaaaaaaacagtgtgtgtagagttcacagacagcgagagatggacagcgacaacaaaacaccaacaaacaaacaaacaaacaactctttaaaacatcatccatccaac

SEQ ID NO: 101896 - DNA, 697 bp, Triticum aestivum
  Clone ID: PAT_TA_101896
gtgtgagcgttctcgactgcgtttgggagctctcttcccagtagtggtcgaccctgccggcggccgcgaattcactaggtgattggcaggtggtattaggttaagggaacggaccccgccggagccgtagcgaatgcgagtctcaggtggggcgattgtcactggttatggacccgaacctgggtgatctatccatgatccgggacgaagcttggatgatactaagcagaggtccgaaccgattgatgttgaagaatctgcggatgagttgtggttaggggtgaaatgccactcgaacccagagctagctggttctccccgaaatgcgttgaggcgctgcagttgactggacttctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagcttatgcctcgtagaatgaccgcgtcagggaataaaaggggaatcgaattcccgcggccgccagtggacggtccgggtatacattgcgatcgttcgggtccaattttcgtctcttatatgtgagttttttttttttatattcctgcgtggtagccctaccaccacatctttctaggctcc

SEQ ID NO: 101897 - DNA, 851 bp, Triticum aestivum
  Clone ID: PAT_TA_101897
gcagtgactccagtaacgcggttggagagctcttcccagtagtgggcagaccgtgcagggcggccgccgaattcgctaggggatcccgagttccgtatgatcgcgggcggccgcttcgcgatctagaactagtcaatcgaattcccgcggccgccatggcggccgggagcatgcgacgtcgggccctattcaccctaatagagaaatctataatataatgtgtttatggggaggtttggggggggggtggtgccgggtcttccgcgccaccaagccccacgcggccaaggcgcagctgacggagcgcccggacgcgacgctctagcgcgcggcacggctgatctgtggtgagagtgagagatgtgtgtagtgtctgtgtgtgttctatccgcgacgagccgcgcaccagacaacgccacatgagccgggagtcgtgcggcgcgcgggcgttgtgcggcgcgagcagatagccaatagaaaaagagcaaactctgtgtgcgagctatgtggccgctggtctgtgtgttttgcagtgggaatgcaaaaaacaacacagacaagaaacgcgagcacgacgcggggggggcctgcgtcgcctgtgtgttcacaaaaccccccgcagcccatccaagtcccggctcgtgggtggtagtgtgtgtcgcgtcagctggttcggtggagtaatttgtagtataaacaacacaatccccacaccacacgtcaacaacaataacacacacaggtcggaattggcggcgattgctcgtgtagtgtcccgtccagatcaagcaactcccacacccagcacacatatagggagtattaaggtgtgtgtgagtggagtagttgat

SEQ ID NO: 101898 - DNA, 1092 bp, Triticum aestivum
  Clone ID: PAT_TA_101898
tacgtgcacttctcaggatcgctgtatgtggaagctctctttcccatctagtgagtcgaccaatgcagggcaggcctgcgaatttcaccttaggtggatattgacgaagtcttccaggagtccggcgcagctggcgcgcctcggcagctcttagcgagacgagcgcggcaccaaaatttcgccgcagagtacgccgcaggtggatagttagaggcagcagtgcgtacggtcgcggccccgaaattctgcttcttatttgtgtaggtctgtattatagagttagcccgcgaggggtttggcgccggagcctgcccagcccttgcaggggtgtgcgctcggttcatggccgctgactcgcgcagccacaacagatcaccggaggagcgtaccgcgtagtctattcatatgttactagtgtgtgttgtttgttttgttgttgtgtttggttattgtgaggtggtttgtgtctgacttaggtgttgttattaactagtgtaccctaatttcacagggctggctctaccttaaaacactttctcaggccagtttgtgcgtgtgtggttcgtgatttgttttcattcgtcgtgcgatcctttaggatgtctcgttaacatacataccaataaccgctcctaccacacaacactgacgttaatttacatttcgtggtgttttcttcttttttatagcatcgtacgttccctggtcgtatgtcgtttgggtggggggcgtggtttatttatctaaaccccaaaaaaacacaaaacacactaaaatcgcacacaccactatcccaaccagtcggccaccaccaccaactcgtcacattcaaatctctataatatttcttatctttttatgaacctttcgtcctctatttatgtcattcgtcttttccatatgaacgatgacaccccacaatcatcaaccacgtcctgtaatgcgatgcgcctccttgatgttcaggttgacttgttgtcgtcaattatcttctatattaatttatatacattttactttcattaccccctcatcccgtcttgcacctcttcttgtgcatgtgatgtgttcacttatatttatattattcat

SEQ ID NO: 101899 - DNA, 811 bp, Triticum aestivum
  Clone ID: PAT_TA_101899
tgtgtgtcagtctctgagcttgcggttgggagcctctcctcagtagtggtcgaccgtgcaggcggccgcgaattcactacgtgattactagcttctagatcgcgagcggccgctcgcgatctagacaatcgaattcccgcggccgcctatggcggccgggagcatgcgatgtcgggcccaattcgctttataggtgagtcgtattaattttgggtgggggggctgcgggggggggggatgcagccgcctcttgttttgttgtattttttgtatttattatacatctctctactcgtcccgtgcctatccgcttgcctgcgcgccgcggcacccgatcagaacagcgcagagcttgtgtttttgtggtggtgtgcgcggctttaaaaataggcacgtatatcgttttatgtttcatatttttgtttctcatggtcatgagcgctcccgtgttcccatgtcccctctgtccccttctcacggagaaccactacgcgacaagtatacaaaattactagattaaaggacgttataacatctctacacatgtctcatctatcatggcatttcgtgtctgtgcctcttcgaccccccccccccaaccccctcactctatatcttttatcacattaaataatatcacaatctgttttctttataatttattattattagtcattacaatcacacaaccataaatacaatcctttttcactatctcattacctctcttttttattattcttctctctttcttttataccctaataaataatcacacctatcgtacaccacatacacaacatactcatca

SEQ ID NO: 101900 - DNA, 861 bp, Triticum aestivum
  Clone ID: PAT_TA_101900
tatgcagtctcagagcgcgcttgggagcttcatccctaatattggtcgaccatgcaggctggccgcgaattcactaggtgattacttaggttctaggatcgcgagcggccgctcgcgatcgagaactagtcaatcgaattcccgcggccgccatggcggccgggagcatgcgacgtcgggcccaattcgccctatagtgagtcgtattaaggttgtgtagtgttgtgtggtttggggggtgtttgggggtccctgtgtctgggccggcggctctccgcgcgcgcggcgcgcacgacgggacggggcgtgctggaagccatctgcacagttggtttagtgtacgatgggagactcaccacacgacccacactcaacgcgtcagcatcggtccacgtggtgtgccagtgctagcgtagtgtgcctgcttttttggtattgtttggtgtgtttatccttttttcatataatacgcgaggcaacagcctagactgtcgatcgtggcggtaatgggttgtgatctggtgttttgtgtatatcatttacgataatccaggcggaacccgtcagagctgtgtgaatatgtatgtcatatgtcttctctcactcgtttagtcaagacgtactccgcaccgcgccccccgccccgggctgctcgcacattagagcaagtctacattttaattctaatatcgtgatactgtgatgctgtgtcggcggttcctgctgttctcttgtcgttgttataccatcttcaatcttcacatcactcattatcatatatcaaataaaacaaaaaaacccccactcaacccgtctccgctgtctgacctgcgagttagcgcaggtacgtcgacgattgtc

SEQ ID NO: 101901 - DNA, 1094 bp, Triticum aestivum
  Clone ID: PAT_TA_101901
taggtagctcctcacattgactcgtctagttgtagcgggatgctctctgtcctcattatatggtactagagcaccctgtagctattggcctggtgtctccactatgtaaatatagattctctcgctggctccctgggcgcgctcagggagagcagtgcagagcgctcgaggcctcatatttctgctccataataagtgaggtcgttattatatagtgttaggtgtggcgtgtggggggaggtgggataggggggggttgggtggttgtgtttttggttcttgccgttctatgagagggaatgatggtaagtgtgtgctgtgagcaggattcgacttagacactgtccgtctcgttttcatttagctcacgaggataggcttgctccagaactgtgatgtcttgcttgtgtcgtgtgttgcgtgggcgttgtgtgtatgattttttgagtttgttttttagttgtgtggtggatgtggaggagtggggtaggggagaggggtggacagtcgcacgcaccttttgttatctagtatcctgctaatatcactcaagtgaggtgtgtgtgtgtgtaatttttttctgaggagtcatgagcggttttttgattgttatgtggtcgggggttgtctatgtgagtacgactaagtagtgagggtgagggcgggaggagagtgctggacagagatgggaatattatgatgattagggttttttttattgttttcttttctgtcaatttattagtgtattttgttggtacgtccgtgggatcgcacagcgaaagaaagccggcatagataacatatgaatcaatgagataaagtagtgagtaatgttcattgttgtgtgttgtcgtgtctgtattttttttttttttgatgtgattcgtgggtatggtgacgagagcaaaggcagaacaccggaacagataatgctacttgagaatttttttttttatatattgttatattttgtaataagttgttagttagtgtactatcttgacataaataaatatgtattatgtatttcatatgttttttattcattatataactaaatacagcatagacgtaagatgatagttgttcga

SEQ ID NO: 101902 - DNA, 754 bp, Triticum aestivum
  Clone ID: PAT_TA_101902
tggctgtgcggtgaagcgtcgtactccattagtggctcggaccatgcacggcgggcgcgcgaaattcactaggagattgactagtctctaggatcgcgagcggccgcccgcgatctagaactagtcaatcgaattcccgcggccgccatggcggccgggagcatgcgacgtcgggctccaattcgccctatagtagagtcatatataatttggctcttggtgttttttccgcgggggcgtgcttttttggtgtactcataccacacacaacagaaagatataatgtgagaggtatggtggtttcgtggctatgtgttcgtcgtttggtggctcgggggtggcgcggtcgtcttaggctggaaatgacgatggatagagacgtggagcatgggggcgcgtgccgcccgaaaacgctgctagaagacatacgcgcatcatgatgctgtgttgttgtttagatatgtgttatcgatggaggggtggtgtgtgtgtggtgtgtgtgatcaattagtggtataagaaagacgctactgagtcatgctgggctggtgggccgggtgcgggctgacgcgcgcgtcgaagggctgtgcggcggcgcggtgagtccgcgcgcgcgtgtcgcgctgtggttggccgttgctgcgtggtgggtgtgtggttgtggatggtttgtttggttgccttgccggccccccgttctttttttgggaaaccggaaattggccccggtgtttccgccggggggggggggggg

SEQ ID NO: 101903 - DNA, 887 bp, Triticum aestivum
  Clone ID: PAT_TA_101903
tgcggtatgcagtctcaagtcgtcggttgggagtcctcttcccagtatggtcgaccgtgcaggcggccgcgcaattcacttaggtgatagatctgaattcccgcggccgccatggcggccgggagcatgcgacgtcgggcccaattcgccctattggtgagtctgtattaagtttttgggggacggggtgtcgggctgcgggacacgacgcccggcgcccgcgggggaaattatgcctctacgcccctgaagctcctgctctttctcctctttctctttgttttttgctactagtgtagaggggggtgtcgagttattatcgctgtgcagctgcgttgacaagcatcgacactgacggtatcgacacgacgacctctcacatgccgtgcacgtctcactgcgtagctgtgggcagttattacagatatagataatttatgtatatataaaaacgagcagtcgtctcatacgatatatagtacaaacgaggtgatgtgtgctggggtgggtctgtgtggcggttcccacacaaagcacaacagacaccgacgacacattggtttttttgttgtgtgtgtgttgtttgcctatattaattgtgatgttgtgtgtctaacttaggctctgcttctgcacctgatactctacaactaaccacactacctcacaaaacaaaccaccaatagagctctggtggacatatttaataataacaatatgaaaaacagagtgtatggcgaaacaccacacacccaacttcagctctgttcttctttttatatatatgtttgttatgtcactctaatcgatacagaaagattagactcctaccacacttatacaaactccctcttttttctcacttctccacatctctttctgtttgt

SEQ ID NO: 101904 - DNA, 731 bp, Triticum aestivum
  Clone ID: PAT_TA_101904
cggccgctatgtctgtagctgtccttctctcagtagtggtccgatctcgtgtacggcggttcgcgaaatatacatctaggggattacaaggttctagatcgcgagcggccgtctctcgtcgatctagaatctagtcaatcgaattcccgcggctcgctcatggcggccgggagcatgcgatcgtcgggctccaattcgccctatagtgaagtcatattaatggtgggggtgtggtggcgcggcaccccgcggctacatcctctccaccacgggcacttacgggcgctgggcggactgtggctgatgtggatgttatagcttaacatcttctccgcgccgtgcgctggggtggttgtgtgtgtctgcggggggggactgggtgacgcgtgcctctggctctctttcataacccgtttaccggccgtcgtgcgtcgcttgctgtgcgtgcgtgcccgccgaccgcgcgcccggccgctgctgagtggcactccatccctcctccgtacaccacatgcactcatccatgatgtcctgttactgtggcaaacctccactactctccttatagcattttttactgtcttatcaactaaaaatacttaaaatattacagcgcgtttcatagtttgtcgtctttgggtttagtgtgttgtacgaattgttggggttacgctttcaacactaattccgttccgcaaatttttggggaattggcaattaaacacccaaaa

SEQ ID NO: 101905 - DNA, 839 bp, Triticum aestivum
  Clone ID: PAT_TA_101905
tcgcgcgagcacgtctcgagacgctggttgggagctctcttcccaataatggtcgatccatgcagggcggccgcgaattcacaaggtgattacgaggttctagatcgcgagcggtcgctcgcgatctagaactagtcgatcgaattcccgcggccgccatggcggccgggagcatgcgacgtcgggctcttattcgctctataggtgagatcgtaataatcgcgtttagtttttttttttttggttgagtcttttctcccttcccttcctcacacgtgtctctcttgttcggcggctgtgtgtttggtcttcctcctaggacacttatataaacaatcaatagagatataatcattttttacatctattgagtggcgggctcgccccccctaccacctctgtggtactgttgttataatttttgacattgaacaccactctactttgttctccgttcttttgtttttcccactctgtcatgaccactcattcactctctcactgtgtctgacgtcctggactgtcacacacctttttttatctatatatatatgatgtttttatatattagtactatatttaattatatttctctatcctcctcgtgttcgtctacctcttttctttatcctcccctctcagcatcaacacaacacacacacacatcactcatcccacatcatccatctcctttacgcttcctacttattatttatatatataattatataaaataattatttttgcgtacccctcccaccttatctctctctctatctctctccctcattcctacctactaactcttactctccttcacccataaaacaccattacat

SEQ ID NO: 101906 - DNA, 745 bp, Triticum aestivum
  Clone ID: PAT_TA_101906
agggatgaagtacgctctgtaagcgaccattaccagtataggctcagacctgtgcgggtcggttcgcgaaattcatctaggtgatatgacaggctctggagtcgcgagtcggctcgccctatagttttatttttttttatttatttttaaagaagggggtcccctagagagggaggggggctcacatagacagaccccctgagtaccttttttgggatgtgtccggcatccgaaaaacagtgggacaaattttctctcttattctgtagaagtctcgcctggagagagcctgtaggcaagagaggggcgtctctcactctccgccgcggcgcgcgcgtgggggttctcggggaaatctgtggaacataccagagggggcctactctcgggggggggcccgcctgtggaggggtggggagatgtatgatgggcactggtctctcttagatgccttgtggaggggactttgatgtgaggggtgtgcgactcattcacacgcgagagaggaagcagcagaaaaaagaggcgggagggagagaggaggatattgtgtatttagtacgccccgcaatgaagaagttctcctctcctctcaccgcctatatatagtcgttgtgggggggggtggggggaggccgggaagggattagattcggcgtccccccttttacgggttgtccggggaaggcccggcccccccccaaagggcccggggcaaaaaacccccgaaattttttttttttat

SEQ ID NO: 101907 - DNA, 737 bp, Triticum aestivum
  Clone ID: PAT_TA_101907
gggcgtttggtgtacgtcgtcctcccagtagtggtcagaccatgcacggcggcgcgcggaattcatctaggtgaattgactatgttctaggatcgcgggcggccgtctcgcgatctagaactagacaatcaaattcccgcggccgccatggcggccgggagtcatgcgacgtcgggcctcaattcgctcctaatagtgagtcatatataattggggggtggctcgccccggcgcgcgggctcctactggtgtttgtttttgtagtgtggtcctggggtgtgcgctgttcgcgtctgtgcatcactagatattatgttgaatgtgttttctgtatcagccggggaacggccagctagcgacgacgagcgcgtgccgctgtgtgtctgtcttttagtgctattccagtgagcgcatacccctgagacaaacacttctttttcgctacggtggcttggtggggtgcgcgcccctgcgcgtgggctgcgatttggggggagggtgatggggggcgggtgtagcagggcgtgcagacatatgctgatctttgagtgctggtggggaggggcgaggcgcaatgtggtgggcgtttggaccgcgcggggatggaagtgaagggcggggatgtggtgagtgcggcgcggatgagcttcgaagttgctggcggtcggccggttatttcgtgtgcttgtgccccccctttcccccgtgtggaaaacaacccccaagaccccccccct

SEQ ID NO: 101908 - DNA, 683 bp, Triticum aestivum
  Clone ID: PAT_TA_101908
gtgcgttctgcgtggagctgtcatcccagtagtggtccgaccatgcagggcggccgcgaaattcactagtgattgctaggtgttttggtcgcaaggaggccgcaccccgacctagacttagtcaatgggaagtcttgagggcgcgatggtcgctgcaaacagagccacaatcgggcccgaatctttccttgtaatcgggatatagatatatagaggttgattctttagcaggagtcccaaaccgactgatgttgaagaatcagcggatgaatatagaggttaggggtgaaatgccttctcgcaacccaggagctaggctggctcctccccgaaagtgcgtttggaggcggcagttggtttgactgggaccatttctaacgggcgtaaaaagcaccctgctatatacgggtagccgcggccgtgtctaccgaagtcggggtaaactcctaaagagtccggaggggcaataaatcctccccgtggaacactaacccataaagcgaaactaatttaggaaccccctccaaaactaaaaaacaaacataataaccccaaggcgggggggtgccggctctcctcccacaacttaaggggcggggccttttccccccgggattcgggctcccctcccctccccttcaaattaaagggcaaggggtgtgtggggggcctgtttttttttt

SEQ ID NO: 101909 - DNA, 662 bp, Triticum aestivum
  Clone ID: PAT_TA_101909
gcgttgggagctctcccatatggtcgacctgcaggcggccgcactagtgattggaatgaggggagtgggcaaaacaatctgaatcatattgtgttgcaggatcaacctcaatatcaatcgcacttttctcggtgtcaccaataaaatccttgtcacgagcatgaacacggtcataggggggttgaaagaccgttaaactctccggtagcgtgcttatcctgaaatatgaactccatctcatcaaagttggcaataggcacattgatatattttgccctcttgtctttgttctggaagagaggaggaagcatgaaaatgttagttataaaagacaaaacataatacaagatggaaatataatttgacaaaatttagatgtagtgttcacattcttcatccgtacaacttcagtatcatcatataatattatcttgttgacatcatcaaaattggcaccgcttaaattcttcacctctagtatgatcttccactgacctttcagcttatggaacttgtgataaacttgcctttgtgtgaaggcggtggtaaactttgcattgatttgtctttcccacacctcccattccaatcccgcggccatggcggccgggagcatgcgacgtcgggccaattccctatggggggggttttaaaaaaaaaaa

SEQ ID NO: 101910 - DNA, 462 bp, Triticum aestivum
  Clone ID: PAT_TA_101910
aaatcacacgcgcgttggggaagctctcccatatggtcgaaccgtgcagcggccgcactagtgattggaatgggggtgtaggcaaaaacgacttccttctctcacccgcatgtgcttcacacttcccctttcggactgagtgaaatcgtagatgaacactctcccccttccgggctccgattcaccatgtatcttgcgtcgcgccaatgaatgtcttttgacactctatagcgtctccgccaacacttgcgactgcacccccgtcttcgctccttttgtgagatgtgttctcaaacacctatagactctagcgcgtccacttgcatgtcaacacccgtaactgcactctcattgatatcctagttaaaggacaagcttccgtagcccagtatgatacagcctatggtagatgttataactatctgtctcctatatttgtctctcccgactacaaccgcattg

SEQ ID NO: 101911 - DNA, 625 bp, Triticum aestivum
  Clone ID: PAT_TA_101911
gcgtgcgtagactctgtagagagagctggggggtgcgctgctagttgctaggcgcagatactgcgtgtagctcgtcaccagtagaggtcgaccatagcaggcggccgcactagtgattggaatgggaggcgttggaaaaacgcccgactgtggcatcttttttctttatatttatcgcgatttttccccctttgggttttatttgtttcccaaagatatgcccccccccccccggggttttgtttatttcccggggaaaggggaccggggttcagaccatttgttcccaaaagggggaaaatccccccaaaagggggccccccggtccccccccggggaaaatgtcctctcctctctcctaaaaaggggtgggggggggagggagaagaaaaaatataagttcgaactcaaaactctatgatcctgcgcgcgggcacagagatatattagaataaatcacacgctaagctcaaataaaaaataatgcgctgggggcgctgctaatgctctctgattgtatgtgtctgctgtcttaatacatcacataaaaaatatttttgaagccacacgagccaccacacctctctctctttgtaataaattaatttgttggtggggagtgggg

SEQ ID NO: 101912 - DNA, 843 bp, Triticum aestivum
  Clone ID: PAT_TA_101912
gcctcatcgcgagtagatcggccatacctcgcaggcggccgcgctatatgattggaatggggggggtcggcaaaaccgtcgtgcaggtacataaaccgcttgatcgaagttatagatccctttttagtataagcaattctttcttgcaaagaacccatttctgtactaagagtaggttgataacccactgcggagggcattctccctaataaagcggatacctctgatcctgcttgaacaaaacgaaagatattatcgataaatataagcacgtcttgcttattaacatctcggaaatattccgccatagttagggcagttaaaccaactctcatacgagctcccggtggttcattcatttggccatagactagagctacctttgattcctcaatatttttttcattaattactccggattccttcatttccatataaagatcatttccttctcgagtccgttcccctactccaccgaatacggatacgcccccttgagctttagcaatgtcattgattaattccatgtatcagtactgtcttccccacgccccccattccaatcccgcggccatggcggccgggagcatgcgacgtcgggcccaattcgccctataatgaaatcttattaatttttttttttttttttttgttttttttgctttccttttttcgttgttttttaatcacacatctattaatatatccattttctttttttctttttctttcttcttccctctttattcttcttacttcccttcgcccacaccctcattatcaaacttcaactctccctttcaacaccctatcttttctctctttctctttcccctatcacaa

SEQ ID NO: 101913 - DNA, 246 bp, Triticum aestivum
  Clone ID: PAT_TA_101913
gtacatgtttaatagaattgcttttgcaggatcattatctagatttttcaagtttaacatacctgacttgaacaaacgggaattttatatattacttacactagtatccttgacagttatattgggtgtatatcctactcctatcttggacggtttacactattctgtttcttcactgatatactgtactgccgtataataaccttaatattaaataaaatactgtaactaataacattattacca

SEQ ID NO: 101914 - DNA, 240 bp, Triticum aestivum
  Clone ID: PAT_TA_101914
atactgaagtggaaggagaggccgaagaagaggaggaggatgagggagaggctgaagaagaggaggaggatgaaggagaggagaagcgaatataaactgaggacgacaccgattttgggactatccctggggacgacaccgagtcggaggggcatggcgaggagactgattttgaagattgataggtctgagggtggcacggcgtgagacggtgcatcgtaatcaacgatctgcttgtgt

SEQ ID NO: 101915 - DNA, 138 bp, Triticum aestivum
  Clone ID: PAT_TA_101915
agcaggagctggcggggcattctcttttcattttggtccgtagaggtttgggaagggcagcgatgatggagatgctgcgacggtagtaccccttatgccgaacaggccaacacaccacacaacaacaaaaaattcccc

SEQ ID NO: 101916 - DNA, 140 bp, Triticum aestivum
  Clone ID: PAT_TA_101916
aacggcgaggtgtctctattccaacagtagtctagccagtatcagaacaatacaagacgtcgaagagtgcgttcccttggacatcgaaaagaagctcccaaaaaccgtgtcaagcagcaactcataccgcgctgtatcct

SEQ ID NO: 101917 - DNA, 157 bp, Triticum aestivum
  Clone ID: PAT_TA_101917
gatgtcggatgcttcttaaaacctcacattctgttacaaaacttttgtctgcgcatttcatatcaaggttaaaaacattgatggctacttgtatcttagcttgagttaactttcctctgtatactgtaccatagcttccttttccaattatgtttgc

SEQ ID NO: 101918 - DNA, 424 bp, Triticum aestivum
  Clone ID: PAT_TA_101918
gagcgaatgtggtgttgaatttgtgagtgccttatcgactgaaggtattgcttgacttgacttgaccggtcttccttcgacgacgatgatgaagaagaagaccagattcgtgatcctccagtgtgcaatcaaaccagcatgcccagctttcatttccaccttggtcccattctcatgttcttcatctcgccgaacccatccgcaacgcatcactccctcgcctcgccatcatcttccaatcgtccgagtggcggcagcatgtcgtggttgaagttatttgctgcaagtgcaagcgccctgagcgcaggtgcacgaggtgcaagtgcaagaggtgtttccgcagccgcccatttttgatgatgtgaagggttggtttggtggttgagttgttgtttggtttgagttcttggtggttgagttatgt

SEQ ID NO: 101919 - DNA, 307 bp, Triticum aestivum
  Clone ID: PAT_TA_101919
gaggatccctgatgtacagttgaaaaccgttgtgactatattagcttggcactaccatggtgaagccctgtcccctcccctttgcttaattgtaattaatatttatctgtaagagtaaggggatattattgaactaattaccaaacgactggattggaagactttcagcacctcattttaacccttttttcctaatgttattatcaaatagtcctacaatagttcagaatttaaaatataatttcccccttcttaatgccattttaaaaatgacaaaagtatttttgtgtgtgttgaaaaaaaaaaa

SEQ ID NO: 101920 - DNA, 850 bp, Triticum aestivum
  Clone ID: PAT_TA_101920
gcacgagagccggcgctcccctccccccaccgcccgatctcgccgcctccgacggccacctccgctctccgccccccaccaccacaccccgggacgaccaagctgcccgcggccagtccctagcccccctctccccagacccgcgatgagctggtggtgggcgggcgcggtgggcgcggtcaagaagcggcaggacgagcgggcggcgagcggcggatcccaccttccagagcgtggcgctcatcctcggctgcacggggatcgtaggcgcctccctgctcaacatcctcccggacgaccacaccccgggctggccgtggaacgtgtactctgcttctcacctggcgccccacggctggtggactccttcgccgtcaccctctgtgacgctcctgaacctctggatctcctactcctgctgcatgaacgacgcgctgctgcctgttacctagctgcccatgcttttgtgctcatgctgttcatgaccaggcgagagacatgaccggagagttaatgtgtgggatggatcacctgagctctccacttaagagacctgatggaactttctccgctcgtctgtctgagatccggcgttttttctaaaatgtggccataattggcatcagggagatcccttgaatgagctcctcctacagaagacgtgtccggcaataaataccaagttgtactctacggtgggaatggtggtgggttagtgtaggactctatgtgctgatgtaatgctgcctcccccttggttttattattggtaaacatttaaaaggggtgaatattttattccggagtagtttgtagatcttgctgtgggtagattggagatagtatttat

SEQ ID NO: 101921 - DNA, 873 bp, Triticum aestivum
  Clone ID: PAT_TA_101921
gcacgagcaagctcctccaccctcgctgcgtatacgaactcgcgagccgttgtttgtctagtgcaggcaggctctgctccttggccattccgggaagctctccgtctctcgtataacagaggatcatgatcaaggtcgcggcgccggaggtgcagcagccgcaggccgtcgccgcagccgaggcggtctcggcggtggtgccggaggcgaccatcttccggtccaagcttccggacatcgacatccccagccacctgcccctgcacgagtactgcttcgccagggcggccgagctcccggacgcgccgtgcctcatcgccgcggccacggggaggacctacacgttcgcggagacgcatgcgctctgccgcaaggccgccgcggcgctgcaccggctcggcgtcggccacggggaccgcgtcatgatcctgctccagaactgcgtggagttcgccgtcgccttcttcggcgcgtccttcctcggcgccgtcagcacggcggccaacccgttctgcaccccgcaggagatccacaagcagctcgtcgcctccggcgccaagatgatcgtcacccagtccccctacctcgacaagctccggcacgagagcttcccgagaatcagcacaagcggcggcgacaacccgctcaccgtgatcaccctagacaacaaggcggcccccccgaacggtgactgccttctggggggtcactggacacctataaggctacgctcggccgtactatatttaagagatactcataccatcaaatcaaacaataaatggattataagcatacactcaatactctcaacctcacttatctgcctctcaacattgaccgaataatagaatctcttttccgtcctattca

SEQ ID NO: 101922 - DNA, 231 bp, Triticum aestivum
  Clone ID: PAT_TA_101922
gcacgaggtacgtcccatggagctttcacatacagaagagatgcagtaagaagccccccgcccaacgatcaatactgatactgactgctgtgcaggcgtcctcagagctgtacaatcattgtaatatgtgtagcattactctagcgaaatcatcggtgcaaaaatgtgtgccatcagtcatgaccatgtgcaacacaagtgtgaaaatttcacaaatctaacatgtgtggc

SEQ ID NO: 101923 - DNA, 895 bp, Triticum aestivum
  unsure (1)..(895): unsure at all n locations
  Clone ID: PAT_TA_101923
gcacgagagtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctntcttatntgttcctaagatatgtgtatgtccatgttcatgtacgaacatggctcgagaaagcatgctcgtatgtgaatgctattggtggctatgatatgacggacgcttatttataccattgtgactaaaaaaaaaaaaactcagggggggccgtcccaatcgcctaatgagcgtttcattactggccggttacacccgggatggaaaccgctttccactaatccttg

SEQ ID NO: 101924 - DNA, 877 bp, Triticum aestivum
  unsure (1)..(877): unsure at all n locations
  Clone ID: PAT_TA_101924
cggcacgagctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaagagtccgggcatgcctaaacagctcactcacgacaggccatatataaagtgccattgcagntttgtcaactctgacattgctttgggttttccttctccatttatctttcttatttggtcctaagatatgtgaatgccatggtcatgaccacatggctcgagaaagctgctcgtatgagatgctatcgtgggctttatatgaacgaccctatatatccatatggcactattacgtttaattaaccaaaaaaaaaaaaaaaacttaaggggggccggcccattgcctatggaacngtaaattactggcgcgttaaacgcgaa

SEQ ID NO: 101925 - DNA, 856 bp, Triticum aestivum
  Clone ID: PAT_TA_101925
gcacgagattcctcctcaccggctcagcgggcgacgccgaccgcctccaccgcctgctcctcgccacctaccatccccgcaacctctacctcctcctactcgaccgggccgcccccgcgtccgaccgcgtgcggctcgcccgcgaggtgcgcgctggccccggccgcgccggcaacgtccacgtcgtgggcgaccctgggttcgctaacccgcgcggtgcttccgcgctcgccgccgcgctgcacggcgcctctctgctgctgcggctcggccagggctgggactggttcgtgcacctcgacgccggcgactacccgctcgtcacccccgacgatctcctgcatgtcttatcatatctaccaagggatataaacttcattcagcataccagttatattggttggaaggagtcaagacatataagaccaattgttgttgatcctgggctatacctctcatcaaggactgacattttttatgccactcaaaagcgtgaactaccaagtgcatacaaattatgtaccgggtcttcatctgacatactttctcgggaattgaccgagtcttgtataggctggacaaataatctaccgagaactatgcttatgggctacactaacatgacccttggcacacaggaggatttacagagagtctatgcgatacatgtaggagaacagaccgtgtatacactgatctgcccgctgggcttcgatggacggacaagacgagcgcgctgtgacctacggagctaaaaccggcaatggaagacgcttaggaccgtgaacaggaacccgcgtccccagacctgacacatgcagagtaggaacgatcgtgggaggatggggggacaatg

SEQ ID NO: 101926 - DNA, 860 bp, Triticum aestivum
  unsure (1)..(860): unsure at all n locations
  Clone ID: PAT_TA_101926
gcacgagccaccacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctcgcccgcaacggcgtcaagttcggcgaggccgtgtggttcaaggccggctcccaaatcttcagcgagggcggcctcgactacctcgggaaccccagcctcgtccacgcgcagagcatccttgccatctgggcctggcaggtcgtgctcatgggcgccgtcgaagggtaccgcgtcgccggcggccgctcggcgagatcgtcgacccgctctaccccggggcagctttcaccccctggcctcgccgtgaacccaaggcttcncggactcagggtaaggaatcaaaccggcgctcccctgttctcatgttgggttttcgtgcaggctcgcacggcagggcccctgaaaccttgcacacctgcgaccctaacacacgctgggctgcacaactttcccggagtactctggttttacacatcatgctaaatgta

SEQ ID NO: 101927 - DNA, 875 bp, Triticum aestivum
  unsure (1)..(875): unsure at all n locations
  Clone ID: PAT_TA_101927
gcacgagccaccgtccaccgcagcgcgccatgctctccctcctcccgcccgcgcggctccgcgccgcgccctccgacgcctccgtcaccttgccgcgccgcccggccgtcatcctcccagggctcgggaacaacacgggcgactacgcgcggctggccgcggcgctgcgggacggccacggcgtgccgtccgtcgtcgcccgggtctcgcgccccgactggctccgcaacgccgccgggctcgccgaccccagctactggcggggcaccctccgcccgcgccccgtcctcgactggtacctgaaccgggtggaggaagcggtgtccgaggccagggagctatcctctccagatgggaagctatcattgatagggcattcagctgggggctggctcgcgcgcgtgtacatggaggaattcgggacttctgacataagtttgctgctcacgcttggcactccccacctgcctcctcccaaaggtgtttctggcgtaattgaccaaactagaggactactgaactacgtcgagaagaattgtgcncccgcagtttacacaccagaactacgatatgtatgcattgctggaagtacattcanggtgctcctttaactggaaactncctggctactaccacagatgagcttgtcggcgtggacgccccatcagaagtagctgaagcagtcatggccagtgccgacgaccacaaaccggtccgacaggcccaccttccggccccgttcgtcggacaggctacaaacaggtttgggcagccccaaagtctgggagatggggggtccccaagggcagcgcatctgaggggcactgatttaacttcaacgggtgaccatctcctgaggtttgatataaagaggc

SEQ ID NO: 101928 - DNA, 876 bp, Triticum aestivum
  unsure (1)..(876): unsure at all n locations
  Clone ID: PAT_TA_101928
gcacgagctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccgggaaggcctaaacagctcactcacgacaggccatatataaagtgccattgcagttttgtcaactctgacattgctttgggtttccttctccattatctntcttatttggtcctaagatatgtggatggccatgttcatgtacgacatggctcgagaaacatgctcgtatgtaatgctatcggtgctatgatatgcacgacgctatatatccatatgtaactaatacgtntaatggaaaaaaaaaaaaaaaaaacccaaggggggccggaccattcgcccttaggagcgattacattatggccgcgttaaacgctaaaa

SEQ ID NO: 101929 - DNA, 854 bp, Triticum aestivum
  unsure (1)..(854): unsure at all n locations
  Clone ID: PAT_TA_101929
gcacgagcaccacgcctgcctcatctctcggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggacggcgatgatgggggtggtgggcatgatcgccccggaggccctgngcaaagtgggcctggtgcccccggagacagccatcccgtggatccagacaggctcgatcccgccagcgggcacctaccagtactgggccgacccatacacacttcttctgtgcgagatggcgctcatccgcttctcggaacaccagcgggtccatgactgatacaacccgggctccatggggaaacaattcttcctgagccttgaaaagtaccttcgcggctccggcgaccccgctaccccgggggcccatcttctacccctccggttcggacccaaaactaaaaaggatgaaggacctaaactcaagagatcaaaactgccgctttccatgtcgcctccttgcatgtcctccagctttttcccgggtcggccctgcaaacttcttaccactttaacccttaaaaaacttttctnctaaatcctaggaaattcccacctccacataaacta

SEQ ID NO: 101930 - DNA, 850 bp, Triticum aestivum
  unsure (1)..(850): unsure at all n locations
  Clone ID: PAT_TA_101930
gcacgaggagagagagagagagagagagagagagagagagagagagagagagagagagagagagagagagagagagagagagagagagagagagatagagagggggggccccctnccctcttctccctctattgtgtctcgttttacttctctctcccccttttttcaccttcttgactgtgagaaccctctcgtttcccccctttttctcctctcgccacatctccctctctctcgctctcgtgttatctcgcaggcccccactcctctctctttccctctctttctcactctctgtgtcgcgtgtccctttgtgtgcgtttatattttctcttaattctcgctttatctttgtttcatctcctctttttttttccactatgccgcactctgctcactctcttttgtatctccactgtataccccgatatggctgtgtgtttttccccttttgtgcacgagtcctctctattcgagcttgtactctctcgtcccagtgcgcgaacccttctctcttggcgctgtccccctctgcgtgccctctccctctttctattttttcgtgtccgggtgccccgtatctctctctttccgccctctggggggccccccctttttagcttcttccgggtatcccccgctccctttccctataggcgtgggnaatacctccaggcgcgctcgctctgccgctctcccctttntccctcactctccttctttaccccccaccccccccctttttttccccttccggcgcnctctgtgttcttttttnggggaattccccccaccctcttttttttttttttaccttttattttttcccccttgaacttccccttttctc

SEQ ID NO: 101931 - DNA, 500 bp, Triticum aestivum
  Clone ID: PAT_TA_101931
gcacgaggaagcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggccggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaact

SEQ ID NO: 101932 - DNA, 891 bp, Triticum aestivum
  Clone ID: PAT_TA_101932
gcacgagccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctgggcgagatcgtggacccgctctaccccggcggcagcttcgaccccctgggcctcgccgaggaccccgaggccttcgcggagctcaaggtgaaggagatcaagaacggccgcctcgccatgttctccatgttcggcttcttcgtgcaagccatcgtcaccggcaaggggccccctcgagaacctcgccgaccacctcgccgaccccgtcaacaaccacgcctgtgccttcgccaccaacttcttcccagcaagtgagcgccgtcagctcaagctctaagcccacaacctcattggctgatggatgctgctgcatgtggggcggccgccaatctctgcttcttcccgttctgaaatgagtagtccggactgataaatgtgcctgtaaggcgagtcaaaataggagttgctggggccaccccaaatgggtgttgcgtaatcctggctatcatcaaattaacaaggccttttgtacttttgggaatagaataggatacagagagaatgagcattgtggggggggccggaccaatgtcg

SEQ ID NO: 101933 - DNA, 516 bp, Triticum aestivum
  Clone ID: PAT_TA_101933
gcacgaggagaaatttgccaggtaccaccagtgtatccatcggataatacgaagatatttcaagagcttcaagatttggcaccacgtccagaagatcggcacaagcatgatgaacaacgtcctgatctgaagcatcaatgtataggttttgcaatgaatcaccaagtgatagtcgtactagggtaccacgatatccaaaactgtacagatgaggggctttgctctttatcacttccagatttctacattcctcgacaaccaggtggctaagctgctgcaacaggctaggtatctccaggaaaaataattcatcgcaggacctgagtgtcagtttctccaaagcaattgaactggaaaaaaggcaccttaactcattttctgtaatacgcacataaaaaaatttagactagtcaggcttcttaagcggccaagtgcaaccgtgggacggagggcacaattgttgagataaagctgctggatcgacttgccactcccatctaaaagtgagcatggaaa

SEQ ID NO: 101934 - DNA, 846 bp, Triticum aestivum
  unsure (1)..(846): unsure at all n locations
  Clone ID: PAT_TA_101934
gcacgagagagtgagagcaagtgtgctcttgtgtacgggcaaatgaatgagccccctggtgctcgtgctcgtgttggactgactggtttgactgtcgctgagcatttccgtgatgccgaaggacaggatgtgcttctcttcattgataacattttccgtttcactcaggcaaactctgaggtgtctgctctgcttggacgtattccatctgctgtgggataccaaccaacccttgctaccgacctgggagggctgcaggagcggattaccaccacaaaaaagggttctattacatccgtgcaagctatttatgtgcctgctgatgacttgacagatccggcccctgctaccacttttgcccatcttgatgctaccaccgtgctctcacgacagatttccgagctcggtatttatcctgctgtcgatcctttggattccacatccagaatgttgtctcctcatgttcttggcgaggctcactacaacactgctcgtggtgttcagaaggttcttcagaattacaagaatcttcaagatattattgccattttgggaatggatgagctcagtgaggacgacaagttaacagtcgctcgcgctaggaaaattcagcggttccttacccacctttccatgtngctgagttttacaggcgcacctggaagttgttgagcttaagaggggttcaagttccaggtgttttgatgggaatacaataccttcaaacagcatctactggtggagataaagaggtattgcaagtgaaagatgcaaggaaccttgtaaaactactcttcaacacctgcattacctttggggcaccgtggctttactgtgaccagatgt

SEQ ID NO: 101935 - DNA, 866 bp, Triticum aestivum
  unsure (1)..(866): unsure at all n locations
  Clone ID: PAT_TA_101935
gcacgaggcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttntgtcaactctgacattgctttgggttttccttctccatttatctttcttatttggtcctaagaattgtgtatggtcctgttcatgtacgaactgggttcaaaaacctgctccgatgtaatgctatcgggggtatgaattgcccgacgctatatatacatatgcgacattaccttaatggaaaaaaaaaaaactaagggggccggcccatcccctaggagcgatacataatgcccgcttacacgcgaa

SEQ ID NO: 101936 - DNA, 820 bp, Triticum aestivum
  unsure (1)..(820): unsure at all n locations
  Clone ID: PAT_TA_101936
gcacgagccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctgggcgagatcgtggacccgctctaccccggcggcagcttcgaccccctgggcctcgccgaggaccccgaggccttcgcggagctcaaggtgaaggagatcaagaacggccgcctcgccatgttctccatgttcggcttcttcgtgcaggccatcgtcaccggcaagggccccctcgagaacctcgccgaccacctcgccgaccccgtcaacaaccacgcctgggccttcgccaccaacttcgtnccccggaagtgaacgccctcagcttaagcttttaggccaacaacttattggttaagggagccgctgcatgggtgtctcctcaaatcttgttttttccgtcttaaattaataatcccgactataaagttgatgtgaagggcaatcaaaaaggattgggtggtgccacacaaaaggggtggggaaatcggcgtttttcaaataacaaggttctgttttgggg

SEQ ID NO: 101937 - DNA, 823 bp, Triticum aestivum
  unsure (1)..(823): unsure at all n locations
  Clone ID: PAT_TA_101937
gcacgagccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctgggcgagatcgtggacccgctctaccccggcggcagcttcgaccccctgggcctcgccgaggaccccgaggccttcgcggagctcaaggtgaaggagatcaagaacggccgcctcgccatgttctccatgttcggcttcttcgtgcaggccatcgtcaccggcaagggccccctcgagaacctcgccgaccacctcgccgaccccgttaacaacaaccgctggggccttcgcaccaacttcgtccccggcaagtgaacgccgtcagcttaagctctaagccgacaacttcatggctgatggatgctgctgcatgtgtgtcgncgtcaatctctggttcttcccgtcttaaattaatagcccggatattaatgtggatttaaggccaatcaataagagtggggtgtgtcactcaaaaggggttgggaatatctgcttttctcaaatataaagctcttttttttggtaa

SEQ ID NO: 101938 - DNA, 838 bp, Triticum aestivum
  unsure (1)..(838): unsure at all n locations
  Clone ID: PAT_TA_101938
gcacgagccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctgggcgagatcgtggacccgctctaccccggcggcagcttcgaccccctgggcctcgccgaggaccccgaggccttcgcggagctcaaggtgaaggagatcaagaacggccgcctcgccatgttctccatgttcggcttcttcgtgcaggccatcgtcaccggcaagggccccctcgagaacctcgccgaccacctcgccgaccccgtcaacaacaacgcctgggccttcgccaccaacttcgtnccccgcaagtgagcgccgtcagctcaagctctaagccgacaaccttctggctgatggatgctgctggatgtgtggtcgcntccatctctgcttcttcccgttctgagattgaatagttcggactgatagatggtggctgtgaggggcaagtcaaagaagatttggggtgtgtccacacaagaagggggtggggaaatctgggtttttttcaaataaataaggctctctgtcttttgtt

SEQ ID NO: 101939 - DNA, 896 bp, Triticum aestivum
  unsure (1)..(896): unsure at all n locations
  Clone ID: PAT_TA_101939
gcacgagaaacggactactgggcgatcgatcccgagaccaatcctgaccttgtcacggtcgagagggtgtggcagtgccaggggcgtctgctgagttcggatgtggatggcggcgagacgatgccggcggcgcttaagcacaaggatctgtgcctttccttcgcgctgttcaagcttctccggcggcggctcggtcggtacccactccacgagtcatgcctcaacaagacaagggacttggtcaagctgggcctcctcgccggagacgaccacgagagggtgtaccgtgtggtggaggtcgagctgggcttcctcttcgatttctactacgcaaggtaccggtcgcccaaggagaccctcatactggacacgcttctcttcgccaccgttgctgcgacgagcctgtgcactctgttctcgttggcggcgcttgaccaccgcgcccaacaaaggcaagcctaccctgacacggtcaccaccgtgttcgacatctggctgacaagaatgatgatcgtcctgttcttgatcctagagtcgctccagtacttcacgctggtgttctcggactggcacaaggtgaaggtgctgtgccggtacgtgctgaacgaggcctggcacaacagccccttcctggagcgaatcctggcgttcatctgccgtgtcaagctgacaccgtactggaacaactccctggggcagcactcgctcttgcacgcctgccaccggtacgagcagggccgtctgcgccgcgtttgggggcttgagctccccggacggatcgcgggcttctcatccggaacaggagacggatcgccgaactgcccncccggtgaaaaaccctcttcttttcttagaccgggtgacgcggatcaaacgcagtcaccttagaaccggga

SEQ ID NO: 101940 - DNA, 842 bp, Triticum aestivum
  Clone ID: PAT_TA_101940
gcacgagattttcttaactgtttttggatatagttttctcaacggctctgtctgcaaggggcatgttggagaggctaggagcaaggattttgtagtagagatatggtctgggatggaaacattgggagatatgttgctgggagcaaaaaaaatatgtacttgtcagtttcctgttatctctttctctccctgtctcattgcacttacatgtaattttaccctatgtccgtgcacaaattttaatctttgccagaaaccaaaaagaagaaaatgtttaaacctgttgctggcatcttagaagccgttgcaagctttgaccatatggactagcttttgtcgattaaaaacatataggtagttcttgtaagatactttcatctattctctaatttacttgcagtatgaatttttcaccaaattggctgttggagaaaatgcttgcttgagaattaagagttgaatgctggaatgacagaatatgagatactgaaaaaggaaatattgccctttagtggtgtcattttatgaagtgattggcctcattagcaaataataaataaaaatgaagtgattgcgctcttttctatttggtgccccaattttatactgaacttggcatttagataaaattaaaggtgttgtgttttttttaacaaatctaaattgtattgtcttatgcaaaattaccaacccttgccatttatgttccacccttctaaatgtttcctcttccatcgaattatttcgcgagagtactgcaaagatattggataaatcctataggtcgaatttatattggcacatcttccccgtcgttgtgaaaaggtcttacttgaaaacct

SEQ ID NO: 101941 - DNA, 850 bp, Triticum aestivum
  unsure (1)..(850): unsure at all n locations
  Clone ID: PAT_TA_101941
gcacgagagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagnntttcaactctgacattgtttgggtttccttctcattatcttcttatttgtcctaaaattgtgattgtctgttatgtccaactgctcagaaacatgctcttgtaatgcttccggggtatgattgcaggaccctatttatacatatgcactattaccttaaatgtaaaaaaaaaaaaaaaaaaaacaaggggccccgaccatcccttgggattataaatatggcgcgtacactggacggaacca

SEQ ID NO: 101942 - DNA, 866 bp, Triticum aestivum
  Clone ID: PAT_TA_101942
gcacgagctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacacatgcgccaggtgcagtgcgtcagcttcatcgccttcaagccaccgggctgcgaggagtccggcaaggcctaacagctcactcaccacgggccacatataaagtgccattggcggttttggcaactctgacattgctttggggtttccttttccatttatctttcttggtgggtctaagaaagattatggatgtccttgtcccaaatgactcaaaaaactgctcgattggatgcttccgaggctttgtttcccttgccctatatattatccaatctgcgaaaaaaaaaaaaaactgagggggccgggaccatcccccatggaagcatttcaacactggcgcgttacaacgcgaagggaaacctgctta

SEQ ID NO: 101943 - DNA, 848 bp, Triticum aestivum
  Clone ID: PAT_TA_101943
gcacgaggagagagcgaactactctcgagtttttttttttttttttttttttttttttttttttttttttttttttttttttttttttaaaaacaatgggccccgtgttgtatttaaaaaatatcacaccgggtttgtttttttgtacccgggtctaaaatttgcatttgcctgcccgaaaacctttgttcggcccttccttccccgacctttttgaatgaaaaatttgctctgggcctcccccaaaatcgtggacaaaagtgacgttcacaaaaaaccttttttccttggcccttgtttcaactcgtagtttagggcttgccaaactccttgcaacccggggggctgaaggggataaaacttaccccctgcccctggcgcagggtgtcaaaacccatgaccccgacattggcgtcaggggactcctttttgacctcctccacctctttgagcacctgtgtggggtcggggccccccaacatagggagcttccacattgtccactatcgaccgtcattatatccgggggaacttttgggctcacggaagacaaaaccaaccttgctgaacttgagggagggccccccttggagcggatcaagtgttcaacctgttcaagaggggcccgcggagaggggtggcaggaaaaacgggttttaactttttgagccctaattggcccacccgattccccgatccttcccccttttaaacttttaagccgcccttttgaccggggtattggccgccccggcacttaaacctaaggggcaaggggtgccagaaccctaccggggcctgtttgagaaaagggcggggggcccccccctccccttgggctatacatc

SEQ ID NO: 101944 - DNA, 854 bp, Triticum aestivum
  Clone ID: PAT_TA_101944
gcacgaggacagacatacatagataaacacagacacagacacacatacagggggggtagcaaggtcgaccaagcagcaccgagatggctgctgccttctcctccaccgtcggtgccccggcttctactccgaccaacttgctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtactcagctcctacgagtacgtcagccaaggactcaagaagtacgacttcgacaacaccatgggaggcttctacatcgctcctgctatcatggacaagcttgttgtccatctctccaagaacttcatgaccctgcccaacatcaagagcccactcatcttgggtatctggggaggcaaaggtcaaggaaaatacttccactgtgagcttgtcttcaccaagatgggcatcaacccaatcatgatgagtgccggagagctggagagtggcacgccggagagccacccagctcaaaggcagcggaccgtgaggttgagactgatcaagaggttagatgtgctgctttataacgacttgcgccgtgcggtcgatggcggacaccagtcaccgcacaccaatgtgacgcccctatgacatgcatgcccacacggcagtcagctgtcaaggagaaacttgtgcctgtgcctgtacattccaaaa

SEQ ID NO: 101945 - DNA, 840 bp, Triticum aestivum
  Clone ID: PAT_TA_101945
gcacgagggcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccggcaacgaggcccagtcccgccgctccggcggcgggggcggccgttgaggctaccgacggtcacgcgcttgcagcggagttccacgcgcacctgtggccgctaccgctgccatgacgatgctcttactgtccgcgctctcccgcattttctgcacgcgctgactgctcgtccctgcttccgcgctggccctatcggtacgttactgcccgccccagttgagttactgtccatagattcattccagccagtgtttattattttccaattgacagttacactaagtaagtcgagtatacgtagggtaagaacgcattgttaattttagacctactatacacccagggcgcgccacggaggatgccggaggataaccatcctccctcactcagcgcctcactaccgccatccctcaatttcttcacaccaccccccgctcgccgcctatccacccccgctccactgcccgccggagcactccgccgtgggct

SEQ ID NO: 101946 - DNA, 865 bp, Triticum aestivum
  Clone ID: PAT_TA_101946
gcacgagggcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcggcggtggcggctacggcggccagggccggcggctgcttcggccaaggcggcggtggctgctactgctcaggcgggtgggggctacggcggccaccttggtggacgctggctaccgatgacggtggccgtggcctcccgctggtccgcgctggtggctactcccggctgtcccttggaagtactctgagcgttggcgttcctacccgtgtatgtactttcaccctatcatgtctctagtcgcttcttgtctttattctgtatccttctctttgctcccccgatcctcattatcgctgtgtctctctcttcctctcccaccgtccctatcccgcctatcctctctgcacccactcacactatatttatactgatatctttctttctatccgtctttattcgtcttttctcgtgttctctttttaa

SEQ ID NO: 101947 - DNA, 779 bp, Triticum aestivum
  Clone ID: PAT_TA_101947
gcacgaggcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggccaagcctaaacagctcactcacgacaggccatatataaagtgccattgcagttttgtcaactctgacattgctttgggttttccttctccatttatctttcttatttggtcctaagatatgggtatgtcactgtcatgtaccacatggctcaagaaagatgctcgtatgtgaatgctatcggggctatgtatatgacggacgcataatatatacattatgtcacc

SEQ ID NO: 101948 - DNA, 807 bp, Triticum aestivum
  Clone ID: PAT_TA_101948
gcacgagccatccttcattttagatttttccttccccctcacgcacaccctgacacggcacggccgtacccgtacatgctcatgaagatcgggtgcgacgcgtgcgggcaggcggaggccacggtgctgtgttgcgccgacgaggccgcgctgtgccgccgctgcgacgccgccgtgcactccgccaacaagctcgccggcaggcaccaccgcgtcgcgctcctctcctctgcgccggccggctcgtcatcgcccggcgccggcgacgacggtgggacccaccccgcctgcgacatctgccaggagaaaacgggtcacttcttctgtgtggaggacagagccctcctgtgccgaagctgcgacgtcgccatccacaccgcgactccccatgcttccacccaccaccgattcctcatcaccggcgtccgcgtcggtgttgatcaggaccatattggcgatgtcagtggcgccacagtcggcagccccagcaacagcagcgccaacggaagcaatagcatgcccacctccgagaacttcgccattgccaacggccagcggtcggaggagggggcggggctgatcggaggaggagaagatgacattggccagcagcagcaatggccttggagcgatatttttgctgacgatggcgttggcatggataacaccagtgctccctggctttctgacctggttcctcagctactgatgatgaagctaactaaaggattattacgtctccattctatacttgtgtgattatacatggacggaggagttgtttggatagttgtgaaaggttatatt

SEQ ID NO: 101949 - DNA, 849 bp, Triticum aestivum
  Clone ID: PAT_TA_101949
gccatccgggcactggccacacagctcccggcgtttcgtcagaaactgagcgacggctggtatcaggtacggattgccgggcgggacgtcagcacgtccgggttaacggcgcagttacatgagactctgcctgatggcgctgtaattcatattgttcccagagtcgccggggccaagtcaggtggcgtattccagattgtcctgggggctgccgccattgccggatcattctttaccgccggagccacccttgcagcatggggggcagccattggggccggtggtatgaccggcatcctgttttctctcggtgccagtatggtgctcggtggtgtggcgcagatgctggcaccgaaagccagaactccccgtatacagacaacggataacggtaagcagaacacctatttctcctcactggataacatggttgcccagggcaatgttctgcctgttctgtacggggaaatgcgcgtggggtcacgccgtggttctcaggagatcagtacggtagacgaaggggactggggtcaggtcgaggagattggacactgatgcaaaatgtgttatgagaaatcatctgacggcggtttttaactttctgcgaccttcgagaatgcggaacggcactttcgacgggcttaccccgcccaagcgacagacggcgtatggtatgctgaaggacaagctgtttctatttatttatatcgcctcatttacatgcagtcactctacaatatatgtgctgtgaaaaacaaagttgacaataggtttaatattttaatcgtttagtggattagtcgatatttgaatctttctgtaatactggtgaaggtaaaattcggtgga

SEQ ID NO: 101950 - DNA, 823 bp, Triticum aestivum
  Clone ID: PAT_TA_101950
gcacgagaagaagggaagggaggagagagagagagggagtggataaggcgggccccaccagtcagccacaccggagccgtcccgcgttgacccaggtgccaatgtggataagtgacgggtcccaccccgcgagacccgcacgttagcgacccacgcccgacctcgccactgtccacgtggttaagtggaaacgtatttcccagagtacgttttcttcagacgaaatcatattcttcctttcttttatcgaaagtacgttttcccttccggaaagcgtattcctctcttctgcggctggagagccgttttctttcacagaaaacgtattaaacctgaaggcgctttgtgtttttctgtgcatgcccagattttgaagttttttcattacagatgggtccctggcagaaaacacctcatatctttttaaccacaactgcaaatgaggtgattccaaaggccactttttcgtttcatggagccccgtctgatggacccattttgcccatgtatttggcattcttgaaatgaccatttggcccttggctttttccgcctctcgtgagagtcgttcacgggcattcttagggccgtttctttcacttgtagtgggggttattgcgcccgagtgatgccttgtcgttgttcgggctttcggtgcacactcatattccatgcctcccctcggccggaatcagtcgctggcagcgacgcgcatgagtgtggacggggcacgagtaacgtgcccgcccgcgcgccgtccacgcgctgtcgcatgcgctcgttcttcgtgccgccacatccgtgtggcgagggtggggattgg

SEQ ID NO: 101951 - DNA, 857 bp, Triticum aestivum
  Clone ID: PAT_TA_101951
gcacgaggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcatcggtaggggagcgttccgccttagagggaagcaaccgcgaaagcgggggtcgacgaagcggaagcgagaatgtcggcttgagtaacgaaaacattggtgagaatccaatgccccgaaaacccaaggtttcctccgcaaggttcgtccacggagggtgagtcatggcctaagatcaggccgaaaggcgtagtccatggacaacaggtcaattttcctgtactaccccttgttggtaccgagggacggaaggaggttcggttgccgaaagatgggttatcggtttaaggaccatagtgacactgctttttaaggaaaaaggggaaaaaaataccaaaagggggggccgaaccccatacaccttcacactaactaaatcagctgcactacaataccactaacactggcgaaactgaaatatcaccttatccactacgattacatctataccaatatatcgtcacgatcgcacctacattactattcgtgcgcttgtcagttgctatgaagagataa

SEQ ID NO: 101952 - DNA, 856 bp, Triticum aestivum
  Clone ID: PAT_TA_101952
gcacgaggagagagagagagagagagagagagagagagagagagagagagagagagagagagagagagagagagagagagctcgtgcctgattgagtgcgagggggggtcatatatactccgttcctgccgtatgttactcagcgggagatctctcgcttactgtccgttcggttgattcattgcgcgctcactctatttatctagatcgttctctcgttctctttctcactcactacttgctatccatccctgtcgttgtatctttcgctctctgtactctgtatgcttggcatgtgtcttctctgtccgttctctttgtttacgattctgtcttactctccctttgacgaactttcttacgtacttgcttgtattcacctccttgcggcgctcttttagtcattctagttgcctgtctccctgctcgttcctatcgtcgcgttctttctcgctctcgtttcgactttatccctcctggttgcatcttgcttccttaactcccttcacttgtctactatgttcggctagcaattttttcttcgccccccttgttctttttatcggtccatacatttccttttgctgccgtcactgctttttttctcttctccacctcttttacctacaatatctttttgtgggtcggccctccctttcgttctctctttcgctttttctttttccctccccccctttttccttggcgtctttggttacccctcgctgtcccaccttattcgcttgcacgtttctcatcttttctccgcctttttctttttgccccctccttgcttcctcccttcttccttctttctctgttcttttgcacgttttcttcatcgcttcttcttctg

SEQ ID NO: 101953 - DNA, 831 bp, Triticum aestivum
  Clone ID: PAT_TA_101953
gcacgagccgatcaccagcacagccgcgcatccaccgttgctagcaaggtcgaccaagcagcaccgagatggctgctgccttctcctccaccgtcggtgccccggcttctacgccgaccaacttccttgggaagaagctaaagaagcaggtgacctcggccgtgaactaccatggcaagagctccaaggccaacaggatcacagcgatggcagagggaaaacctcgactacaagaggaacacggacaagggaaagggtattgcaccccatatctccaacgaccacgacgacgtcaccacacggaaggccatcgtggcactcattcttaccaacgctcctagactacggtgcgtagtaggactatataatatactaaaattccacccgccactgaccttgcaacggcaactcgacggccagcgggatgtctagctagtctcggatatatagatgacccgatacgtcgtgatagcaactcggaaccagcaactagatgaaagacatgtaagtgcgcgtagcgaagcaagtgtgacgcagccaagccggtgtggtccaaggttcgcatctttactaacacaattctcgcccgacgatggaaaaaagcgcacaatgatcaacacttgaaccccccaaccagaataacaaccctatcaagcgcgagtgaggaggatacgacgataacgtacatcagtacaccagtgcggggcatgatgacatttgacgtggccgtgtgttcactactgcactactgtcagacttacctaatacaattcgctacacgaaataatttttacactcccggccagtcgcggatgagtaacattaaaacag

SEQ ID NO: 101954 - DNA, 774 bp, Triticum aestivum
  unsure (1)..(774): unsure at all n locations
  Clone ID: PAT_TA_101954
gcacgagacacctttaaaaaatgctgaaaacagccaaggaaccgtagcaaccgactggttcttcttcccggatttcctctgcctcctccccacagtccacgccaccgccaccaaccactccggtccacccccgctcccgcaccagctccactccaccgacagccgccggccgcatgacggtgttccggggcccgcccggccggccctcggcgctcgtgagctggtggaggaggcgcccgccgctgggcttcgccgccaaggtctccatcgccatcgcgctcggcctctccttcgtcgtcacctggaccacgctcgccccgacctcctcctcccagcagatctccaccgagcgcacctacttcgccgccgacgtcgccgacccgccccctggagcgctggcgcccccccgcaacgccaccgcccgcgccgtccacaggaagccccgccccgccagcccccgcgcccgcaagaagcgccgcgccccgcctggatcccgccgccccaatgccaccccctcgcccgacgccgccgcgctgaggtccaacctcaccgacccggacgcgaggcccgagccggaacaacccaacaagccaaagccggagtgggagtgggaggacaagcaagagccggaactgtccgtgccggaggacgacgcggatgccacggggaaggcngcccaggaggaggagaacgacgacagggcgccggccctggatgggccgaccaatccgcgagctggagcccaggaggagaggacccngagggcgccaaggc

SEQ ID NO: 101955 - DNA, 817 bp, Triticum aestivum
  unsure (1)..(817): unsure at all n locations
  Clone ID: PAT_TA_101955
gcacgagcctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgngtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggggcagtgcgtcagcttcatcgccttcaagccaccgggctgcgaggagtccggcaaggcctanacagctcactcaccacgggccacatataaagtgccattgcngntttgtcaactctgacattgctttggggttttccttctcctttatctttcttggtgggccctagaatatgggatgtccatgtcatgtaccacctgtctcgagaaaactgctctatgtaatgcaatcggggtttgatatgcactcacatatatattatccatctggcactatgatccggtaatataatagacctctttgcccg

SEQ ID NO: 101956 - DNA, 898 bp, Triticum aestivum
  unsure (1)..(898): unsure at all n locations
  Clone ID: PAT_TA_101956
gcacgagtaattatccatggcagaccggcacataatcatcatcgtcttcgcctccatcctctccgccatggcggtcgtcggcatagtattcatctggacacgaatgaggcccaggagagactacctccacgacgacatggacggctcaggcgagatcatccgcaccatcatgtcgtcgcagctcggcttccggtacgaggagctgcgcaaggcgaccgatgacttcaatcagatcaacaagctcggccagggcggctacggttcagtttacaagggcgtgcttccggatggccgggagatcgccgtgaagcggctctacctcaacacgcggcagtggaccgaccagttcttcaacgaggtgaagctcgtcagccaggtgcagcacaagaacctcgtcaagctcctcgggtgcagcgtcgagggccccgagagcctcctcgtctacgagtacctctgcaacaccagcctcgatcactacctctttgatgctttcaagaagaatgcgttggactgggagcggcggtcggagatcgtcctcggggcggcggagggtttgtcatacctccatagtggctccgaggtcaggatcatacatagggacatcaagggccagcatgtgatgttggatgagaggttcanacctaagattggcgatttcggcttggcaaggaacttcatggaagatcagacccacctcagcaccggcctcgccggaacattttgatatatggctcccgagtacatcgttcacgggcaggtgacgganaagggccactctatagctacggcgtgctggtccttgagaatcgtaccggccgaagaaccacacttcgtggcgtatcggccagggggtgtcctatgtacagtattgaagccctcacgccggaccctctggagc

SEQ ID NO: 101957 - DNA, 837 bp, Triticum aestivum
  unsure (1)..(837): unsure at all n locations
  Clone ID: PAT_TA_101957
gcacgaggagagagagagagagagagagagagagagagagagagagagagagagagagagagagagagagagagagagatagagagagagagagagagagagagagagagagagagagagagagagagagatagagggggggtcccgttccccattttcctttttttgtgtcgtattcctcttccctgccctctctttttctgcgtcgtgactgcgcatacccctctcttccctctcttgctcctctttctgcgcatctctctttctgcgagtgtgtgtatttgtgtatatgctcgctcctttctctcttccctcagcttcttctttctcctttgcgcctggctgcttgtatgcctttatatttttttatatttcacctttattttttgctgtatctgctcctttttgtcccaataggcctctcttcgtctgtctccctctctcatccccagggtcgaccccactgtgtttgtgtgtttgtcctctatgtaccccctctcccctattaagtttcttggtctccctcgtgcccgtggcgctctacctctcttcctttccggtggccccctctttaactcttcccctattagttttttagcggtcccggtgccctagagcactagatctagagcctggcgtttccgctcttttttttttntcttcctatcctttttcctctccccaccgctgttattactcttttgggcctctttgggctttttgtgttctttcgcnccctcacccctctcttttttttttccatttttgtctttgtggcctttcggaatttccttttctttttgtttttggtttcnttttttttcccttccccttttc

SEQ ID NO: 101958 - DNA, 555 bp, Triticum aestivum
  Clone ID: PAT_TA_101958
gcacgaggagagagagagagagagagagagagagagagagagagagagagagagagagagagagactgagctcgagttttgttgatttattgcgcgatcattttcttgatatagatcgcgctcgcgcgtctctttttctctcgtgactgtgtgtccttgccgggtcgtttacctgtagcttcgggtggtattcctgtttggcttctgccagctctgacgcgcatctttggggaccattctctatctctctccggtggcggagctgtcggacatccttggggatatgcacctggtgcatcagctactcctgtgggttttgaagcctgtgtacaagctcgtaacgatgggcgcgatctttctctccaaggtggtgacattatggcgcgcatcttgctcatggagtcctgaactatctccagcttgtgaggtatggagggcgatcctattcgagttctagccggtatatactattgatctgtatatatatctagcgataaagtactataggtatgtatatatcactaacgatctagaagagaaggtataaatctctag

SEQ ID NO: 101959 - DNA, 259 bp, Triticum aestivum
  Clone ID: PAT_TA_101959
gcacgagattgattttggcactcactcccgtgttaaccatcaactgcatgcatgtaatagtttttggtaaatccccgtcgacccgatcacacacccagtcggagcggttagcgggttaaggcatgtacagtcgccgtaccaccctgcacttggtgcacctgtagtgctgtactgtgcaagtgtgtctatgctcgccttgcgtccgggcgcgggtacgtgcagcgggccactgtggcagtcgcactgtggttggtttatt

SEQ ID NO: 101960 - DNA, 865 bp, Triticum aestivum
  Clone ID: PAT_TA_101960
gcacgagcccccgcgtccctttccgcgccgacgcggcggctgccatgtgggagcacttcccgccccgggcctccgccgggagccgcggccccgcgccgccctaccaccaccaccaccaccaccagcagcagcagcagcatgtcgcgccgcccgactaccagcagcagcacgtcgcgccgcccgactgccagcagcagcatgccgcgccgcacggcgaccccgacccgctcgcctccgactggatccgccgcctccacctcgccccgagcccgccgccgccgcgcgccagcctcgcgcccccgccgtcccacgaccacgacgccgtctccgcccgcagcgccgggttcggccccttccgctggagcccgcgcccgccggtcggcgcccctgccccatgtggcggtgggggcgccccgccgatgatgtcgccgttcttccgctccccgactcagccgctcccggcgctcgcgggtgtcggggagttcccgcccgtcaggcccaccatcgggttcggcagcgggttccccgtgtcgccgtcgacgacagtgcttggtgtcaaccctcacgcatcttgggtaccgacggcagctgcaggttcagcttatcctaaccatgatgtggacatggttcccataagaacttctcatgatctccatgttagacgacacagcatgatcccacaaattttgcaaggcgcacccctagttcagcagcaacacgacagcctttcactattggacatggggaggtccagagagaccacgactcgtcgactctcagtgctgtgaccttgtatttggaagagaggacgtactaacaatgtgctctctaatccaaactagggggtggaaaaccacctgggcca

SEQ ID NO: 101961 - DNA, 822 bp, Triticum aestivum
  unsure (1)..(822): unsure at all n locations
  Clone ID: PAT_TA_101961
ctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcgggtntgtcaactctgacattgctttgggttttccttctccatttatctttcttggttggtcctaagatatgtgtatgtccatggtcatgtaccaacatgtctcgagaaacatgctcgtatgttaatgcaatcggtggctatgtatatgcacatgcacatatatatttatccatctgccactatgattcggtaattattatgagaacatttttgcaccgacgc

SEQ ID NO: 101962 - DNA, 892 bp, Triticum aestivum
  unsure (1)..(892): unsure at all n locations
  Clone ID: PAT_TA_101962
gcacgagctcctcctagcaagctatatacctacatagtacagccatggcccccaccgtgatggcctcgtcggccacctccgtcgctcctttccaggggctcaagtccaccgccggcctacccgtcagccgccgctccaacggcgctagcctcggcagcgtcagcaacggtggaaggatcatgtgcatgcaggtgtggcccattgagggcatcaagaagttcgagaccctgtcctacttgccaccgctcagcacggaggccctactcaagcaggtcaactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgaggtttccttctacatttatctttcttatgtgatcctaaaatatgtgtatgtccatgttcatgaccaacatggctcgagaaacatgctcttatgaaatgctatcngtggtatggatatgaccgacgctaatattatcatatgtcactttttcgttttatggtaacaaaaaacaaaaaanaaaaaaacttcagggggcccggacccatccccttaaggagcgtttaaatcatggccgcggttcaacgttaacta

SEQ ID NO: 101963 - DNA, 866 bp, Triticum aestivum
  unsure (1)..(866): unsure at all n locations
  Clone ID: PAT_TA_101963
gcacgaggcaccacaagcccaaggtgctgctcgacaagatcgcctactggaccgtcaagtcgctgcgcgtgcccaccgacatcttcttccagaggaggtacgggtgccgggcgatgatgctggagacggtggcggcggtgccggggatggtgggcgggatgctgctccacctgcggtcgctgcggcggttcgagcagagcggcgggtggatccgggcgctgctggaggaggcagagaacgagcggatgcacctgatgaccttcatggaggtggccaaacccaagtggtacgagcgcgcgctggtgctggcggtgcagggcgtcttcttcaacgcctacttcctgggctacatcgtgtaccccaagtttgcgcaccgcgtcgtcggctacctcgaggaggaggccatccactcctacaccgagttcctgcgcgacctcnaggccggcaggatcgagaacgtccccgccccgcgcatcgccatcgactactggcgcctccccgccgacgccaggctcaaggacgtggtcaccgtcgtgcgcgccgacnangcgcaccaccgcgacgtcaaccacttcgccgcggacatgcatttccaggggctggagctcaacaagacgcctgccccgctaggatatcactgacgaatgaatgccangccggcttgactctgccttttcantaaagaccaaagtcgttgctattatatgtgcngataggtagggactggtgcttgaaaataaaacgggctttgtaccagactcccaaattctcaaaaactatcgggtcctacccttaaaaaaaaaaanaaaactttaggggggccctcccctttcccttantagcntttacataatgccggctttaaa

SEQ ID NO: 101964 - DNA, 848 bp, Triticum aestivum
  Clone ID: PAT_TA_101964
gcacgaggactcgccggcgtacgagtacccgaaccagcagcctcccggtaacctctggtaccacgaccacgccatgggcctcacccgcgtcaacatcctcgctggcctcctcggcgcgtaccgtgtcgccgacccggcagccgaggcgcccctcggcctcccctccggcgcggagttcgaccggaacctcgtcctcttcgaccgcgacttcaggagcgacggcgcgctcttcatgaacgccacgggcaacaaccccgacgtgcacccgcagtggcagcccgagtacttcggcgccgtcgtcgtcgccaacggcaaggcctggcccttcctgcgcgtgcggcgccggcggtaccgcttccgcatcctcaacgccagcaacgcgcgcttcttccgcctctcgctctccggcggcctccgcttcgtgcacgtcggctccgactccgtgtacctcgcccggccgttgcccacggaggggttcttgctcgcgccgtcggagatcgcggatgttgtcatcgacttcgccggggccaagcacgacgcggtgaccctgcggtccgacgcgccggcgccgtaccccggcgaccccggcgagaagggggatacgggggccgtgatgaagatcgggggcgcgagtaacccggacacgacccggtgaccgggccgtgacgctatgtcggggaccctaacccgacccctggagcgatggaacctatttatttcctggccaagtcgcaggacttctcggtaagtcgacatccggcgcagagggggtgagttcatgataacaattgatgcatgtggggtccacgcaccggtagacgattaaggcggatacgcacaaccaccaa

SEQ ID NO: 101965 - DNA, 502 bp, Triticum aestivum
  Clone ID: PAT_TA_101965
gcacgaggcaagaagcacacaggaagctcctagccaacaccaatcaaagcctccatccaatcccaagcaacctcgaggatgtcttgctgcggaggaaactgcggctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatctcccgtggtttaaccta

SEQ ID NO: 101966 - DNA, 861 bp, Triticum aestivum
  Clone ID: PAT_TA_101966
gcacgagctgccaccttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaatgagtaccctgacgcctatgttcgagtaatcggctttgacaacctgcgccaggtgcagtgccgtcagcttcatacccttcacgccacccgggtgcgaggagtctaggaaggcctaacctaccagtaggaacatggcctatggttgaacggattttgtgaacttaacttttgaacaccactctgctggacgaccataacatattctgaatactatattgactgagtgcgtatggcccaatctacgcattctacctccattagtagtgcaccaccggttaacatatacaacgctgcgtgaatagtttatcgagaaggaaaccagaaatcccggggagctcggcaccaatgcctatacagaccgttcctaagctgccgatattaactatagatagatgactaggcactgcctaactccg

SEQ ID NO: 101967 - DNA, 858 bp, Triticum aestivum
  Clone ID: PAT_TA_101967
gcacgagcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcggcttcaagccaccgggctgcgaggagtccagcgaggcctaaacagctcactcacgacaggccatatataaagtgccattgcaaggtttgacaactctgacattgctatgggttttccttctccatttatccttcttatttgtccctaagatatgtggatggtcatgttgatgtacaacatggctcgagaaagatgctcgatgggatgctatcgcggcttgatatgccggaccatatatataaaagtgcactttatcttaatgggaaaaaaaaaaaaaatcagggggcctgagcatcggccatccggacgaacacaatgccgcctcacag

SEQ ID NO: 101968 - DNA, 822 bp, Triticum aestivum
  Clone ID: PAT_TA_101968
gcacgagtctcctccccttccggttcgggttctggttcggttcgggttcggttcgagagagaggccgagtagctagcctagtctagggtttcggtagagaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcggcggtggcggctacggcggccagggcggcggcggctacagtcagggcggcggtggcggctacgggcagggcggcggtggctaccgcggccagcgtggtggcggcggctacggcggcggaggcggtggctaccgtgggggctgtggtggctcccgcggccatctcgttgctactacgggggaccgtggaagaactgaccgcgcggcctcgacagtgaagttcttcctcgctcccgctccgtgcactctctcggcgcgacgaagtaacacttggggtcccgtttcgcatccgttagacacgtggaggcgtactgagaacaaagaaacacgttccgtctcatttcgttaatcatcttgtgtccgatattgtcgttcggtgatcgccg

SEQ ID NO: 101969 - DNA, 877 bp, Triticum aestivum
  unsure (1)..(877): unsure at all n locations
  Clone ID: PAT_TA_101969
gcacgagcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgagctacctcaccggtgagttccccggcgactacggatgggacaccgcggggctctcggccgaccccgagaccttcgccaagaaccgggagctggaggtgatccactgccggtgggccatgctgggcgcgctcggctgcgtcttcccggagctgctcgcccgcaacggcgtcaagttcggcgaggccgtgtggttcaaggccggctcccagatcttcagcgagggcggcctcgactacctcggcaaccccagcctcgtccatgcgcagagcatcctcgccatctgggcctgccaggtcgtgctcatgggcgccgtcgagggctaccgcgtcgccggcggcccgctcggcgagatcgtcgacccgctctacccccgcggcagcttcgaccccttgggcctcgctgacgaccccgaggcgttcncggagctcaaggtgaaggaaacaagaacggncgnctcgccatgttctccatgttcgggttctttcggcaaggcatcgtaaccggcagggcccttttagaacctcgccgaccacttgccgaccctgaacaacaacgctgggccttgccccaacttctgcccgcaagtacctgtagggtttggtttgtctgaaacgacctgcccgtctacttcgccacaaggtgccctcttcca

SEQ ID NO: 101970 - DNA, 852 bp, Triticum aestivum
  Clone ID: PAT_TA_101970
gcacgaggtattctctacctacccacctgtgtcggtttcgggtacaggtacccttttgttgaaggtcgttcgagcttttcctgggagtatggcatcagttacatacttcagcgccgtagcgcctggtatgagcctcgtggagaagcaatcgctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccctccgtaccaacaaggggtagtacaggaatattgacctgttgtccatcgactacgcctttcggcctgatcttaggccctgactcaccctccgtggacgaaccttgcggaggaaaccttgggttttcggggcattggattctcaccaatgttttcgttactcaagccgacattctcgcttccgcttcgtcgacccccgctttcgcggttgcttccctctaaggcggaacgctcccctaccgatgcattttgacatcccacagcttctgcagatcgcttagccccgttcatcttcagcgcagggcgctcgatcagtgagctatacgcactctttaaagggtggctgcttctaggcaaccttcttgctggctttgccccccacctctttatcactgagcggaatttaggggcttacctgggatccgggctgttcctctcaccataaactatccccttgctactggcgacttacccttgtttttgggatattagataaaagtgcctcatcggacctccgcatccgccaaaatgctaccctaagaccccca

SEQ ID NO: 101971 - DNA, 847 bp, Triticum aestivum
  Clone ID: PAT_TA_101971
gcacgaggcggtggatacctaggcacccagagacgaggaagggcgtagcaagcgacgaaatgcttctgggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctacatggctaaagtccagtagccgaaagcatcactagcttacgctctgacccgagtagcatggggcacgtggaatcccgtgtgaatcaccaaggaccaccttgcaaggctaaatactcctgggtgaccgatagcgaagtagtaccgtgagggaaaggtgagaagaacccccagtgggtagtgaaatagaacgtgaaaccatgctgagcctccaagcatcgggaggggaaaaggatctttgaccgcgtgccctgttcaataatgagcctgcgactcataggcccggcttggttaatggaacagaacccaccggagcctttctaaagccatttttaataggggatatgtactgttcttgacccaacctcggtatctttgctcacccgactcacactgattaaacctaatcagggtcgaccggctgactcgaacatcttccatacagcggctcgggtaactcctctcaacaaactatcatctctacaactcactgacccctatattcatatatgacgcctctactcgccgca

SEQ ID NO: 101972 - DNA, 1034 bp, Triticum aestivum
  unsure (1)..(1034): unsure at all n locations
  Clone ID: PAT_TA_101972
ggtaaataagtaccagctccngccntggggcngcacttctagactagtggatcccccgggctgctggaattcggcacgagctagcaagctatatacctacatagtacagccatggcccccaccgtgatggcctcgtcggccacctccgtcgctcctttccaggggctcaagtccaccgccggcctccccgtcagccgccgctccaacggcgctagcctggtagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatggccatgttcatgtacgaacatggctcgagaaacatgctcgtatgtgatgctatcgggggctatgatatgcccgacgcatatatatacatatgtcactaaaaaaaaaaaaaaaaactcgaggggggccggaccattcgcctatgggagcgatacatcactggcgcgttacacgccgactggaaaccggcgtcccataatcgctgagaatccctttccttgggatacaaaggccaccacccttcacattgcactatggaaggaatgactaattgtaata

SEQ ID NO: 101973 - DNA, 906 bp, Triticum aestivum
  unsure (1)..(906): unsure at all n locations
  Clone ID: PAT_TA_101973
gtcatatagttaccgctccgtccctgnagcnngacctctagactagtggatcccccgggctgtatgaattcggcacgagcctcctagcaagctatatacctacatagcacagccatggcccccaccgtgatggcctcgtcggccacctccgtcgctcctttccaggggctcaagtccaccgccggcctccccgtcagccgccgctccaacggctcgtgcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttgtttgttcctaagatatgtgtatgtccatgttcatgtaccaacatgtctcgagaaacatgctcgtatgtgaatgcaatcggtggctatgtatatgcacatgcacataatatatntatacaatctgtcgactatgtattcnggttattaataatgagaacatctttggcac

SEQ ID NO: 101974 - DNA, 761 bp, Triticum aestivum
  Clone ID: PAT_TA_101974
tccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaccgggctgcgaggagtccggcaaggcctaaacagctcactcaccacgggccacatataaagtgccattgcagttttgtcaactctgacattgctttgggttttccttctccatttgtctttcttacttgttcctaagaatatgtgtatgtccatgttcatgtaacaacatggctcgagaaagcgtgctcgtatgtgaatgcaatcggtggctatgtatatgcacatgcacataatatattatacaatctgtcgactatgtattcgggaattaataatgagaacatctttgcaccgc

SEQ ID NO: 101975 - DNA, 849 bp, Triticum aestivum
  unsure (1)..(849): unsure at all n locations
  Clone ID: PAT_TA_101975
gcacgagagtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgngtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggccaggcctaaacagctcactcacgacaggccatatataaagtgccattgcaagttttgcaactctgacattgctttgggtttccttctccattatctttcttattgggcccaagatatgggattgtccatgtcatgtccaacatgctcgaaaaacatgctcgatgtaatgcttcgggggcttgttatcacgaccctatttttacattttcactaaaaaaaaaaaaaaaaaaactaggggggcccggccaatcccctaagaggcgttcaatactgccggttaa

SEQ ID NO: 101976 - DNA, 807 bp, Triticum aestivum
  Clone ID: PAT_TA_101976
gcacgaggcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagatattgtgatggccatgttcatgtaccacatggctcgagaaacatgctcgtatgtgaatgctatcgggggtttgtatatcacggacgcatatattatacattggaactatatcctttaatggaccc

SEQ ID NO: 101977 - DNA, 867 bp, Triticum aestivum
  unsure (1)..(867): unsure at all n locations
  Clone ID: PAT_TA_101977
gcacgagctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttntgtcaactctgacattgctttgggttntccttctccatttatctttcttatttgttcctaaaatatgtgtatggtcatgttcatgtaccacatggctcgagaaacatgctcgtatgagatgctatcggtgctatgttatgaacgacgctaatattatcatatgtcactattacgtttaatgtaaaaaaaaaaaaaactcaggggggcccggcccatcccctaatgaaccgatcaatactggccgctttaa

SEQ ID NO: 101978 - DNA, 342 bp, Triticum aestivum
  Clone ID: PAT_TA_101978
agcctgacattttggcatgccgcagtaccgagccactggaggaacatgtgacaaccaagctctcacaattctgcaatgtgccaatcccaaatattgtgaacctccatgacgttacaaacatttggcatatccccttgttgctaagggaccagaaggcacatgaagccattctgaaagttttagatcttcagcttgttggcaaagtacatcgagaacctaagttgtctgaatggaccgaaagagccagcaagtttgacaaactgaaaactccggttaagatcgccatggttggaaaatataccggcctgtcggattcttatctatctgttttaaaggctctct

SEQ ID NO: 101979 - DNA, 227 bp, Triticum aestivum
  Clone ID: PAT_TA_101979
attggataattcatagcggagttcatctcattcaaacagtaagatagcagcagacacaggaagataaccatggccgccggacacagatccagcggccaaaagagtccacctaaaaccctcctaaaccaaccacggagatctcatcggacggacaaggggaagacacgacacgacacacgactctcttatttagatcgacgacacgggacacggggcgacgacgacag

SEQ ID NO: 101980 - DNA, 368 bp, Triticum aestivum
  Clone ID: PAT_TA_101980
cagaattcaggatttgcttcacacaaattcacattcagctaacaaatgatccctgacttactgaaactactagctagacacagtaactgaaactagggacccttgactctgaaactagcttgaaacacaaactgaaactgtaaaaatttctagcgattgatgaacatcaagtaaaagaaacccatagcaatgacacatcaatcaaatgctccagccatcatatttgcttgctgcttcaaatcgatcagctgctttagttgcgtgcccattttcttcaattcacacttcacttcagcacttcccatcatcggatcggctctttccaccaaatatgaggcgtgttccacaccaagcttccccccaaaatt

SEQ ID NO: 101981 - DNA, 246 bp, Triticum aestivum
  Clone ID: PAT_TA_101981
gagaaaatacgaggaaaaatctcacctcctcttcctccgttcccctgctcgatccgccgcgagaaattcgccaccaaatctattgatctgttggatccaatccgccgatccgtcgatcggttcgcgcgggccctccgtcccccggtgtttcgatctggtcggagtcggaggagatgaatggcgccggcgcgaagcagcagcaacagcagcagcagcagaggctccgtcagcagcagcagcaacagc

SEQ ID NO: 101982 - DNA, 140 bp, Triticum aestivum
  Clone ID: PAT_TA_101982
caatgaagggggggacggtgcctacatggctagagctactgctcgcaacacagttctgcgcaataggcaccaaccatctcttctcgaatcgcaatgagtgtaaccggtgtggcatagattgcgaggaatcaaagggcgcc

SEQ ID NO: 101983 - DNA, 333 bp, Triticum aestivum
  Clone ID: PAT_TA_101983
gttagcacaaatgagcatcagcatgatgacaatcccatggatgccactagcccactactactgatccactacaccagtagcagtacaatttataattcagaagaactgaagaagtacctcaagaagttcagtctgcctgccccctgcgtctccgaccccactcacctaccaccaaccaccccatcgcctccttcccttccaccaccgtataaagtcgctgaggccaccagcaccaccagctccaccaccgtctccaccaaccccagagcagagagagcagaagcagagtcgcggcagcacaatggacgtggcgtcgctgctcccgttcgccat

SEQ ID NO: 101984 - DNA, 281 bp, Triticum aestivum
  Clone ID: PAT_TA_101984
tggtgcaatatggagggatgtagacattgcacattgcaggtagcgtctgtagcctaggttccttatttcctcgaactggggcagttgttgaggctggacagagccctgggctgctgggttttgctgagattgccggaagagccctggcctaacggatattgttgcagaggctgttgtaatgagaactggctcgatggttgttgttgttgtttttgttgttgatgcagaataatagcatgaacaacattgtggatggcctggcactgcgactgctcagggat

SEQ ID NO: 101985 - DNA, 388 bp, Triticum aestivum
  Clone ID: PAT_TA_101985
taccaagtacttccatccaactatgacatactgcaatatttgttttacctgtgtgattactactccggctgtcatttcatctacctctgacatcctcagcaaaacattactcgctttacaagtaataattccccaatatcaaactcgcacagctaaaaagccactggtaaaattttgaggcatacctcatagttcaggggtgctaggcaataaatggaccgcagaattgcctagaggggagggaggcaactcttcaaagtatccgtcgagtaggaaaaatgtcgatcctcttccgggcatgagacaaaggtcaaatcttcaggcaacgtttgaactgaaattccatcctgcttcctagcttgttgccattctctaatgagctacttct

SEQ ID NO: 101986 - DNA, 208 bp, Triticum aestivum
  Clone ID: PAT_TA_101986
cttactggggtccgccgatccgcgtccgcgtgggggtttggtttggtttgggctggctgggttggtcctccccgagtatccatttttagttggattcccgggtccctcctcgggctactagattcccggttgtaggggatggatttggcgtcggtcaactaggagctcgccgagatcgacggtcagatctccgacatcttccgcgcat

SEQ ID NO: 101987 - DNA, 254 bp, Triticum aestivum
  Clone ID: PAT_TA_101987
gtcgatcacacacgctctcctcgccgccaagatgttcgggttcgggcacaccacaaggaccaggcgccggtcggggcccaaccagatcttcaagatctactgccgggcctcggaggactactgcctcgccgtccgacgagtgctcgcccccgtcaaccccaaggacgagacccagcactggctcaaggacatgcgcttcagaccaccgtcaagacgaggagggcatgcggccttcgcgctcgtcaacaaggcca

SEQ ID NO: 101988 - DNA, 327 bp, Triticum aestivum
  unsure (1)..(327): unsure at all n locations
  Clone ID: PAT_TA_101988
agcaccgcccgcagcaaccaaagccaagtttcgaagccgccgccgccgaggagcaggagaaggcgagaacatnggcccgtacgaagcagaccgcccgcaagtccaccggtggcaaggcccccgcaaacagctcgccaccaagggccgaggaagtcagcgcngacacgggcagttgaagaagccccaccgctacaggcccggtaccgtggcgctccgggagatccgcaagtaccagaagagcacggnagctgctgatccgcaagctgccgttccagcgcctggtgagggagatcgcgcaggacttcaagacggacctccgcttccagt

SEQ ID NO: 101989 - DNA, 188 bp, Triticum aestivum
  Clone ID: PAT_TA_101989
ccgtgggggaccaactcgccgagatgctcgccgcggggccgaggaccccgacgccgtcgccgagctcccgcccctgcaacgggcgcgcgctatcctcgccgtagcccacgccgcgaactccctcttctcagtgcggctgaggtgttcggggattaatccggatgagcaccctataaagaaggagttcg

SEQ ID NO: 101990 - DNA, 173 bp, Triticum aestivum
  Clone ID: PAT_TA_101990
ccgcaacctcccacaaatctccgccggccctccccttccgacccgcacaggccgcagcagagcgccatgtcgtcctcccctacccccgcgccagacgccggcgccgccgcgatggccgtcgacgactcgtcggagaccgaccagctcgactccatgtccacggaggacatcgt

SEQ ID NO: 101991 - DNA, 249 bp, Triticum aestivum
  Clone ID: PAT_TA_101991
gcggcctcgatcgtggggtacctccacagcggcctcgagcgtcgcagtgttccgacgaagcagctctgactgggtggatttggaactgcagtccacatcgcacagaggagtgccccacttcctcctctccatgcagtccactgtcaaagccaagggacttgccgtcccgggggcatcagaggcagctggcttcaaaggttggagggggttcggttatctcggcggtcagcgacgagggatccgaggcag

SEQ ID NO: 101992 - DNA, 428 bp, Triticum aestivum
  Clone ID: PAT_TA_101992
ccgccgccgcctcccctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactg

SEQ ID NO: 101993 - DNA, 257 bp, Triticum aestivum
  Clone ID: PAT_TA_101993
gaattctgaaacttctcaactcaagagaccatagacatcttacaggttattgctccactgctactgctgattacaacgaatcgaaagcgaaaaggtaatgcatgctggcgaaggaaaagtaaaaatggagtatgcatggtggcctaagggaaaaactaaatctaatgtatgcatggtgtcctgccctgcctgcctgactagttcgggtgccctgtggtggaggggctggagccgggctgctgctggaatccggcggg

SEQ ID NO: 101994 - DNA, 135 bp, Triticum aestivum
  Clone ID: PAT_TA_101994
gagagctcgagagagtgcgaccgggatggcgatgagatgcgcgctgacctcgctccccgcgcgcctccggtccccggcggtggtagccagcgggacgcggcgccttctgagtgacgggaaggggcgcgtgctcag

SEQ ID NO: 101995 - DNA, 150 bp, Triticum aestivum
  Clone ID: PAT_TA_101995
cttggacgccctacgattgatgtcgtcgtcaactgctcgggtgtgttcagacatctttccatcaaccagatgaatctgctggaccgggcagtaaagatggttgctgagctacatgagccaattgagatgaactatgtgcgctagcatgcc

SEQ ID NO: 101996 - DNA, 294 bp, Triticum aestivum
  Clone ID: PAT_TA_101996
gcgccttcccccctctctcgcgcgcgcccctccccacggactccggcaaccggcggccaccccgcccacccgatccaccagatcccttctctccccctcggccgatccacgcgggcggcgaccctccgtagccatggccaacacgctgcggctgtacctcacctgcatccgcaacactctggacgcggccatgtgcctgcataatttcccttgccaagacgtcgagaggcacaacaagccggacgtggagctcaagactagccctgaacttctgctgaatccggtgcttatatg

SEQ ID NO: 101997 - DNA, 450 bp, Triticum aestivum
  Clone ID: PAT_TA_101997
tacccccgggctgcaggtacggcacgagaagcaacactagttaacactaatccaccatgaagaccttcctcgtctttgccctcctcaccgttgcggcgacaagtgcaattgcgcagatggagactagatgcatccctggtttggagagaccatggcagcagcaaccattaccttcacaacagacatttccacaacaaccactattttcacaacaacaacaacaacacactatttcctcaacaaccatcattttcgcagcaacaaccaccattttggcagcaacaaccaccatttttttttgcaacaaccaatgctaccacagcaaccaccattttcgcagcaacaacaactagtcctaccgcaacaaccaccattttcacagcaacaacaaccagttttacctccacaacaatcaccttttccacaacaacaacaacaacaccaacagct

SEQ ID NO: 101998 - DNA, 294 bp, Triticum aestivum
  unsure (1)..(294): unsure at all n locations
  Clone ID: PAT_TA_101998
cccccgggctgcaggatcggcacgagccccctcttgccccgtggttcccaaccgccgtccgccgccgcagaggggagaggcggccgccgcccaccgccgcagcaccgccggccccgtcgcccccgccggtcgggtttgatcccatggcgtccaagaggatcctcaaggagctcaaggacctgcagaaggaccctcccacctcatgcagcgcaggtcctgtangtgaggacatgttccactggcaggccactatcatgggaccctcggacagcccgttcaccggtggcctatttt

SEQ ID NO: 101999 - DNA, 238 bp, Triticum aestivum
  Clone ID: PAT_TA_101999
aaacacaaagcacaacccaaacatctagacacactactataacacactactatcttcttcttcccacaaagggcacacagacagacagacagacagacagacgactctcttcttcctgtttttgacaacacaaacaactacaaacagcacggagtttcttcccccctactacatctacaacagacagaccgacagacacatgcatgcgctgggggttggttcaggctctcgcatagcc

SEQ ID NO: 102000 - DNA, 277 bp, Triticum aestivum
  Clone ID: PAT_TA_102000
cccgggctgcaggaatcgcacgaggatcgatctaattccaattttcttccaaatatacttacataaacaagcacccacactttgatcttcacgtaatttacatacatatctatgcagtgtacgtatatataacatctacctatgtcgtcgatgcttacgctcatcacccgtgacttacatgcgctaaatattctatcctcctcactcctgtaatcctgtacacagtgcacagctccaggccaagctccaagatgagtccaaagcgtaggccgtcgag

SEQ ID NO: 102001 - DNA, 404 bp, Triticum aestivum
  Clone ID: PAT_TA_102001
agctgactttattcgtccacattttgcagcttgcaaacagcggatctactcaaagtacaaaacccaaaacccatcaacatagtaccaagtcacagttacagcagtaaataacaggagcactagctaccacaacctccctttcttttccctaaatgaaaactatgcagatcctaagtaatcaggagaccaaggaagctgattgccatagccaccgaggtactactagaggatctatctagttttcgttaggtgggcatgcagtgaacactttcctcacatcagtaacgcgagctaggagaacatcgaccttaataacttggcacggtagagctagctagaaagggtaacccatggcggggacgccgagcaagccgctgccgccggctgcgtggccatggtggtcg

SEQ ID NO: 102002 - DNA, 262 bp, Triticum aestivum
  Clone ID: PAT_TA_102002
cgagctggtagtatgacggagtacattattggactgtagtttggcactggcggacgcacacgtgcgcccgccatgagcgagctgagcggtggactggtggtgggcgctacgcagctgggcccgaccgccgtcgcgcgtcacgcggcgggcgcgggcgcgggcgcctcctcgtcgtgctgctgctgctggggcggcttgagtgggccgcatcgtcgacggggtcggcggcggagcggcggcagagcgggcaggaggcgtggcc

SEQ ID NO: 102003 - DNA, 389 bp, Triticum aestivum
  Clone ID: PAT_TA_102003
tcgcacgaggcaaaactagttagcaccaatccatcatgaagaccttcctcgtctttgcccttctagccgttgtggcgacatctgccattgcacagatggagactagctgcatccctggtttggagagaccatggcagcaacaaccattacaactaaaagagacatttccacaacaaccaccatcttcacaacaacaacaaccatttcctcaacaaccaccatttttgcagcaacaaccttcattttcgcagcaaccactattttcacagaaacatttaccagttctaccacaacaaccagcattttcgcagcaacaacaaacagttctaccacaacaaccagcattttcgcagcaacaacaccaacagcttctgcaacaacaaatccct

SEQ ID NO: 102004 - DNA, 222 bp, Triticum aestivum
  Clone ID: PAT_TA_102004
cagccggcccggaaatacacgttactatgatagccaagtccacacacctcacgcctataaataaaccaaaacattcctcctacaacccgatatactgacgagactacatcaaaactgctccttggcacgtcaaacatctcaagggcggccctcctgccctcgcctgggcaggctacagatctgcaaagaagtccggcgcgaacccgtccagcctcttgccct

SEQ ID NO: 102005 - DNA, 245 bp, Triticum aestivum
  Clone ID: PAT_TA_102005
tggtaggtggtccttttggtacaaaaaaatccacctgtaaatgccgcggacatcgctggtggagcgttgtgccaggtgcccaggaccacaccagctcccatattgaacacgacttgaaggcatccttttacatccagaccaggctaaattacacaactcactaacatacaagtcactggcacgaatctggtgatagcgtgcagagacggacacggcagcgtcatgtgcaatctaccaatcccccg

SEQ ID NO: 102006 - DNA, 442 bp, Triticum aestivum
  Clone ID: PAT_TA_102006
gagcaagatcccttactcttcagctggcttatttatacggcgggccacctcctctgcttcctccacaagtgcagccgcagccacactagctacgtactttgcctgactcctccagtttcatgtgtgtgccagcttcttggtgcttgcatagtgatcgatggacgacgcaaacaagcctcagcggccgcagcaggaggaggagcagaagcccatgagcgaggacaagacgacgatgatgaaggtcttgtcggaggacggcggtggcgaggccgaaccgtcgtgggagtccggggacggcgacgccgccgaccacaaccaccttttatggaaggccatgccgtacgtcataggtgattgtcactacatcccagctatctgttttccctgcatgcacatgtcacatcttcttttcgatctcccgctgaattcattgctgctccta

SEQ ID NO: 102007 - DNA, 427 bp, Triticum aestivum
  Clone ID: PAT_TA_102007
tttttttttttttttacatccaggtctcaacaagaatatttatctacacacaattcacactgaaattgctatttctcattcaaaacctaatcttacaaattacacccgctaagtttgtctcatattccgttacaaaatgaacatgattcgagcatcagttcatgcttatgaaaaaaaatacaatgaagcaattccaaaaacatgctattaatcatcaggaggaatggcatactattacttgcatggtcacacctgtttgcacagactaaagaaattacgaaacacacgatttggaaaattcatcaaaacagtcagaccaaagaataattttacacagagagacaactcaccttcctcaatctcgggaagtagatgttcagctttgaactttccagagcatccttctccagcttccgcttctccttct

SEQ ID NO: 102008 - DNA, 287 bp, Triticum aestivum
  Clone ID: PAT_TA_102008
tattttcaaggggatccatatctatcatgcagctgttgaattcacatcaaatggctcagacagaatcgattggaacctaaaaaacgttctcagtcgcatgcatgttactactactccattggttgtaccttattctgttcatgcaagtctgctctcgattaactaacaacctccctcaagagtcaatcaagacagatagtggtcggtagaagtagagacgctcacaccagtcgcgccagcagtatgtgctccgttggtcatgactcggcgggttggtttcgaagcaa

SEQ ID NO: 102009 - DNA, 107 bp, Triticum aestivum
  Clone ID: PAT_TA_102009
aacttcttaggatagacaacattctagccagcatagttgcacatacattgccaggaagacgacagagctagtacttgggtccataactccatttcactaagcaacct

SEQ ID NO: 102010 - DNA, 171 bp, Triticum aestivum
  Clone ID: PAT_TA_102010
agcaaagataacgcaacacaagtacttctggaatagctcaagatcagttataatttcgcatacagatatatccatcttttggtgtcatgatcatctatctttgagaatctgagagaaagttatccctccagcttgtttattgttgcttcttttggtgctgagaacctaagt

SEQ ID NO: 102011 - DNA, 400 bp, Triticum aestivum
  unsure (1)..(400): unsure at all n locations
  Clone ID: PAT_TA_102011
ccaagccgccgcacgcgcccccaccctgaaccccagccggcgaacgagcgaagcagcagcgacggcagccatggcggcgacgaagatccggtggggcgagctcgacgaggacgacgacggcggcgacctcgacttcctgctcccgccgccggtcgtcgtcgggcccgacgccaacggcctcaagaagacgatccactaccgctttgacgacgacggcaacaaggtcaaggtcaccaccaccacccgcgtcgtcaagctcgcccgcacgcgcctctccaaggcggccgtcgagcgccgctcctgtgccaagtncggcgacgccgccaccggcgacgacgcctccacgcgcctcaccgtcgtctccaccgaggagatcttcctcgagcgcccacgcgcccca

SEQ ID NO: 102012 - DNA, 196 bp, Triticum aestivum
  Clone ID: PAT_TA_102012
ccgggcgccggacaggaagcgggagcggcgctgtcgtcggggtcggtagccacgccgccgtacaccggcggggacctgtcgcggtccggcgagctgggccggatgttcgacgtcgcctcctcgtcgtggcagtcgcaggcgccgtccccggcctcctcctcgcgccgcagctccgggcacctgccgctgccgcccc

SEQ ID NO: 102013 - DNA, 244 bp, Triticum aestivum
  unsure (1)..(244): unsure at all n locations
  Clone ID: PAT_TA_102013
caacccccgagccggaagcagagccgcgatggccggcaccgtgcccaagctcgccgctccgaggccggcggccgcggggccgcncccctcgcagcccctccgcgccgccgcgcccgcctncgccctttccgcccgacgcttccgcgtttccctcgccggccgcgccaggagccccgtcattgcgatggcttccgccaaggaagggaacggtgcggtgacgatgaggaccacgctccatgacctc

SEQ ID NO: 102014 - DNA, 344 bp, Triticum aestivum
  Clone ID: PAT_TA_102014
aatggccccgaagcgaggcggcaaggcgccggtgccggcgaagaagaaggcggcggacaaggtggtgaacccgctgttcgagaagaggccgaagcagttcggcatcggcggggcgctgccgcccatttaaggacctccaccggttcgtcaagtggcccaaggtcgtgcggatccagcgccagcgccgcatcctcaagcagcgcctcaaggttcccccggcgctccaccagttcacccgcaccctcgactttttcctcgccaccaacctgtttaagatgcttctcaagtaccgccccgaggacaaggtggctaagaaggagaggcttctgaagagggcccaggct

SEQ ID NO: 102015 - DNA, 457 bp, Triticum aestivum
  unsure (1)..(457): unsure at all n locations
  Clone ID: PAT_TA_102015
cctgatcccgtcgagaaaaaagaatcttccgcgcgcaggcgatcaatccccgtcaagatgcagatctttngtgaagaccctcaccggcaagaccatcacacttgaggtagagtcctctgacacgatcgacaatgtcaaggcgaagatccaggataaggagggtatcccgccggaccagcagcgtctcatcttcgctggcaagcagcttgaagatgaccgcaccctagctgattataacatccagaaggagtcgaccctccacctggtgctccgcctccgtggtggcatgcagatcttcgtcaagaccctttttggcaagaccatcaccctggaggtggaatcttcggacaccattgacaacgtgaaggcgaagatccaagacaaagagggcatccccccggaccagcagcgcctgatctttgctggcaagcagctcgaggatggtcacactcttgcg

SEQ ID NO: 102016 - DNA, 438 bp, Triticum aestivum
  Clone ID: PAT_TA_102016
gagttttcaacttatcagtctctcacaatattcgacaaaggtttcggcaccaacttaactttttatggttaattccagatggaacactccgcctggtaagaagtactcacactctgctttcatcagttctgcaacaagcttgcgactgaatggggtcgacattctagaggactgctgcagacatctaggcacctacctacacactgcactagcctatgcatgagccgctcgactcgactcaggcacgagtacaacgcaaatctattattactggcaactgacatgtaccctacctgcgccgcttctcacggctcgctccttgcgcggccatcgaaaggggacgggcccgcattctgcacatgggctgtcatggcaattcccttcatcttgaggtctcccggaaatggcagtgcttccggacgcagctgcgactgctgc

SEQ ID NO: 102017 - DNA, 323 bp, Triticum aestivum
  Clone ID: PAT_TA_102017
gcaggaattcggcacgagccgccgcttccagctcgcgctccctcgcccagccgccgcgccgcctcctcgtcggagttcttcccacccctttcgccaacatgggtaagacacgtggtatgggagctgggcgcaagctcaagacccaccgcaggaaccagaggtgggctgacaaggcatacaagaagagccacttgggtaacgagtggaagaaacccttcgccgggtcatctcatgccaagggcattgttttggagaagattggtattgaggccaagcagcctaactctgccatccgtaagtgtgctcgtgtgcagcttgtgaag

SEQ ID NO: 102018 - DNA, 270 bp, Triticum aestivum
  Clone ID: PAT_TA_102018
gaacatgcccacatatgatacaacactaactacaaccttcagcagtacaagactggaggttaacatagacggcaaatatttcctcagattataaactatatgaatgagcaggctagtacacatgaatcagcaagattgtatgttcatatcttcaggatttttaaatgtcaatctgtccatttcttcaggtacttgcttcttcaactcagctgactaaaagctcaagtgttcttaggaatcctcgtggttcctcttgattatgcatcttca

SEQ ID NO: 102019 - DNA, 410 bp, Triticum aestivum
  Clone ID: PAT_TA_102019
gaatcggcacgagggcacggctccgccgccgccgcccccacgcgcgaccgccggccgatcttcttccccgaccccgaccctttgcaattctgtctccttcccctctccatctgcccaaatcttctcctgcgccaccctgagccttctcgatctccaacctcctgcaatcttcaagcccgccggcacccaatccgcctacaatcttcaagcccgccagcaccaaaagcaaccagcggtcgatttgagtgacccccgctaggaatccatgggatttgaggtggatttcctaggagagcgagtaggaagggtgatggtggggttcatggggaagatgaagaagcagaaggtgatccacggcccgcacgcgacgccgagccaccacgggcctcctcccctgccgctcgccgcca

SEQ ID NO: 102020 - DNA, 137 bp, Triticum aestivum
  Clone ID: PAT_TA_102020
ccagccgcgtccaccgcgtttgatctgattctgcagccgcatctacccctcccacctcccctagaaacaagtagactagtcatccaccactgtaccacaacccattcagtgccggccttgtccacggcgccggatct

SEQ ID NO: 102021 - DNA, 323 bp, Triticum aestivum
  Clone ID: PAT_TA_102021
gagtccacttttgtttcgtgggtggcatcgatcgagagaaagagagacgccatgagctacccgccgccgggcaccgcgtaccctccgccgggccagcagcagccgtacccgccgccgggcaacggttacggctaccctcctccgggccaggagcagcagcagcaggcctaccctccgccggcgtacggcgcgccgccgcctgtcgccgccgactactaccagcccaaggacggcggcgcgtacccgcagcagcagcagcaggcgtacggcgcgccgccgcccgtcgccgccaactactacccgccgccgcagcagcagcaggc

SEQ ID NO: 102022 - DNA, 136 bp, Triticum aestivum
  Clone ID: PAT_TA_102022
gagggtagttaaaggataagtccagatcacctaataaacagcagccgatttgttgggctctaattaatatttggcaactggtgtaataaaaaactagtgaaaattgccaaatgttgacaactactctatgagcttt

SEQ ID NO: 102023 - DNA, 238 bp, Triticum aestivum
  Clone ID: PAT_TA_102023
cttgttccttgtgcgaagcctcaattcctgacaaaacttcaaatggatttagcagtggagcatttgctgagtaggtaatggagttggctggagcattgatgcaaacctgaacgtacgggacattggcctctatccttctgtgcaggcaagtctgaactgatacaaacttctttttgcctagctactaattttttttatatagccagctatattttttaacacacacattgaaccgttt

SEQ ID NO: 102024 - DNA, 194 bp, Triticum aestivum
  Clone ID: PAT_TA_102024
aaaagttttttcccacattctagtaagaatgttttgttgagctgccaagtttgaagttcatatgttgttctatatgggagaaacaaaagagacaaatgtactcgcacgaatcgcgatgcaaaaatgagtggctagataagggggtgtaggaacgcctatgctttctcaaatgttaaccctgagtatccgcctcc

SEQ ID NO: 102025 - DNA, 387 bp, Triticum aestivum
  Clone ID: PAT_TA_102025
ggcacgagcctcaacatccaccatttttgcagcaacaaccttcatttcgcagcaaccactattttcacagaaacaacaaccagttctaccacaacaaccagcattttcgcagcaacaacaaacagttctaccacaacaaccagcattttcgcagcaacaacaccaacagcttctgcaacaacaaatccctattgttcatccatccattttgcagcagctaaacccgtgcaaggtattcctccagcagcagtgtagccctgtggcaatgccacaacatcttgctaggtcgcagatgtggcagcagagcagttgcaatgtgatgcagcaacaatgttgccaacaattgccacgaatccccgaacaatcccgctatgaggcaatccgtgc

SEQ ID NO: 102026 - DNA, 220 bp, Triticum aestivum
  Clone ID: PAT_TA_102026
tggacatacggcaacaaatataaattttattcatgcgtattggttgatccgcagagacgaagggtttagttggacgtccccgttgacctgaccttgggctgggtactgatgaacgagccaccagcactgctccatctctccgtggccgaggtaagccggcggcgggacggcctgagaccatccatgatcggggtggaagccaagcccattcggcatcccc

SEQ ID NO: 102027 - DNA, 426 bp, Triticum aestivum
  Clone ID: PAT_TA_102027
ttcgatttgcggtgtacaatcgctcactatgggacacccaactacgcgggcgattcccacgcctcttccttctcctgaccccgcgccagcgcctccttgacgtgacgcttcagcgacaccaccacgccccgcttcaccgcagcggcgtacacggccatggcgtcaggccaccttccctgccggctgagctctccgagcagcgcgtcgaacgcgttccggccgggcacgaagtccttggtgatcaccgcggccagcacccggagagcgtcgtgcgtcctgctccggtcgcacagcgcgcgcaccacgtccgtgtacgcgcgcttccgcagcgcgtaccccttgcgcaccatgtcgtccagtattggccacgggccgcgtccacctcgccgccgcgcgccagtgcctgcgccatcggcagtacgtgta

SEQ ID NO: 102028 - DNA, 394 bp, Triticum aestivum
  Clone ID: PAT_TA_102028
aaaaaaactccctccctccggaaaccgcgagcgccagcgggatccaccgcaaccgaacggacggacggacggacggcgcggagggatcgaccggtcggcgcacacatgggcatgcccggcgacgactcgcgctgccggaagcacccgccagcgccctgcggcggcgtgtgcccgcactgcctctgcgaccgcctcctccgcctctgccccgactgcgcgcggacgcgcccctgcccctgcgcctccccctcctccccctcatcctcggcgtcctccgcctccgttggccgggtctgcagcctcatcgagcgggagcgccggatcgggcgctcgcggtccgtggccggcggcgtcggtgccgacgagcggcgccggtccagggtctggggctggg

SEQ ID NO: 102029 - DNA, 255 bp, Triticum aestivum
  Clone ID: PAT_TA_102029
agtacagaggaaactcgactgaagacaacacgaagactgaagaagccacaaggctacagaagaagcagtaggcagaaccacgaggaatggcaggtggagacagcggcggggatcggtgactcgacggggccctggggcgatgctctagtctagacgcggccctcccagaggcacggctggtcgtcggagcagagcgcgtgcggcggcggggcgaggcccagcgcggcggcgcgctgccagcgctgggcgcgggtg

SEQ ID NO: 102030 - DNA, 302 bp, Triticum aestivum
  Clone ID: PAT_TA_102030
ggcacgagatcttgtgtccatcccatcccctcctcttcccgaccctgccatcttgtttccttcccttctcacgcaggttagcatggaggaaccctagccagcagcacctcctcacctctgatgatgcctctgctgcaccaagatagggtattgctaaagagatgcagggtgcttcaaatatgaagatatacaatctgttagtattgtgggccggggtatctgatcttttacttttagcctggtgggtaactgatgtaaaaaaatgcctctgagcgccagtgttggagtggacaggagccgcg

SEQ ID NO: 102031 - DNA, 393 bp, Triticum aestivum
  Clone ID: PAT_TA_102031
atgatgttcacattcagaaatggtagtgacgacataaattgacaaaatataaagacaacggttcatcataaatggctgccacatagagacagtcaactagggaaagggtctattacaaaacagactcaggatgtaatttttttgcatctaagattgaacataagcatatgctagctgaaggtgacaatatagtgcttcccaatcttccataatcttattccccttgtccctatataaatggtttggatccctcagaaaaattcccacacattggcatgccatcggaactccaaatgtccatgttgccaacgacttcccgaggcacatcaaaattcagaaggctatcaatcgactcgaccacgccatcatccataagaagcctcacccaaggca

SEQ ID NO: 102032 - DNA, 262 bp, Triticum aestivum
  Clone ID: PAT_TA_102032
accatgccattatccaagcatttaaccaactggatgtaacggactgcataacaacggtactcgggacagacggcagtcatgcaccgaaaaccatcaccaacatcaacatgtactactagcaagcataagcatatgaagggaataatagcaactagccgggcatgaaaaccaggggcataacaacatatcaagcaaataagtattaacccagaagcattaccgaaacaacgataaccatattttaaacaagcaatcatttaat

SEQ ID NO: 102033 - DNA, 280 bp, Triticum aestivum
  Clone ID: PAT_TA_102033
tcggcacgaggttcatgtgtcacatggcatcctcagtcaccggccacgtggcgcatcaccaacaacaacaacttccggctacccatctgtatacacgcacgggcggtttaaacatggtggacatgtgccaaatatatgtggcacatcactagcagctagtataatagaataagctaatggccgcccgactatgctgcggcgacggcgtccccggcaccgcccgagccgccgccgctgccggactggtccgacggggcctctcggatggatgtgatggtgc

SEQ ID NO: 102034 - DNA, 221 bp, Triticum aestivum
  Clone ID: PAT_TA_102034
tacagttcacggtatataccaaacctaaacatcaccatcattctttttctccgaagaaacctgtttctatctttgtctgtcctataaaccgacacctgaactcaagaaaatgacctgatatgatcttataacttactctgtgcggcgaccgatggcgtacgcctcccgggcgacctccgcctcccgtttcacattttcagccaggatggccatggcacctg

SEQ ID NO: 102035 - DNA, 293 bp, Triticum aestivum
  Clone ID: PAT_TA_102035
ctgcaggaatcggcacgagtttttgtatacagactgtgtttgtcttttattcccaattgaactagtatagttcgggttcttacatgatagtgcattgtcacattattttttcaccgctacaacgaccaaaccatggactgagaaaacggtgtttcatatatctagtactagagttattttcttctcagttagtatcgaagatgccaaatggcgtgatggtgcaatatggagggatgtagacattgcacattgcaggtagcgtctgtagcgctaggttccttatttcctcgtgc

SEQ ID NO: 102036 - DNA, 344 bp, Triticum aestivum
  Clone ID: PAT_TA_102036
gattatgcaaatataatttccgttggcacacaccataatgcgtatggcgaatgaatataggcaagacaggcaatcataagcatagttaaaaccagaacgaaaagagttggatctggaagagagaaggatgcttcagggagcagggcaacacatgtaggagatcatggtcagcttcgttgaagaagaaagcggatcgaagacctttgtatttctccagtaatgccacaacaaagagcaattgttgttcttggactgagctgacaaggagaagcacacgagcaaggcaggcaagatcgagaaggagaccaaggtggatgttagaaaaaacaggcttaccatggcca

SEQ ID NO: 102037 - DNA, 201 bp, Triticum aestivum
  Clone ID: PAT_TA_102037
ctcctcctctggccgccgtcctgctctccgtcgtcgccgctgcttccgcctccggcagctgcgtcccaggggtggcttttcggaccgatctgctgccacactgccgcgactatgtgtgacaacaaacttgtggcaccttcacccccgggtcgaagtgacccgaatggatgacatccgcgtcaatatgctcccccatgaagc

SEQ ID NO: 102038 - DNA, 243 bp, Triticum aestivum
  Clone ID: PAT_TA_102038
gagcctgattgcatccaaaccaaattcaggcagatagcaaagtctgcaaatatcaagcgatccgaggtttaaagtaaggaaatcattgtcctctatggcttcttcaagcagtggtcatgagaaccatgaacacggcaatggatcttcaggaccaaaagtaagaaatctgactcgtattcttctttatctcctcttttcattattcttgtccttcttgttgaactagttgcaccatttcctctg

SEQ ID NO: 102039 - DNA, 345 bp, Triticum aestivum
  Clone ID: PAT_TA_102039
cggcggcggcgcctggcgtgaactcgccgttcgtgctcgcggcggcgcggacgcagcggaaggaccctctcgacgggctgaggtactacaccggcggatggaacatcagcagcgagcactactgggcctcggtgggcttcagcgcggcgccggtcttcgcggcggccggagtctggttcgccgtgttcggcgccgccctgttcctcgccgggtgctgctactgctgctgctccagccgcagcacctcctactcccgcgctgccctggtcgtctcgctcctgctcctcctcgccttcacggccgccgccgccatcgggtgcgctgtcctgtacgacgggcagggcc

SEQ ID NO: 102040 - DNA, 232 bp, Triticum aestivum
  Clone ID: PAT_TA_102040
acgagcatttttcataacataaatcgcctctgtcattttttgtatccctgatagtctcattctctcaaatctatcagtcatgtcttcttcaagaattaatttacaaagtgttaattcctgatgtagggtatacactagtgtttgtaacttctctaaactttcacactcaataggagaggattttgctcttcgctggatgctgcttgcgcactggtccaccaattttgtagtc

SEQ ID NO: 102041 - DNA, 329 bp, Triticum aestivum
  Clone ID: PAT_TA_102041
tgcaggaattgcggcacgaagggaaaaatctagcacaagggaactccaaaaaagtgtctgacgactttgcgcgagagcgttgggagtttttttgaacgccattttgggagagaggttgtcgactatcttattgatccatttgtagctggaacaagtgcaggagatcctgagtcattatctattcgtcatgcatttccagggttatggaatttagaaaagaagtatggttctctcatcgttggtgccatcttgtcaaaactaacagctaaaggtgattcatcaaagaaaggaggcgcttcgtcaggaaaaggaaggagcaagcgggcctc

SEQ ID NO: 102042 - DNA, 310 bp, Triticum aestivum
  Clone ID: PAT_TA_102042
gagtggagctctatacatgcataaacaaggccagcaatctgtgattcattcatcagggtacactaccaaaaccccagcgattccattgcacaatctaaaggagacacgagactactagtaattcctaccacgccttcttccatttttctcccgtcgccttccttgagagcccagcccttgatgtacaggggatataagaaggagcggtaaatctactgaagaagcaaaagagcaagagaaacgaaaaaggatgatgccatggaaggatcgatcgtcagtcagtcagtagttgttgctgttgtagccgatg

SEQ ID NO: 102043 - DNA, 214 bp, Triticum aestivum
  Clone ID: PAT_TA_102043
ttttatataataaaacgacaattcttggtaatttcaaaacatagtaacgatcggagtgaatggaccgtcgcgaactcagatcctattataagaagataaggtcaagttttaacataaagaatacttacaaggtgattctgctgaaaaagggggtgaatttgccatccatgtttaaaatcctgttgtcttcaccgtgcttgagccatccatttaa

SEQ ID NO: 102044 - DNA, 299 bp, Triticum aestivum
  unsure (1)..(299): unsure at all n locations
  Clone ID: PAT_TA_102044
gcacgagagcatagcgccctgctgctgtaattacatgtatttaaattctatggtaactttaggttcttcccttatggcctttcctctaatcataagaggtacaaaggagatgcattntttatgaaactgggaatattttagttctcctgctggtgtccgtgctttttttaatctcacatggcttacttgnctatctaagtgttctcattaaactttctctatagaaagcttgctaaagttgtaaccgaacaaaagcaaggctctcttgacacactatctttacacacagagagaagcta

SEQ ID NO: 102045 - DNA, 413 bp, Triticum aestivum
  Clone ID: PAT_TA_102045
gagtttttttttttgtagacaagaccagtgtttgtctttatcccaagtttgaactagtatagttcgggttcttacatgatagtgcatgtcacattattttttcaccgctacaacgaccaaaccatggactgagaaaacggtgtttcatatatctagtactagagttattttcttctcagttagtaccgaagatgccaaatggcgcgatggtgcaatatggagggatgtagacattgcacattgcaggtagcgtctgtagcgctaggttccttatttcctcgaactggggcagttgttgaggctggacagagccctgggcctgtgggttttgctgagatggccggaaggagccctggcctaacggatattgttgcagaggctgttggaaggagaactggctcgatggttgttgt

SEQ ID NO: 102046 - DNA, 195 bp, Triticum aestivum
  Clone ID: PAT_TA_102046
gtcatcatcagggggcaacgccaagacgccgggacgagctcatcgaggcggaggtcgccgacctcctccgctccgccatccccctcagcggcaacgccggcgtgtactccaagcccgaggcaaaagcatggtcagtggaaggggctgttaagtggaagaacttggctggctatgcagacatctgggatgcttcag

SEQ ID NO: 102047 - DNA, 401 bp, Triticum aestivum
  Clone ID: PAT_TA_102047
ctgaacagatgaaaatactgcggtagaacaacacataatagaatctggatagctttagatcacaaccaaaacaggaaaaacattctcagttcaacctaggactcgaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccgctgaactgctcctcaatgtgagagtccagtgtacgtccctgctggcgcttctcaagcttc

SEQ ID NO: 102048 - DNA, 152 bp, Triticum aestivum
  Clone ID: PAT_TA_102048
taggctccattgaatccatgtcctccacaagagcctctggcctccaaagagtacaaaacaagtgtgcgaattttaggttgcctccatctgcagttcgactaggctcccctattacaggttttagggcccctttctcctttgggcatagcaaa

SEQ ID NO: 102049 - DNA, 115 bp, Triticum aestivum
  Clone ID: PAT_TA_102049
tatatatgtgttacaggtacaaaacaagcccatgatcggatgggtaaccacattactctaccaccgaatactcgacatcaggggagggaggggtactaaaatcaactgtggtggg

SEQ ID NO: 102050 - DNA, 216 bp, Triticum aestivum
  Clone ID: PAT_TA_102050
cggcacgagcaaacttctagaatttatttaattgtagctttggcgataaaataaaacatccaactagtcatgactagtaaacaactctcaagtagcaccacggcatatcactgccgccacacatatgcggtagaaaccccctgactacgaacttctccaatgctggtcacttagggacaggttatctttggggggcgaatgaggaggcgggtggtg

SEQ ID NO: 102051 - DNA, 384 bp, Triticum aestivum
  Clone ID: PAT_TA_102051
gaggccaaaccccgcatattttattgattgctcctttttgtgtcgtacggcctctaggtccgtcgtatacgctcatatgcctagtagtttaccatcaagtaagtgaattagcagtagtttgtatcggtcggcccagaccaagttgtacaacggtgtcgacttcacaggcggtcgcatcagccggatccagcagctctccaagctcttcaccccacgggcgaactcgtcggcgacccccgcgaagcggcaattgggcagcatctcgttggcgacgcggttgatggagcttctcaccgtggcatagtcattcaggcatccctcgtaggcgtccctcacctggccagagagcgaggtgttctggctcagctggttcctcgcggcgag

SEQ ID NO: 102052 - DNA, 375 bp, Triticum aestivum
  Clone ID: PAT_TA_102052
atcaagactgatggtagcacagtggatggatccaaaactaatgattgcaggtagattatagcttcagttcaaaatgatagacaatggatcatctattgtttcttgcccacccaacattgaaccacatagaagaccccagatggaccagatagtagatagatactattcgttgctgcctcgatatgagacccacgagcatttcaaaactcaagtttgaacgataaagtagcaggtaataataaccgatgtataacgtaagcaaacacgaaagactgcgacctctcttctggagctgtgtactcctcaggttcatctgctcactcgatgatggtaatgcagtcagcatggctgccggcaacgaggaagatgatctga

SEQ ID NO: 102053 - DNA, 135 bp, Triticum aestivum
  Clone ID: PAT_TA_102053
aagcaattcgggaaatgtaacaatccacaattagtttgcagaacaagagcagaaacaatagacctgcctaacagtcttggcgcatacattgccccagtataacagcgcgacacaccaggtgccatcttcccctcg

SEQ ID NO: 102054 - DNA, 424 bp, Triticum aestivum
  Clone ID: PAT_TA_102054
ggattcggcacgagtttttgacagaaccatttttattttatatatcctcgattcgaaagaaccttactgttttgttgttctccagagtgcccagctcatgaaacagcgaaggcaacaatgttctagcattacagttttgcttattcattctcatcaaggaccttacatctgatgaagttacatgaagaactcgcccactgtatcctcggattctaaaattactcaccggcgtttcggtcgcgtgagagagcctctctatcggcgcctgttgccggtggcgatctcccaggcccgcagcacgtggtccacaatctcctccacgccaaccccgtgtttcacctgggcgaacacgaagggccctccttcccgcatccgaagggcgtctcgctccatcacggctaggtcggctccaaccgcggaggca

SEQ ID NO: 102055 - DNA, 142 bp, Triticum aestivum
  Clone ID: PAT_TA_102055
atgtgcgataatggcatcatctgcacaaacgttaaatagccaacggcacaggtgattctcaccaattttgggtgaactactctagatccaacaccacgtgctgagggagactacacacgatgatgcaatagggcatatgcag

SEQ ID NO: 102056 - DNA, 422 bp, Triticum aestivum
  Clone ID: PAT_TA_102056
ccgtgcggccgcggcgcgctgcggctcgtgctcatcgccgtctccgcggccttcctcacctacaacgtgctcctctcctcccgttccctcctgcccctccccaccgcctccttccccgccgccaccaccgcatcctcctcctcctcctcccgccgcctcgcctccggtcgcgccggcggcaccggcgggcggaggctgttccacaccgcggtgaccgcgtcggggtccgtgtacaacacgtggcagtgccgcgtcatgtaccactggttcaagcaggcgcggcggcgggcgggcggcgccgacatgggcggcttcaccaggatcctgcactccgggaggcccgacgagttcgtccacgagatccccaccttcgtcgccgacccgctccccgacggggcggatcaggaatctctttctaggat

SEQ ID NO: 102057 - DNA, 101 bp, Triticum aestivum
  Clone ID: PAT_TA_102057
cacacaacccatgataatacataaggggaaatagatactagtggatcacaatcgtcacttcacacaaatacatgaataaagcattacaacatccaaataca

SEQ ID NO: 102058 - DNA, 290 bp, Triticum aestivum
  Clone ID: PAT_TA_102058
cgtcctcgcctgcttcctcgcgccctgctcctcccgacgccgcctacaaggtctactggtactgggccgccgcgcccttccgctcgccctggtggaacgccgccgcatgcgcgctcgaggccgcctcctgggtctaccgcaccgccgtcttcttcatgatctgcgtgctcttccgggtcatctgctacctgcaggtgctgcgcatggtcggcttcgcaagggagttcggcaggttcgccgacgtcgccgtcgtgctggagcaccaccgccggatcagggaccagctccga

SEQ ID NO: 102059 - DNA, 292 bp, Triticum aestivum
  Clone ID: PAT_TA_102059
cgcctccctcctgcgtgcctcgccgtggcggtggccggcaggggcatgcctgcgggggacgactgcgacaccgttgctcttgctgccggtcgcaacaaccaagacggtgctggtttcggcgaagccaagcacgcctttgctgggagcacggtggtgacggcggcctcttcggcggtgccgtcaacggtggccctctcggcgggggcgtcgctggctttggtccgcacggcgggtttggtgccggcgctgggcccttcggtgggtttggcggcggcttcggcgctggtggcgg

SEQ ID NO: 102060 - DNA, 285 bp, Triticum aestivum
  Clone ID: PAT_TA_102060
attcggcactcaacataatatagtactctgtatagcaaaaagctctcttctctggaagtacaggcagcccacgagcagtagtaagcagagcaatagcgagcggtcaagtaagcagcaacaagcttgtggcctaaccatgtggcccggaccaaaatggtctcatgtggcagcaccacaaccgtctccagcaacggctagaatgagaaaaaccggcgctgacaaagaaaagaaggcacaagaaggcaatggcagcttctcaccctgctgttcgtggcaatgcctgat

SEQ ID NO: 102061 - DNA, 126 bp, Triticum aestivum
  Clone ID: PAT_TA_102061
ttttttttttttttaagaccattagaagataactattgcataagagccagttaggctttagggcagagacaacagtcaaaacagataaaaatacatcttccattcggtacacgggcgcaacaaaac

SEQ ID NO: 102062 - DNA, 338 bp, Triticum aestivum
  Clone ID: PAT_TA_102062
ttttgctctgataaagctggaaataaagcctggtggactgctacacattgctgcaggtgtaatcattttgccctttacacgcacgcacgcacgcacgcacgcaagcttcctcccctgctctgctcagcaggctctcgcaccggtggctgacgcgcgggccccgcatggcaggcctcgccgcccgcccgtgcgctcggctggctagtagagtactagtaacagtagctgcccgaccgctgcggcgtcagcagtgagctactggctcggcgatgacggaggcgctggtggctgacgtgcgggcccagggtcgggtctcctttcccttccccccgccggtg

SEQ ID NO: 102063 - DNA, 108 bp, Triticum aestivum
  Clone ID: PAT_TA_102063
caactaactccttttttatttctgatacaagccagaagacaaagacataacttttgtgcaaagacacgttacttttaggcaacaagtctctgtttccacggctatgct

SEQ ID NO: 102064 - DNA, 268 bp, Triticum aestivum
  Clone ID: PAT_TA_102064
tttgattgaatttctgtaatttttagaaatttttctgggtggttaaaaaatgttcaaattttgggcagcattttggctcaatttggacagtattttacccgttaattcacttctgaagatatgtatgcacaaaacagaaaaattcaaacatatatatggacatatacatacaccatgacacaatatcaagacaatatatacttactgccatgtttttcaaccaaaagcacaaggccatagtaactggccatgttacaaccaaaagcat

SEQ ID NO: 102065 - DNA, 221 bp, Triticum aestivum
  Clone ID: PAT_TA_102065
atccacgccacctaaaaagaaatgtcgagacaatgatgatcataatctgaatctaatcagcctacttgtcactcgactacaagcgagctgcagcattgcagggacgccatgtcctcctcgacgtccatgacgagagtctcctcatgattgacatcgcttgggaagcacttacttctgatggaaatgaggaattgcaaaaataaagtactaaacaaaaaaaa

SEQ ID NO: 102066 - DNA, 287 bp, Triticum aestivum
  Clone ID: PAT_TA_102066
ttttttttttttttttagcataactgttttaaattaaagttgacatgaaggctataatacgcatggcatgcgacagggtgcatctcaaatgttacagtaacgttgccttgttaaagggtaaattatcaaaatgtttttctcaattaaaaaaaagtattctacaattgctatttacagtttggtacagacagtccacatgtggtcactctaccattacgaacctgaatctgttatgctcaggttccgaatccaactcaacaccaaaactgcagcagccacattgcacg

SEQ ID NO: 102067 - DNA, 393 bp, Triticum aestivum
  Clone ID: PAT_TA_102067
aatcggcacgagttttttttttaaaatacagattgcattcgcgtgcatataggagcttctataatgaatttacaagacataaacaattcaatatatagtacatcacaaaccaaacaatgccgtccatcaccgctgacaaatttaacagaaatgtcaaaatagcatgactatgtaaagtgtcaactatagttatatatgtaactcagggaatcctttaagatctgatcaatgtcgttgcagtgccggtcgtatttttcaaacagatggttctgctcccaatgctagcatctcgtgacagtcgctctctctgaagctgacatgcctcgagtaaataggctcatctgtgaaagcgcctaaagcagacacatcaaacagatggagtgaagcatcact

SEQ ID NO: 102068 - DNA, 347 bp, Triticum aestivum
  Clone ID: PAT_TA_102068
gagatccacaactacaacaaccaatttcgcagcaacaagcacgcaacaacaacaacaacaacaacaacaacaacaacaacaacgacaacaaatccttcaacaaattctgcaacaacaactgattccctgcagggatgtcgtcttgcaacaactcaacatagcacatgcaagctcacaagtatagcaacaaagttaccagcagttgcaacaattatgttgtcagcaactgcagcagaccccccatcagtcgcggtgccaagccatccacaatgtcgttcatgctattattctgcatcagcaacaacaacaacgacaacaacaacaaccgtcgagccagttcccctacc

SEQ ID NO: 102069 - DNA, 112 bp, Triticum aestivum
  Clone ID: PAT_TA_102069
gttttttttgacgatccaactgatgcgtcttcaaaagaggaaaccggacaatacagtatagcagcgacaaatcacaccccagcgataataaatacatatgtaaagcaacaaa

SEQ ID NO: 102070 - DNA, 336 bp, Triticum aestivum
  Clone ID: PAT_TA_102070
acaaataattgggtatgataattctatggatatatgtccatgcaaatacgtgggcacgaaacctatagttttttggtatatagtcgcaaatacataatctaaaattccacaaggaaaggtatgagacatagaaatcaataaaaggaagcatatagatttagataatttaaaatgtgtcttgctatttcatacatggaaagtctggaatgcaaaaaagaaacaaatcagaagatgtactaatgggttggacccgatcaaggtgcccaggcacctaggtgccccagttaattaacctatatatatctgtgtgtgtgtgtgtgtgtgtgtgtgtgtgtg

SEQ ID NO: 102071 - DNA, 201 bp, Triticum aestivum
  Clone ID: PAT_TA_102071
ggcacgagtttttttttgagacaaattgcacagctttattaatcttcgcatcaatcagtacattttgcagcaacactcgcatgtgtagcgtttgtcacagaattggatgtaacttaagtcgggattgtaaatactgccaattgcatggcaaagctctctgcacctctcggtcgtagtgtaaccgccaagcatgtaattaca

SEQ ID NO: 102072 - DNA, 117 bp, Triticum aestivum
  Clone ID: PAT_TA_102072
tccgcagccgaattcccccctctccaccgctcagtcccccggaccgctgacctctcccgcctttcatggctgccgcagcactgagggtccagctgaacgccctatggccggcatgta

SEQ ID NO: 102073 - DNA, 130 bp, Triticum aestivum
  Clone ID: PAT_TA_102073
gataaactgcattgctactttgtctgcatctactctctgacaggtatgtacattgacatgagctgacgatcacagcggacaagaaggcgccatgcataagccgagaacacgtacaacattgtgcgcggca

SEQ ID NO: 102074 - DNA, 237 bp, Triticum aestivum
  Clone ID: PAT_TA_102074
agaccaggcgtactccaagcggttccagtgaagttcaagagaaggagacaggggaagaccgattacagggccaggctcaggctcactaaccaagacaagaacaagtacaacacgcccaagtaccggtttgttgtgcgatttaccaacaatgatgtcactgcccaaattgtgtacgccaccatcgctggtgatatcgtgatggctgctgcctattcccatgagcttcctcggtatggt

SEQ ID NO: 102075 - DNA, 147 bp, Triticum aestivum
  Clone ID: PAT_TA_102075
gttacatcctctaacaaggccctcaataagcccaatttaacctgaagaggaaaacaagtaaggtaatgctgagacttttcctgcatacttgatgcgctgggactttaccaacacattagtgacatactggcatcataccatcgacac

SEQ ID NO: 102076 - DNA, 408 bp, Triticum aestivum
  Clone ID: PAT_TA_102076
tcggcacgagcctccctccttcccctgccaaccccaaatctcccctccccgtcgcagcgtctcggaatcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtcgtgccctccgtgagctcctcttctgcacccctggtgccctccagtacctcagcggcgtgatcctgtttgaggagaccctgtatcagagcaccaagggtggcaagcccttcgtcgacatcctcaaggcgggcaatgtcctccctggcatcaaggtggacaagggta

SEQ ID NO: 102077 - DNA, 432 bp, Triticum aestivum
  Clone ID: PAT_TA_102077
agaaaaaaggatcaagcagtatatatattcgatcacagaatgagaagatatgctccgagttaagtgagcataatgatcagggtgataatgtaaacagtccagctggtgatgaacatgatttgtcgacaaggaagcttaatagctaccaagcacaacttcgtgctcaaaaataagttaaaccgtcctgaataagctaggtaatctgaaacctacagttggccttcaaaatattatgtttcttgcactacatgtgaataaatagaactggcagctgctaaggaatacttgagtattcatttaatggttcaagtcagagaaaaaagaccttagattttgcggtatatgctttctataaagtggtaagatgattaatttgttaagctagccactgccatgtaatttgtatcaactatctaggactgcaggtcatct

SEQ ID NO: 102078 - DNA, 265 bp, Triticum aestivum
  Clone ID: PAT_TA_102078
cttccgccgagccgccgtaatatccaatcctccaagcttcgcggattcgtcgcgggcgccgtccagtggattcgcttgaacatcttgctgaattagtaatatcgattggacgcaacagaagttggtggtgaaatgatgggtggcagcttgagaaagagtgccatcccatcctgtggcgaggctgggaagattacggcagaggcgttcccaagcagcaagaggaagaaggcccttctagctctttgtgcacggttgcttcctgatg

SEQ ID NO: 102079 - DNA, 205 bp, Triticum aestivum
  Clone ID: PAT_TA_102079
ggaattcggccgagcttctatactggcccagcatatttttttattccaaaaaaaagccagcattttcttctgcccatgcaaaacatgatctattattaagaagaagaaacagacaaggcgagaaatgatttattattggtcacttggtgatgagcaggccgatgaggtcgcccgcaacgccgcaccgctccgtcgtctcgcgatc

SEQ ID NO: 102080 - DNA, 540 bp, Triticum aestivum
  unsure (1)..(540): unsure at all n locations
  Clone ID: PAT_TA_102080
ccaccggcggccatgggcgaaccgcagtttatcatcggcactcccatgagcgatatgcttgccagcatggagcgcgacggccgggaccctgcgacgctcagccttggctcaaactatctgctctacttcctgtacgactacctcccgcacccgccggtctcccccaccgctgcccactcgctctccggcttgccgttggtccccgacggcgtcgaccgcatcagccgcctcccccatatgatcctccgcgacatcatctcccgcctccccgccaaggacgccgcgcgcaccgncgccctctcctcgcgctggcgcccactctggcgcgcggcgcccctctctcttgtcgacagccacctgcttcaagacggcggcgcggccgggcagttccccatcggcgttccctctccccgtgccgtcaccgccgcggtttcccacatcctcgcggcgcatccgggccccttccgctgcgtccacctcacccgcagcaccatggaggagcaccggggcgagatgtcgcgctggctcgacatcctcgtc

SEQ ID NO: 102081 - DNA, 456 bp, Triticum aestivum
  Clone ID: PAT_TA_102081
acgcgatatccatcccaccgaccggcatggccggctccgcgcctcacgtcatggtgctgccgttcccggcgcagggccacgtcaccccgctcatggagctgtcgcaccgcctcgtcgaccacggcttccaggtcaccttcgtctgcaccgaccccatccacaagctccttcttgacgccctgcaaagcaacgccgacggcgacaacggcggcggcgaggcgctggacgggatccgcctggtctccataccggacggcctggccgacggcgacgaccggagggacctctgcaagtttctggacgggatctcgcggtgcataccaggctatgtcgagcagcttatcagggagaccaaggtgcggtggctcgtcggcgacgccaacatgaggctgtgcttcgaggttgccaagaagctcggcgtccgggtcgcctgcgtcttcccggcgtccgcggcgg

SEQ ID NO: 102082 - DNA, 613 bp, Triticum aestivum
  Clone ID: PAT_TA_102082
cttaacagcgagggcttactgcttccctctaaactcatatatttattgataagtgttgtagtttttgtatctatttcttgcagtttatgtatctatttctctctggagctagctgagtggtcaacaccgaggaagatggggaagacagagccagtgaggaagatggctcagccctgccaccgatgcccaccggccactcccgtcggtcaccagcataggaggggcgcaccatcgaggagcagcaggggaggagaagaggatacaccgccggactccctcttcactttatggtccgtgtacaatttattccagtgctcgactcggtgtccgtcccaacaaaacctaacatgtcggtgcgaaattctgctagccagcttgaccatttgctttggaaggagtaattcaactcagaaaggacaaatgatttgcgactatttttttcctacaatctctttaggaaccgcatcacaacagatcaatggcattgtaggttcagtggccatgtatgctgaatatcccctcactatacaagattggattttagtctatacaagccatcctctcagctgctcagaaatctataatgaaatttgcagtggtgatgatagcgggt

SEQ ID NO: 102083 - DNA, 461 bp, Triticum aestivum
  Clone ID: PAT_TA_102083
ctctggttgagctgcagagggacgagttcatccgtggtttgatcaacaggaagaactcaaatgaccctgaaccagcaacagctgagagaagagtgatcacaagggcaagcctacgtaaggccgagaaagatgcaggtgagctgaagagcccgagccacaggttcacgtcacctgtgcctacggctaagaagcgtaccttctgggactttggaggcgaaagcccttcagttcttgctggaaatgggcggaagactcggagccatgtagctgctgaaactccaaccagggccccttcaatgctacttcagccgggattcacacgccgaagagcctatcagcactggaccctcaggagacgaatgaatgcagaggatagacatgttcatatcttactatttttttgtcagctatgctaattggagtttatcatatccgtgtattctgttgattaaattcagttt

SEQ ID NO: 102084 - DNA, 383 bp, Triticum aestivum
  Clone ID: PAT_TA_102084
gaaaggcgtcttcgtactcgcctctctccgcgcaaccgagccttcgccctcggactccccatttcgccagcggcgcagcccaccaaccacccccacccgtcggcatgagggagtgcatctcgatccacatcgggcaggccggcatccaggtcgggaacgcgtgctgggagctctactgcctcgagcatggcattcaggctgatggccagatgcccggtgacaagaccgttgggggaggtgatgatgctctcaacaccttcttcagcgagactggagctgggaagcacgtaccccgcgctgtcttcgtagatctcgagcccactgtgattgatgaggtgaggactggcgcttaccgccagctgttccaccctgagcagcttatc

SEQ ID NO: 102085 - DNA, 478 bp, Triticum aestivum
  Clone ID: PAT_TA_102085
gaggagccgccgccgccggccggcacctccgctccgcagcgcttgaatggggaactatctgacgagtagaataacggcagagaagcatgtccatgtcaagacactgaagaatagcaagggaaggcctgacgttaaatttcatgaccttccagaggatgtactgtgtgcaattttatcgaaattacctgtgaaagaggctgttcggaccagtgttttgtcgactgactggagatgtacatggacagcttgccccaggctaagcttcggtgtcaatgatgtatgtaagaatgtgaaaatgaaacatcagcacacccagatgttcattgaccgtgttaatgcggctttggggaagcactgtggcagggttgttgaccaacttgaaattaaatttatattcgagagcaagcttgttgatcacctcaataactggattagatttgctatgtcgacccacgcaaagaatctagcttttgatttg

SEQ ID NO: 102086 - DNA, 357 bp, Triticum aestivum
  Clone ID: PAT_TA_102086
gaatgacatgacttacaggcgcattcacatagttgtcatgttaacatcttggttagttgtattcactatttgtcttcaccattatggattcatgtgtactacagccatcatcaaagctgctaaagaaatgcagtgaagaatgtagtttacatgtgtcagcttatagctgtaagggaaaatgctcctcagattaggctttcttttggatatatatgtagctttatcagttgaaacgagtagtagggatgagaactgaatactttcccagagttgttagagacctgagacacttatgcaaatctgaagatacgcatgtttttgggaagaacatttgtactggactattgttgggttgtg

SEQ ID NO: 102087 - DNA, 215 bp, Triticum aestivum
  Clone ID: PAT_TA_102087
gaagacgtctccttcacctagggttttggtggctccctccgtcaccgtcgccgtcgccgcccgcgttcaccatggcgctggcgaacctgaacaccgtggagtaccccagcttgaagctggacatcgtccgcgatggcggtactggcgaaagcacattcgtgaagaggcatatcactggagagtatgagaagaaatacgaacccgccattgtggtt

SEQ ID NO: 102088 - DNA, 552 bp, Triticum aestivum
  Clone ID: PAT_TA_102088
ggagaggagatagtaggggtggagggcaattcagtccatctggtggaaggggaagaggagatggtagggatggacggtttagcccatctggtggcagggggagagggagaaattttaatcaaggccgtggaagaggaagaaatgactggagagaaggaaaatctaattttacaagtagtgacagtccaatatcaggagattgtcacattgacagcccagcatctgaaggagttcgaaagcgccctcctatcatttatgacaaaaaagaagttaaacagtgggttcaagcacgcaagaaaaattaccctacaagtgccaacataaacaagaagttgtgtcagagtcaattggatgagcaaaagaaagatgaagaggcccaaatgcgccgccgggaactcaaggaagttatagcaaagcagaaggaattgggtttggaactccctgaactaccgcctggctatctgtctgacactgagggtcaacccaggggacgtcaaggcgatgaaaaggaaagtaattggaagactcgacaggggggtggtcgttttggaa

SEQ ID NO: 102089 - DNA, 213 bp, Triticum aestivum
  Clone ID: PAT_TA_102089
gttttagagtggtttccaatagtaaatagtcagctgtattttatcagtatttttagtgtaatatcagaggtattttattgtgatttcagcttgaacgtgtgtaaatgtgagattgctcctgagtgttggtttcttatcactagattgctccggactgcccttttcttatcactttatttactctgtgaatcttagattttgctgttatttgta

SEQ ID NO: 102090 - DNA, 346 bp, Triticum aestivum
  Clone ID: PAT_TA_102090
caagagtaaaggcactatgtgcgtgtgccaaagtgtgtgtatcttcttctttctcgagcttgtgtgcgtgagtcttcttcctcctcctgggcaagggcaacatccagctccccccaatccctgacgacctggccgcttcggtggagcacccgctccgcgtggagttggagcgctggtgcgagccctttctggctccctccggcgaggaggaggcggaagaaacgtcattcacagtgatctggatggcgcactgcaaaacgaagctgggtgccttcgtcttctctttaagcaccggagaatggcaagccgctacgtctcatgcttgggacgatttgttagtgggcac

SEQ ID NO: 102091 - DNA, 400 bp, Triticum aestivum
  Clone ID: PAT_TA_102091
attcagtcgtccttgggattggctctttccttatcgatccattatgccggatgattggtgcaagattggtttgggcaattagcaacttcatagtgtttgcctgcatgttggctacaacaatactaagctggatctcctatgacctgtactcgagcaagcttcaacatattgtcggggcagataaaacagtcaagactgcagcgctcattcttttctctcttcttggattgccactctcgatcacttatagcgttccgttctccgtgactgctgagctgactgccggaacaggatgcggacaaggtttggctactggagttttgaatcttgccattgccgctcctcagatagcggtgtcactcggagccggcccatgggacaagctcttggggggagggaa

SEQ ID NO: 102092 - DNA, 489 bp, Triticum aestivum
  Clone ID: PAT_TA_102092
taattatcatgctgcaaacctacatagttttctatattaatcatgtcatgctaaaatataaaggttatagcttcaataaattgataaaatacagatttgggctttacatatttattgaatatatatttacatatgaatacgtcgttacggtcggactccagcgaacagcagtggttgttataccccaccaggtaacttgctactgttggtgaaactctcttgtgcagaaacgccgatcttgaaatcttgatcctacttataggccgtattgcaagcaatgtactcatgttttactgaacatgtaggtaacatgaaattttgatcttctcccatcactgaaagttgtgttttaaacttgcaaaagcattgctaagcctattcaatcatttctatgttaccctagatttcactccataccataattgagatacaaatgggcattactgatgtcgaggagaagagttagaagctcttggattgagaatctga

SEQ ID NO: 102093 - DNA, 456 bp, Triticum aestivum
  Clone ID: PAT_TA_102093
cgcacccatcccacctcctggtcagatctcgccgccaaccacggccgcgcaaaatgggctctgcacattcctcccactcctccatctctaccgcggccgacgaaggcgacgatgatccatcgactgcctcagcctcggagccctcggccccgccccctcccgcccaagcgccggctccaccggcctctgcgtccaaggtgctggagcaggagcccgaggtgctcccctgccgagccgccgactcgccgctctcgccacagccatccgtaacgggcactccacgcctcctcggccccaacatcaaggtctgggacccctgccacgtgctccttcccccaccgtcgccgcaccagcacctccctcagcaggggaggacggaggcgctgctggaggtggtaatagttagccacggagaatgtgcgttcgcgatgcgacccgacctggttggtgggcgat

SEQ ID NO: 102094 - DNA, 506 bp, Triticum aestivum
  Clone ID: PAT_TA_102094
tccctcaatccctccttcagcaccagcagcagctcaagcggccagcacggcaaaacccctaaccccgttcgactaaacgggaggcacttgcagcccgcgagtgcccctgcgccaatgccgcctcccgctcgccgccgcccctccgtctccgtggccgcggccctcctcgccgccgcgctcctcctcgtcctcgcggccggcgccgtcgcagcagccgacgacgggcggacgctgctggagatcaagaaatccttccgcgatgccgacaacgcgctgaacgattggtccggcgacggggcgtccccgggctactgctcctggcgcggcgtgctctgcgacaacgtcaccttccaagttgcagctctcaacctctcagggttcaatctcggcggcgaaatctccccggccatcggggatttgaagagcgtcgtgtcaattgattttcagtcgactggactttccgggcagatctctgatgagattggtgattgctcgtcgcttaaaat

SEQ ID NO: 102095 - DNA, 294 bp, Triticum aestivum
  Clone ID: PAT_TA_102095
cgccggtttgttttcttcctgggaatcatgagccgctcccccgtagatttcccttccactggtacacatgcacatgtcgctgcaccaccactctagcgccactgtgtgcctgtgactcgcggctcaactgagcgagcaaatcttctcggccctcgcctgccgagatatattgtagcaccgctccacttcgcttcgctcctccgggtgcgacgtccattgcttccattggtggtttgttctttgttgtctcccacgtcgagcaccatggacgaggcctgtgacctcacggtgcac

SEQ ID NO: 102096 - DNA, 469 bp, Triticum aestivum
  Clone ID: PAT_TA_102096
ctctcagcttagctgggcttgcaaagcatgtgttcgtccatgtcccatagtagtgcgacaccacctccatctcatcacacaagcaatcagatgcctccactcccgctcatccgttgccccgaattcaacaccacctccatcttcctcctcaagttctgaagtatcatcctgtctgcgtacgtagtgtcgtactcatacatttcttcatcttgatgtgctcagtgcagtttgatgtacccaccgcatggccatggccatgaacagggcactgtcgtagtcatatatatgtattgtatcccctctgcgtagggactgccgtttctttttcctgccgtagtcatatatgttctagtagttagtacgtccagcttgcccatgcaggggcgggagctgctatgtccaatatattatctaacacccgtcttgagcgggcgccctactgtaattagcctgtctctaatcaggaaag

SEQ ID NO: 102097 - DNA, 158 bp, Triticum aestivum
  Clone ID: PAT_TA_102097
caagggcagaaacctggtggtgatcaagccggggggcgggaagcgcaacagcatgttcacctgcaccgacaccaaaaagaagcggcccgggtgcgaggccacctgacccagccgctgtcccaaagagtgcctcgtcctctgaccatcctgcatgacct

SEQ ID NO: 102098 - DNA, 264 bp, Triticum aestivum
  Clone ID: PAT_TA_102098
cggacgcgtgggcggacgcgtgggcggaagtctgagaagccaactgaaaagaaggaacctcagaaacctccagaaagttggtttgatctcaaagtcaacacacatgtctatgttactggtttacctgaagatgtcacggctgaggagattgtagaggtattttccaagtgtggaattataaaggaggatccagagacaaggaaaccccgagtgaagatctatactgacaaggaaacaggcaggaaaaagggtgatgcacttgtg

SEQ ID NO: 102099 - DNA, 371 bp, Triticum aestivum
  Clone ID: PAT_TA_102099
cggacgcgtggggccgccacgggctattgatcaacccagtgcgcgggcaactgaacggatctccaatctagcgtcctccctatggcaccgctccaccgtgccgaccagcattgaatatgccatcgatctgccaagaagccgcctatcgatctgccaagcagccgccacgggatggtcatccagaacgctatcctgcctccattcaagctcagttgtattgccgactgatgcaaccatgtgctgatctgccggcagtgagcgggcagagttgagggaaggcggccagctgcctggcgggtgcaccggcgagcacaacgtggaagagcctgacagcccgtccactaccagcttagttgctgactctttgattg

SEQ ID NO: 102100 - DNA, 224 bp, Triticum aestivum
  Clone ID: PAT_TA_102100
ggatcattgctcagaagaaaatggcaatcactgtaatcaagtttcccaagtgtgtgttactgaccccaggttcttccatagcttcaacaacactctagagaatttagtaagagatggaagatttttccaatcgttctatgttcgagtggcaccatgcattacaaatagcatgcgagtgcaagatgaagaagccatgctcgatatgcaagttgcaggagttgtca

SEQ ID NO: 102101 - DNA, 369 bp, Triticum aestivum
  Clone ID: PAT_TA_102101
ggataatgcagaggagttacacagcgaaatcgtggaggatgatgacagggagaatgaaaatctccaagatgagcatgatgtgtggcacgatgacgaatctcatggcaccgaggagaactggcaagatgacttccatgatgctgcacttgacacagggcccattcctagaattgaaaacagcttcaacctacgtgatgaagccaatttgcacaacatggaactgagggaattacttagcaggcgaagtgtatccaatcttctcagtaatggttttggtgacagtttggagcaattaataaggtcatatgttcaacgacgtggtcatgccccactcaactggaatctcgatacagccatgcccacagcgaa

SEQ ID NO: 102102 - DNA, 351 bp, Triticum aestivum
  Clone ID: PAT_TA_102102
gttttggatctcacgtacgctgagttaactctctcagcatgtgagttaactctctttgtttcttaaagaatcattcactaaactcttgcttaattacttgagagtcgagaaagtcataaatgtttacgctttggtgatattgcatgatatatctactaaattagagcatggaatggacgactggttttgttttatttggtcaatactcgctatcttgtggtgaaaacagaaaattatttgtctcttgtttcttgtgtaaccgcgttgcacatttctattctctatttgctcgcctcttctttttaatcttggcgacatttatactgaaaagaacataccgtactattcgat

SEQ ID NO: 102103 - DNA, 401 bp, Triticum aestivum
  Clone ID: PAT_TA_102103
cggccaaaaaatccggcctttttccccctgccaaagccggcactgcggctgccccctcccgccgccgccgatgaagcccatcgtcgtccacgccgctgccgtggaccgccggtggctgctccctctggccgtcggctccgcgctgtcgctcttcctcctcgtgctcctcaccaccgtcccgctccccttcttcccctactcctcgccctccccggcgctcttcgtggagcacaagctcgccccaaccccgccggcctcccgcgccgccggatccctcccccgcatcgcctacgtcatctccggatccgacagggacgccgccgcgctccgccgcgtactcctcgcgctctaccaccccaggcacctctacgtgctgcacctagatgccgaggcgcccgagt

SEQ ID NO: 102104 - DNA, 302 bp, Triticum aestivum
  Clone ID: PAT_TA_102104
gttgggggataatggttggagcaacctgaattttgggacgccttttccagtgcacctgttaattcagacagcaaaatgaagcttggcaaggagcagatcgattcgccatccaggactggcgtgggaagccggagagtcgaatcttatgattctgattttgagctcgtccagaaagcgatagctggtggtgttgttccagcgttctcgtcttctggtactggagatgagacccatcttgcagcgagggagagtagctggagtttactaaggcgcaagtttatctcgagatcactatctcgagt

SEQ ID NO: 102105 - DNA, 332 bp, Triticum aestivum
  Clone ID: PAT_TA_102105
aaaaattgaagcatgaagaggcttcccacttggaagatgatgaagttttgaatgcaatagctgttgaagcaaatcataagtccccgctggttaatctcgatagaccatgttctatgggcaatgtgaaggagtctgttgtcactatgagcgaatcctttgctcccaggaagaagttaaagataaaaggtccagctcaaagtaaatatcttcccatgaataccatttctagcaaggaaaatttgaagcatgaagaggctttccacttggaagatgatgaagttttgaatgcaatagctgttcatgaaagaaagcttgagatgtacctcaatgat

SEQ ID NO: 102106 - DNA, 413 bp, Triticum aestivum
  Clone ID: PAT_TA_102106
caatctcctcccctccgccaccagacgctgcgaaaaatcagggggaagcccgtcccagaatctcaaaaaccctgctgctgccccaggcgagcaatggggccgtagatctccgccggagggagcggaaggagggtctgtggttcctggagcttcccgtgctgggattcggccggcgacggctgctgctgctggggacgaagtgaaagctaccggttggctgctactgacctgtgaaagagagaagtttgtgaggcggccagggtgtttggtttggtcaaagaggagctctcagtgcccttatttttctcctgtatacatgggatgcttgctgtgagccccgctgtttgttcttggagaaaataggacagtgctcccaggatctgagttttggcctttgggcttaaaacaatctt

SEQ ID NO: 102107 - DNA, 307 bp, Triticum aestivum
  Clone ID: PAT_TA_102107
gataattacgtatatatgctgcaaaatagcaagtgaactgacaacatcgttggacactggagaggcaacatggaagacaccattgcacccatcgaaggcggaacggaggctgtcttagtccatgacgtcggcgcggcgcaaggatagactctcatcggctccctccaaggtatgcaagtggatgttcttgcggtccgcttcacatgattgatgcacgacgccaagcaagtgatggactagcaaaggtaactagctaggaggtatatatgcaagatgcatgtgcttagaggtacctgggtctctagcg

SEQ ID NO: 102108 - DNA, 383 bp, Triticum aestivum
  Clone ID: PAT_TA_102108
cagaaaagtcacttcagcaaaacctgttgtacaagatggccagggccaacttgcagggagctacacaacggcactagaatctgcttctgatctgggcagcattcttgtgaagaatatgtctaggcttgagaaagagatcttggaagccaagaagagcaaccaatgcgccgattcttctgaagggagctgtaaggttgttacagatgatgcgcaagccagcaccgaagaatctgaatctctcaagggtcagtcagaagtcttgtctgacagcaatgtaaagagaaactgtgataacagggaatcggttgaagaaagcaattgcgttcaagcctgtaccgattcttcacaagataaagaaaacagaattttaagttcacataagc

SEQ ID NO: 102109 - DNA, 311 bp, Triticum aestivum
  Clone ID: PAT_TA_102109
ctttgttcacatctgactaatgataaaagattgggacaactacggaatttgatcagtacgagattggactgccaaagcctggagaatagagaatctgctaggcttaaatctccgggaaagaatgatgtgaagtatcaatcccctctgacagataacacagatgattcatgcactatccaggagaaagctggtacaattatacacgctctaatcagacagataattgcgaagaacagatatcataagcttaggaagtgaatatctatactgcaaggggctataagagcttgggcatttgttatcatgataag

SEQ ID NO: 102110 - DNA, 369 bp, Triticum aestivum
  Clone ID: PAT_TA_102110
gctaactcctcccgtgacccctgcgtcgcctccccgcggcggcggggggaacccagccgcgccgccacggccccctccccacctcgccccacctcctcgccaccaacggaggagcggctggcgaagccgtgctggctcccaggaaggtggcggcggggcacctcggctggcctgcgctgtgccacctctaccccttttcccgtcgacctccgctgcgcaccggcgccggcgtgcctccagcggctcccccaccccccggcccccgcccgaccccttcctgtcgggctccggctgcccctggacttcgccggcgcgatctccctcctccccgccttccgtgctagatccatggcgggcaccagcacccct

SEQ ID NO: 102111 - DNA, 423 bp, Triticum aestivum
  Clone ID: PAT_TA_102111
gccatctccttcttaggtttcagttctcctccgcctccggtctcgagagctcgccagaatggtcgcccacaggttccaccagtaccaggtggtgggtcgcgcgctgccgacccccggcgatgagcagcccaagatctaccgcatgaagctctgggccaccaacgaggtccgcgccaagtccaagttctggtacttcctcaggaagctcaagaaggtgaagaaggccaacggccagatgctcgccatcaacgagatctttgagaagaaccccaccaccatcaagaactacggcatctggctgcgctaccagagcaggaccggttaccacaacatgtacaaggagtaccgcgacacgaccctgaacggcggcgtggagcagatgtacacggagatggcgtcgcggcaccgcgtgcgtgccccctg

SEQ ID NO: 102112 - DNA, 379 bp, Triticum aestivum
  Clone ID: PAT_TA_102112
tggaactttgaagttccagttatagcacaactgtttctgtaaaaaggtgcagcataaacgaggccacttgtctatgcttcttgcaaaagttgcggatactcttgatctaaaccatcaaatctctcgtcaacagctcacaatgtacttggatgttccaatttacttaactacacacctagggtatagttaattcttaatcaacctcattaattgcttcttgattacaagttttctaggtcgtgatttagctatgctcaatccatatatttgttctttgattgaaggatttcacgagaaaagaacggaaacattacatttattatcaatatatattgctagaaacatgcattgcatatgcataaaaatgctatcaagctta

SEQ ID NO: 102113 - DNA, 396 bp, Triticum aestivum
  Clone ID: PAT_TA_102113
aaagaaattaatgagaagaaaagaaaggaagacgatgtcctcattgctattgctgctggaaataggcggcctatagttcccaacatgtcatttgagtatgtagatgcaaatatccacgacgatctttataagatcgtgaagtactcgtgtggagaagtctgtggctcggaccaactggacaaagtgatgaggatttggacaacttttctggagcctattttgggcattccgtctcgatcccacggcgccgtggatgcagatctaactaaacccaagaatggcatcacaaaatctggtattgcaaatgtgggggaaagcaatgcttctcctgatggagttgctgcccagcaaggccatggtgatgaaagcatgcaacaggagcaagcaccatcagct

SEQ ID NO: 102114 - DNA, 351 bp, Triticum aestivum
  Clone ID: PAT_TA_102114
caaatttaagggttctgaagattcagaggtgtcctgcaataaagatctttcctctatttgagagctcccacgaatttaaaatcgagcagatgtcatggttgcccagtctgagggaactcattatccatggatgtcctaatttacttgtaccacatccccttcccccatcacctaccatttccaaactatccatcgtcgacgttccaacactcccaaggatagagggatcatctggtgacacattaacaattggatctggaagtgagggcaatgataactgtgatccttcttcgggtatgatgactatactggattgcaaaattttggcattccacaacctgtggggcctca

SEQ ID NO: 102115 - DNA, 181 bp, Triticum aestivum
  Clone ID: PAT_TA_102115
aaaaacagaaacagaaactagaagtgggggagaggcggagagggagatgccggagctgccggaggtggaggcggcgcggctggcgctggaggagcactgcgtcgggaagcggatcgtgcggtgctccgccgcggaggacaccaaggtcatcgacggcgtcgccccgtcgcggctggaggcg

SEQ ID NO: 102116 - DNA, 530 bp, Triticum aestivum
  unsure (1)..(530): unsure at all n locations
  Clone ID: PAT_TA_102116
gaacttggcgccgcctcgaaggtgcctggcccgccgggaaagtccgggaaggtgatgcggtacgacttgccgtcatgcatcctaacatgctgctgctcctcgtccccgtcctcctcctctgcttcctcaatctctgtttctgccgcagcatgctcttcgacattgccttcagaactcccatgccgacgccgccgctggccctctagacgctgctcgtcctgctcggcaagcaggcggctgatgttgcggctcttggacatgagcaggaactgcgcgcgcaagcaccaacttctncgcggaatttcgtcgagcacagatttaattcaggtgggggttcatgtggggggtaactgcaggttgaatcagtgaaacggcaggggggtttgtgcaaaactgcaggcgctgaccggccagccacttggcagccaattggcgagctctgattggtctgggactaaaacatcacattggttgcaagttggggtatgagttgatctagttttgcaagtttgggactagatcatcacatt

SEQ ID NO: 102117 - DNA, 170 bp, Triticum aestivum
  Clone ID: PAT_TA_102117
gtgcggcaggggctggggaggatccgagacgggcggcgacgacgtgggtcgccgatgacaacgaggaaagccagagcgcgacttcccgggcggacccatggcatccggggctcctgtcagaaaggagacagggagatggggggaggagaaaaggggggaaaggaggggag

SEQ ID NO: 102118 - DNA, 515 bp, Triticum aestivum
  Clone ID: PAT_TA_102118
gctgaaaccatttctttttcttttcgcttctcgccacaccaccaccaccactgcgaatatgctgtccccagccacgccggccgccccctgatccccaatgcccccgcgccgccgcccgcgccgccgcccgcgccgacccgcgctgaccgctccctagtccacccctctcttcctcctccgccccgccccgccctgccctgccctgccgctcctccccgctcgcggaggacggggttgtgggctgaggggacggctagggttttcctcgattcgagcgccgccgggctcccgcggattcgtgctcgctccgcggagcgccgcctgctgtttcgctttgccctaggggttggctcccttgctctcttgctgacgcggaaccgcggctccggggagctccggggctcgattcgcggagctttcggcggcgcggcggcgcattctgtggcctcgcaagcccccgagggcttcaagcttcgattcggccgatttggtcgggtccgggctctgcaaagcgc

SEQ ID NO: 102119 - DNA, 499 bp, Triticum aestivum
  Clone ID: PAT_TA_102119
caccggagttattgccgcgctgccggggctgcaatggagcttcgccggtgcggcatgccggatgaggtatgaggtcgtcgggtcaccggtgctatgatgtcaaggcggccggtgatgcaatgaagcctcgtcgccgcgcaccaatgctgcaatgaagtctccgtcgccggccaccggccaccggcgctgcaattaagccaatcgtcgccggccacgggttgttctcctactctgtactagcgctagagcgttgaccccatccctggtgctgctcgccggcaacaaaagctatgatgcgtgacccgtagatgaaagcgatgattgacgaggaatctggcggcttaattcatcctagttaagcgaatcggacggcaggctaggcggcttaaacttggacaaaatcagccgcctgatttgtagcaggcgccttatacttcggggtgattagcaccactttatataggattactgggagtgttacacagcatcattatccttt

SEQ ID NO: 102120 - DNA, 481 bp, Triticum aestivum
  Clone ID: PAT_TA_102120
cgcaacctcccgagctggcctcgatccatggcctctccttccacccagatccgatccgtcaccgatcgtccgtggcgcgagcgccgggcctcctcctcaatctcctcgttctgcgccgccccgattacactgtgcacacgtgctccggagccatggccgccttttgtcgagccgcgtgatcgatgtccgaccggcgccgcgaccggcctcttgcgcagttcccgaccgtcgtcccctgtgcctcctcccgcgtctccccacctcgcctttgcagcaccgttgttgcacgtctccagcgccatctgctgcagccccgcagtcaaccgcttgcacgccatgggcagcggccatggaccagttcgacaagaccatggtgcttgcgggcgggatgcccctcgccgccggcagggcagggaagatgtgggagtccctgggcactcttgtgtgacgcctctgcactgcctttgaggagcacgatgac

SEQ ID NO: 102121 - DNA, 462 bp, Triticum aestivum
  Clone ID: PAT_TA_102121
gggacagctcagagatttaatagtcattcgtagccctagattctttgctggatggactcccaatcccaggcgggtgcagctgcaggatgaactaggacaagggcagaagctgcagcagcttggttcattcaagctcttgacggatgaccacatgggactcctcgctgcacccatctgcagcttcttgtcttattccctcacccacctaaacctttgtgaggacgataagattgaacgcttcacaaaggagcaagaggattcccttcacctcctcacatccctccagcgacttgactttgggtctttcagcaagcttcagagcctcccagcagagctgcacaagtttaccaacctcaagcaattaggggtcaggtcatgcccggctgtcaggtcgctgcccaaggatggcctccccaaatcactgcaagaattagatgttggggagtgcgacaacgcggagtt

SEQ ID NO: 102122 - DNA, 420 bp, Triticum aestivum
  Clone ID: PAT_TA_102122
actatttaagtatacatagaatgtgtacataaatgcacttttgttgaaacatgaacttcgagcaatctgtaccatcttattgtttgtcccttgtagtttaattaaacttcattgttttttaagaaacatatcttccggccatagcactagattctctttaactcctttttatgtgtggatgcatttcattaatcatcacataatttaatatagttacctcattgtaattgatgatatatgggatgaagtactgtggacagttatcaagtgtgcattctctagtaataacaattttggcagtcggctaatcacgacaactcgtatagtcagtgtatctgaaccaaggataaatcatactctgtcactattaacctccctgctcgcagcctaaactagcgatcgcgacaagctgacattcag

SEQ ID NO: 102123 - DNA, 487 bp, Triticum aestivum
  Clone ID: PAT_TA_102123
ctgcaatgatgcagcaaaacagtgatggcagtggtttgaatgttaatcaggaggtacaagattcctcggagtttagccaatcagcattggctaatatttcttcttctcaagtggagcaagttgatgagcctgtgggctgtcatgggcaaatacattccaatgatggagcacatgactcttactcttcatgtcaggaagcatgccatactaaagccaacgatgctgcctctacttcaccagagactcgtcaccagttgtcgatctctgaaaatgatccagatatacactggcagcaagacctttctgtagccgacttcgatcttcagtcagaactgtggcaggatatttcttatcagagtcttcttactgcaccagactccatcaatgctgtttctttcttcagcccaaattaccagcatagtgcatgctcatctgaagttgcgaacaattttgaagaacggctttatccattgcatacatactcatc

SEQ ID NO: 102124 - DNA, 510 bp, Triticum aestivum
  Clone ID: PAT_TA_102124
gtgctgactctttgaaagatcctttcgtgcctaatgattttgctgatgatgattctaatgctatgtctttgttagttatttttgtattcttatcttctttcacttccctttatttttctattttcattttattaatttttgtgcttgttgtctgattttttttccaggattgttctggtgatgatgaagagtttgataaagctctatacaatttttatgtgaataattcaattacctaaagaggaaattatcatctgctagtagaaggaatgtttgttgttttatagttctaaagttcttgaagaattgttcaaacaactaaatctttttgagtggctacagagggctgcctcccagtgattagcttccgctgctgcctcttcgcctgttgaatcatcttcatgcatttcttgccatgtctgcagagtagttcaacttatactttgttatttctgggcatttgtaactcacatttagtatgaggtcttctagtgacattgatagtagatc

SEQ ID NO: 102125 - DNA, 523 bp, Triticum aestivum
  Clone ID: PAT_TA_102125
gccacgctggaatgtacgaggaggggcgcaagtacttctcagcaatggagagtacataccagttgcggcctacactggagcactacacctgcatggtggacctccttggacgggccggccgtctcaaggaggcacaagaactcatctcctcaatgcccatgccagccgacggtgcggtgtggggtgcccttcttggggcgtgcaagatacataagaatgtggagataggggaggaggctttcgagcatgtcatcaagctcgaaccgagcaatgtcggctactatgtgctcatggcaaacatatacacagacacaggacaactggagggtgtggtgagggtacgtgcgatgatgagggagcgtgggctcaagaaggagcctgggtgcagctatgtcgaaaacaaggggagggttcatctcttcatggctgacgaccactcacatccgcaggcaaagaggatttacgagctcgtgattaagcttgaacaaatggtgacggagagaacagatggcactgtggaaac

SEQ ID NO: 102126 - DNA, 417 bp, Triticum aestivum
  Clone ID: PAT_TA_102126
gatttatttgataaatacgtgaccatatgggtaacctattgtttgttttagcactatcggacaatgcattcctatttaacagggaattgcttatctatgattcaggctagaacaattgttttctactaacgattgaagttccactgtattcttcagatttgcgtagcgcatactgctctttgaacaagcagttgatgtcttcacaaaaactgctcaaaatcaactatgtgttgtgggacagatcttttatctctttgttttgctccctcaaattgttggaaaaatggctagcctatttcttccttcagatgatacatatgaacagataatgctaggtggtagccttgcaagatgcattttgatgttcatatgtactgtctgcttgatgagagaaaaaacaataatataatagatagt

SEQ ID NO: 102127 - DNA, 161 bp, Triticum aestivum
  Clone ID: PAT_TA_102127
gggctttcaggtttttgcttctgcatcgctcacttcatgctgaccaggttcgagtgacattgcttgggaccctgcgggactcagagcatggggatgaggagaagcaagggggcacacacgaagaagagtgaagctggagcattcatgacgaagcaaaggag

SEQ ID NO: 102128 - DNA, 436 bp, Triticum aestivum
  Clone ID: PAT_TA_102128
tgtagatttaagtatagttgaagaaattaagggtttgttttcatctgagagagacgatgaacaaggattcttgagtcccggccacaaaacagaatgtattgcatctgcccggttggattcatcagaggattgtaatcttgtgaaaagggatattaatactgaagtgatctgcaaggaggaagagaaacaggaacttgttccttcttctgacactcgcacccttcatgaaacatcaaatactgatgaacctgatgaacagagaataaccctgctgcaagctgcggaaacatcggcttcagcagataagcagcttagctccgagctggaggacgatgaatttaaggaacacaactttagcagtgaagaaacgattggcatatttggtgttggatcggtgaagagtaatctattccatttgcatgaagactctcacacc

SEQ ID NO: 102129 - DNA, 558 bp, Triticum aestivum
  Clone ID: PAT_TA_102129
cgatgtttgaataaggttaaaatggggctctcttcgagcatctccatggtaagtgtgtactgattctgttaattttcttactgtcaacagaatggttcctataacgtgcagccagttcaacaattttagcatgtgttggtagccaacaattactaataatcagtatttgataatgctttggattattctgcagttctttttttaccgcagttatgttgcagtcaaagatgctgagaacatggactggatgacccaacttcaaatggcgatggggatagcttactgtcaagagcacatgcttaagttgaatctacctgctaggctaaggaacctcatctcaacagttatgttgcaacggtgtcagatcttgatgtctggaatggcaccaagggatctgattctgtcactgatgattgcatcatgctatatttcattgtgcatcagtatggcatcatgcttaagctgaatctacatactatagcttactgacgaagataatggctgcatctttttttagctggtcttgtcgcatctatttgaaaacatacaacttgatac

SEQ ID NO: 102130 - DNA, 256 bp, Triticum aestivum
  Clone ID: PAT_TA_102130
aaatagagagtgttagactttctctttgtttgtctcatccccttcttaagtgactggttcctgcacggctattggcttctccaatggatcatgtaggtagaaactaaaaagaactggataatttcttttacccttcttttaatttcaataggactcccgagttcagaattgacaattcacatcatttatcagtacagagcagatcaattgattttcataaaaacgcatattagaattatcattggattgggtttca

SEQ ID NO: 102131 - DNA, 473 bp, Triticum aestivum
  Clone ID: PAT_TA_102131
aacgtcaacggctggtggaaatccacaatacattaaggatgaatctgcttcaactagccattttgtagaatatacatgatccacggtggcgttactctattactagacaacttttgttggccatccgcttaaagtgattacacaactttcatgcaaaactaaagtggtcatataatatttgaagttttactttgcactcccttctaaaatttatacaactttgactttgcttcaactttgactttgcctctgcttcagttttttctaaagtgtttttagaacacctcaagaggggcacgggttcctacatttcattaagaagaagagaggtgttcctatttataaggaaaaccgaacccaaaaacctaacattctcggttaatcagggaaaaccgaataaaaacctaaaaatggaaagaaaaaaaaaagagaaaaaagagcactagaatttggggacagggacaagacaaaag

SEQ ID NO: 102132 - DNA, 495 bp, Triticum aestivum
  Clone ID: PAT_TA_102132
gtcatcttataatttcacaggatgcatcagcatgcttgtgaccaagaatacatttcaagaggggcgtccaaattaaaatgctgaggtgattgctgaagagaccacatccatccaactacaacatcattggaaaggaaaggcgtacgtccacatgtgcgcttgtgcatcacaactatttgaccatgatgatgccgttgaactaaaactctaaggacatgtacaatagtggcataatggatatagatgccccatgaccaaaagtagcttggggcatctacgttgatttttttctcttcaatgcaagctaccactagtaggcgtcatcaaagaatagaaaataaaaactcacactatacatgcatctctactctacacctcaaccttttcaactttatatatgcactggaccatattttttctccccaagcacccgcctccttcaatggatcccgctgctccatccgaacctacttttccttacatcctatcttacgt

SEQ ID NO: 102133 - DNA, 398 bp, Triticum aestivum
  Clone ID: PAT_TA_102133
aaagaagaagacacagacagagagagaggcctcgaatcgcgtgacggtgaaacttcccgtgcaatccatccatgggagggagtgtgcgcggcagcagcagtcggcacggggtctcacgaactgctttccttcttttcctttccgctgggcatttttgtagtgggagccatccgccgctgcccgctgcgttctctgatgcactttgcgatctccaaatgcttttcacaatgtgcttctctgaatttttctctgctactagatagagagtcagtggcacgtttaaccagtttgagacacatgggggtaggattttgctgcaggcaggtaagtgccatttgcacactaatactaagaaggttcagctgtcagagaggaaacccatgttcagcacgttcttg

SEQ ID NO: 102134 - DNA, 338 bp, Triticum aestivum
  Clone ID: PAT_TA_102134
ccacacccctctccacatttgtagataaggccttccctcgttcatcttcgtctcccacgagataaacagctcgtataaatgtaccttgatgtttacgtgcaacgcatgggcctcttgctagtctcaaatataaactgcactagtgcgcgcccacagaacatcctttctgaagggatgaagccgtacagttaccatatcctctcatgtaaaccagctccataagggacaaggcagttggtcgccattgccatggattcgcaaggcggtggtgcttctcgtccttgtcaaggttggcataccttggacgacaatcctttgggacaaatcgtaagtcgctc

SEQ ID NO: 102135 - DNA, 364 bp, Triticum aestivum
  Clone ID: PAT_TA_102135
gtgaacataagtgaagacaaacagagtatacatgtgaatgtggtcagttcgagcacactggaatgttgtgcagccatgttttgagggtcatggagatactacatgtggaggggatcccttctaagcatatattgaagcggtggaccaaagacgcgagggacatacttccaaaagatgtggttcagtaccagagagataattcagttaacatgtcgttgacatgtaggcactcgaccctttacttgagagcaatggaggtagtgcggctgggtgactctagtgcagaagcattcgatcacatattagacgggtttgaagctcttttggtgagtggagcacctttcggaaagcgaagggatggtat

SEQ ID NO: 102136 - DNA, 217 bp, Triticum aestivum
  Clone ID: PAT_TA_102136
tggcgctctccgatctctcccgcgactcgctcctccccagcttcctctactccccgcgctccttcgccgccgccgcctccccgcgcttcccctcctccccgtcgccctaccaggcgcccgccgcggccccggctgctcgtctcgtcggcgctggcggggtcgggggcggcaggcccttctcgatccgcgcgcccaacgagaagatagagatgtactc

SEQ ID NO: 102137 - DNA, 420 bp, Triticum aestivum
  Clone ID: PAT_TA_102137
gtcccccgcacgcacccagccgagcccagcgagagcagcaactccattccccattccttcttcatcaccctccccctccccgcccccaaaaagtctcaacagcacctccctaatcgcctcctctcctccttccatccaggccaaaagccctttgcttttcgccttccactcccctcctcctccgtgccggagttcgccggcggtggtgcctttgccccgcctgccttgggttttagggggattcttgaggggttttaggtaggccgtgtctggggcgctggcaaatgccagtggagttttagggtgagtgttttcctttcctcgatgtggcccatggaggaggagtttttcatggcggtgaagaggacggagcacgtcgaggtgacgtcccgttcggtggcggcgtcggccaggggggag

SEQ ID NO: 102138 - DNA, 125 bp, Triticum aestivum
  Clone ID: PAT_TA_102138
aacaaatccacggctgcctccatcacgaatacttgaccacgcctgctgatggggggtgacaccggcgccaagcagtatccgcacccagctccaccatgcggtgcaacggcggcggaccccaagtt

SEQ ID NO: 102139 - DNA, 501 bp, Triticum aestivum
  Clone ID: PAT_TA_102139
cgcctgtcacatcacttggctcgccacttctccattttcaaccatctccaactccgcagctctgatagaattgatcaattcttcaaggggctctctaaatcatctcaagtgtccctgctcaaggtgctagatctagaaggttgtctgtgctttcttaagaagaaacatcaatacctcaaggaaatctgcagcaagatgttactgctcaagtatctgagcctaaggagaacagatattacccagctacccagtgaaatcaacaacctccgtgagctagaggtactagatatccgagagactaaggtgcctccacatgcaacagcacatatcctgctattgaagctgaagcttctgcttgctggtcacattgatccaagcaattttgaatctaatccccggattcctcataggatcgacaaaatggtaaacgtggaggtactatccaatgtcaaggccaagcagagtcatgatttaaaagatattggaaggctatggcagctg

SEQ ID NO: 102140 - DNA, 450 bp, Triticum aestivum
  Clone ID: PAT_TA_102140
cgtagtagtagtagtagcggcgtcgcgccccgtcccaggcgaggcgacggacggccccgcattcacgccacgctcaccgagggcagcagtaaacgcagccagaggccggtcgtttctttcttttaaggaggcagcagaccggagcagagcagcggcacggctccccttgctttcccttcccacggaagacaagtatccttgtctctggctccctccccttcttccccacgcttgttcttctcccccccgtgagcagtagcaaagggagcgagctgctgctgctgctcttgctgtgaggtggaaccgtggaagtgaagtgaggaggcgcggcgggagcgtcagagatgagcgtgaccaagtttatcaagtgcgtcacggtgggcgacggcgccgtcggcaagacctgcatgctcatctgctacaccagcaacaggttccccagcgactaca

SEQ ID NO: 102141 - DNA, 504 bp, Triticum aestivum
  Clone ID: PAT_TA_102141
agcgaggagaccgccacctctcagtgacttcccatgctcctgcaaaaattcctcttcagatagtggagtggcatctctcccatagtcttcaacatccgtgtcctcacagatccgttctctttttcatgaagtgcctgggggctttggccacatgaaaactttcatttgaaatatagaagataaaaatcagtgattttgatgtcataccactcatctttcggcactgtacggacaaactttgagatctttactgccatcccaacagatgaagacatggattacatattaaaagttcatcagtgttctgtcgtttaagaccatgtgtgggtataccattgacaaccaatgatttctttatgcttgaaaaatacttcatcgctgcactatgatggtaagatatgttttgttttcctctaaggaaacttcatagttccaacactgttttatttttgcagcattgtagagttcttttgaacgtataggattccaaatcatattcagatt

SEQ ID NO: 102142 - DNA, 524 bp, Triticum aestivum
  Clone ID: PAT_TA_102142
cggacgtgcttgctcgcccggcgctggcgcggcgtctggaggtccgtgcccaccctctgcttcaccggagccaaggggtggggcagcgccgacaggttcgcccaattcgtggaccacttgctccacctcaggtgcgggggcgacggcccgcctctggattcctgcgatttcgacttcgatcacgacggattcatgctgtggcccgcaaacaagcggcgtgccagcatctggctctggaaggctctgcctcgtgtccgggcgctgggcctttgtatcgtcgaggagctggaaacctggacacgattatctgataagcatctcttctcccagcacctcactagattagagcttgctggagtcagtgtcagcgacagcgtcgttgatttttcaggctgtccggcattggtgcaactgagtatggattattgcgatgtttttgtcagacagctggtgtctccatccttgaaacatctgcgcgttacccgctgctatacttctcgcaattaccgcattcttatttctct

SEQ ID NO: 102143 - DNA, 402 bp, Triticum aestivum
  Clone ID: PAT_TA_102143
ggcggtacgagtaaaccctacgctcgtcttcctccgttcgccgacaccacctcacgtcgccatggccggcgacggcgaccacccgggcgccaacaagcgggagcgcgaggcggtggggaggcccgaggcgccgtccaaggggggaggcgatgccgtcaagcggaagaagccctacgacgcccccggggcgcgcggcggcggctccaaggagaagccgcagcctgtcaccgccatggaaaagcgggtggcagccgagaaatgtccttaactctctgtggcaggaaattttcctgcccgagtcgaggaagcccgattacaagctcgtgaaggaaatcacagtactatgtcaaaaggtgagatgctgtaatctgagcgggaaggagagatccaagctacttaccg

SEQ ID NO: 102144 - DNA, 495 bp, Triticum aestivum
  Clone ID: PAT_TA_102144
gcgaattcccccagaaaataaaaaaaatccgcggatatgccgaagacctcctcgtcgccttcccccaccgtcgcccccatgaatcccctcctcccctcctcctcctcctacctcaaatcccaccacccgccggacccggaccccggctccccgaaccccagcccctgcagctacctcctccacgtcgacgccgacgacgaggcgctgatccaaatccccggcggcccgaaccctagcccgggggggcccgtcgcctcctcgctcgcgctgccgcccgtcgacccgacgccgcacatctcctcgcagttctacaccttcaccgccgcctcgcacgcgctcatgctgcgctgcatcctcgccggccgccccgccgtcgccgaggaggtccgcgccgccacctccccctccgtgctcgcctcgtggcgggcggtctggaaggaccggaacgaggacaccgcctacctcaccgcgtggaagcgcatccaggacaagctc

SEQ ID NO: 102145 - DNA, 503 bp, Triticum aestivum
  Clone ID: PAT_TA_102145
ctagattatgaacgggaagaaatccatctagaactggggcaattcattactcgcgatgagcgttgcatcggttacgctgatgagtttagcccctactatgtgtatggaaatgaagtgacgttgtacaacaacaatcttaagaagctgcgcaagctaattagaaacaggacaatacctaacagctactatgtctgccacatgacaaagacctttgcaacccctagaaaaacaatgtatttcctggtgcccttctctaaaggcagtatcttcccacatatggatgccaacaatgagctgccagtaagcaatggagatggtactgtcaatgccaaagttcgctttatcaaaggcgtcgacaacagagctaccatcacaaagaactggagcgctttctttcgacaggaagaaatggtaaagggccgggtctatgccttcgcgttcaagtgctcagcaaaggggctgcgcatgatcgtctatcccctataaggagatccatgaatatc

SEQ ID NO: 102146 - DNA, 444 bp, Triticum aestivum
  Clone ID: PAT_TA_102146
cagtggtcagtgccgtgcgacaacgacgcgtggcggtcggcggcggctccggccgtcggcagcagggtgcggaagcgatgaggacgacgcaggagaagcagcgccgacgtggtcgcgggtggggttggcttgagccgctcggatgccggctccgtgggcccaatcgacggcgaccggatctaagaggcgcccgccgtcagcggccggcgcgcacgccgccgaggcgggagaagaaggcgaagcgaggagccgagcctgcctgagcccgagcctccccctggcgcccgggtagcgcgcccaaaaagaaaagcttcgggcagatctgctccaggcaaatatattattatacacagctgcatgcttaatcagggatgcccatacaggaagccggtaaagaagctagaagcacatttactctgtaatggatctagagcacatttactc

SEQ ID NO: 102147 - DNA, 514 bp, Triticum aestivum
  Clone ID: PAT_TA_102147
ggggcccgtcgtagccaagctgggtgctttgctgggcagggagtacaagcttcggcgcaggactcagaaggacgtcaggttcatcaaatccaagctgaaatctatgcactctattctttgggcgacatgggagaaggaggttctggatgtcgaatccaagaacttgaagaaggaagcgctggatctcgccaacgatatgcacgacgctattgatgacttcatcctcatcatggatcccagccgcagaaacaagcgattgatggtgcagagcaagatcgaagccagccgtcctttccaagagttcaagacgagagtagatgacgtatcgggccgctgtcgcagaaggtggaggtgggagaagaacaagtcttctgaacccatctccagcttattttcaagaagaggcgtaaaatccagcccccccagcaaacaaccacctcctgctcgagctccatttgtctgcaaggatgcatcagagctcattggtctaggcaaatggagggatgagctcatc

SEQ ID NO: 102148 - DNA, 252 bp, Triticum aestivum
  Clone ID: PAT_TA_102148
ctgcagaagcctattactgatagacttggggaggcccatggtaatcctgcaaaggcaagtttatttgtcaagttattgtatctaattttgctttgatgctttcatatgctcaccaagttggttgctgtgtgtgtcattgcctgctgttattcttgtgctgagtgctgactatctttaatactccctccatcccatgtgactgacttagtacaactttgtactgaagttgtacttaatcagcaacacttattt

SEQ ID NO: 102149 - DNA, 204 bp, Triticum aestivum
  Clone ID: PAT_TA_102149
gcggggccccttcctttcctttgggcgtcgagagaaacaccagggagcggtgactgagaggagagagggataaactgtttccaccaccaccaccaccaccactggggccactcttcagtcttcaatccctttcttcttttcaaccggttcccaacccggaccccttccttcgggcccttttctttccttccccgccttttcctt

SEQ ID NO: 102150 - DNA, 291 bp, Triticum aestivum
  Clone ID: PAT_TA_102150
ggctctcctcacatagcaggtgccccgagtccccccgtccgaatccatcgcccccgaaccctaaaccctagagctctacagcgccttcgccacctctcgcctcgtgttcgccgctcgctcgccctcgcctgcgctccgccgctccctcgtcgtcggctgcgcttcggcgcgcactcgccctcgcctgcgcttcggcggtcacctgcgggtgcccccaaactccgtggaagatggcgcttgcgatctcgatggaagccataaatgcgcgcgcgcgggagctggggatcgacc

SEQ ID NO: 102151 - DNA, 384 bp, Triticum aestivum
  Clone ID: PAT_TA_102151
gcctccccaaatccaaagatgcaccaccagccgccgacgccgtctccgcgccgccctgcccggtcgaggacaagccgccccaggtccagaagattgaggtcgtcgcgccggcggcggcggcggccgacaaggatgaagacggcaaggaccacaaggagcacgaggacggcgagaagacggcggcggtgccactacccaagagcaacctcaagaaggccaactgcggcgacgacggcgtgtgcgcccccaagggcaatgtgaagtggcttgatttgctggggaaggatctcaccgaggtcaaggagttcgagccaagcgaatccggagactcaatggacgacgaaggcatctcgacgtgcgtgtgcgtcatccaatgaacccaag

SEQ ID NO: 102152 - DNA, 438 bp, Triticum aestivum
  Clone ID: PAT_TA_102152
ggcccggtccaatacacggatatttcattgctaacaaaagaaacattgcttcacaaattaggattacccgggagcttgctgctcgtctttaattccatgaagtccgaaattacttccatgctcgccaccacgctcgcccccggtgtttgctcctgatcatcctctaccgctgcttcccatgctaactctgggccaccaaagcttcttgctacctgaaactatttcatgctcgccaccaaactcgcactggcgtttgctcctgaccatcctctgttgcttgctatatgggccgccaaagcttctcgctgcctgtgctcgctgactgattagattcttgctgcccatgctctccctgttggagccgatactacttcatctggctgcattgggaaccggacactatatgaagcaaattctccaagcttggggagcaaattt

SEQ ID NO: 102153 - DNA, 436 bp, Triticum aestivum
  Clone ID: PAT_TA_102153
gttgaagcgatttctgaaagaatgtttgcagcagaaaatgcttccgagttgtttcttgtaacgtcaaaggaacttgttaacagaattaataccatgcagtaccaactaagtgcatcaggttgtagggaaagtgatcttaaagcaaagctagagcaaagcttggtgcagttaaatgctttgaatggctcactggagatgatgcaaaatggcggtgaggagaatgccagccaggattccatgcagaggcaaaggctgtcgacccctgagttcttcgctttacagcataaggttcagaaactggaggagtggctgagggaatcttgctcccaattgcagttcgtaacagtatcgacagaaggaaatgaaaaagagcagaatatgtcaccatctgagataagcagatttaggaatataatcaatgatattaaagatgctg

SEQ ID NO: 102154 - DNA, 390 bp, Triticum aestivum
  Clone ID: PAT_TA_102154
agctaagtctggtgaaagtgacgacgacgaagttggcaaatcagtggagaacctcaagaagttagttccgcgcactcttgaggaatttgccaagggagttgttagtgcgcaagaaaattcttcagcagcagaagaatccaccgctgagtcgcctgaagaagagaaaaggcctctccaaaaaggtgatagggtgaagtatgttggagagtcagtgcttgttgaagcagatcacagaactttatcaaatggacagcgtggagagatatacgagatcaatggtgatcaagtggctgttttatttcaccctcctgaggagaagctggatgatggtaaaaataatgaagctaacaaagagcaagatgctaaaccatcagtttgctgggttgacac

SEQ ID NO: 102155 - DNA, 400 bp, Triticum aestivum
  Clone ID: PAT_TA_102155
cggacgcgtgggtgagcgtgcagcctgcagcgtgcggcgtgcgcgtgcgagcgagagaaaaaaaaaaaggaggcggcttccgttgcatgtgagcggagcggagcggaggggcggaagagcagagcagcggagcgcggcgcggggccatgtcgatcgcgctgaagagcgggcccgggctagccggcggcgggggcgcccggttcggccgcgccgcccgctgcggcgcctacgcctcgccgccggcctcgggcgggcgcggcggctcgtcggggggccgggacagcgacagcccggcggcggcggcgcagtgggagtgggacggcgaggaggtcgagggcggcgacggcgaggtgcagagcaactacaaggggcccttcgacaccatggacgcgctcaacga

SEQ ID NO: 102156 - DNA, 287 bp, Triticum aestivum
  Clone ID: PAT_TA_102156
gcgtaccagcagcagctccagtaccaccagtactaccagcagcattaccctggctacaatccctacacccagcagtatcaacagtatggccaataccaacagtgcacacaacctcaaacgcaagtggcaccacagaatgttgctcaagtgcctgcacaacctgctccatatgctcagcctcaatttctggaggcgccacaggcccaacacatagtgccaaaccagtcccagaatcctcaactccaagcaccagctgttcagccacagcctcagcagaatccaccatt

SEQ ID NO: 102157 - DNA, 299 bp, Triticum aestivum
  Clone ID: PAT_TA_102157
ctctcgctaatagcatattttcagaggtcacgctattttgtatagcacgctattcattagatctgtctactcctgtattttcagttacctgtgtgactgaaaaaatacactatatgtcactatgatatatttcttaagttatgtatagaacctctgcctatatacttggatcaccggattgttatgcatcaaaactacagaattactacttaccattgtagtgtcgtgttctgtgtgtaccaatatctctaccactataatacaccattcttgaatttggatgcaccacctacttgctt

SEQ ID NO: 102158 - DNA, 469 bp, Triticum aestivum
  Clone ID: PAT_TA_102158
ggagatctatgcggtgttgtagaactacaacaactactggatattttggagcttacacatcagtcaatatcaagatttcttgaactggattcttactctcttatgattagtgaaatgcaagagaacctttcactggtttcttattcgagtcgcatctcttctcagatatggaatgagatgcaaacagatttcttgcccaatttcatcctgtgtaatactacacaacggtttgtgagatcattaaaaggagctcatcactcttctcagcgatcagatgcttctactgggaaaccttacttctactgtggatcgcatgatttgacaatggcataccagggtcttgctggtctgtaccgtgacttctttgggatccctcacatgtttgcagttgttaaacttcttggttccagatcattacctggtattatccgtgctttactggatcatatatcaagtaagataacagcta

SEQ ID NO: 102159 - DNA, 211 bp, Triticum aestivum
  Clone ID: PAT_TA_102159
aaaacaacccctttcccgggtttttttcctttcacttggcaagttcagggtacatttttcattaggggtgggatttagcagccttttccccagtgctttttccatgaaaaaattttgccccaaatcacaccctttcaatgcgaacgttgagagacaccttggacgccccaaatccaaccaaattttttgggggccccattaaaaacgacgg

SEQ ID NO: 102160 - DNA, 324 bp, Triticum aestivum
  Clone ID: PAT_TA_102160
ggcagaagcggatgatcaagaaccgcgagtcggcggcgaggtcccgggccaggaagcaggcctacacgaacgagctggagaacaagatctcgcggctggaggaggagatcgagcatctgaaggagctcaagaagctggaaccggtgatgcagttcctgccgcagcaggaggcgggggagaggcagcagcagcttcggcggcacgcggtgctctacatgccccagccggaggcggagccgaagcagcaccggcaccagcttcggcggatcaactcggcctccttctgatcgatggatcgatcgacggcgagagagagacacgccc

SEQ ID NO: 102161 - DNA, 577 bp, Triticum aestivum
  Clone ID: PAT_TA_102161
cgcatcgcatcgcattcgccgacgcgacacgcaccggcagcggcgtgccggcgacggtggtttgatttgtcgtcccttccctcgccaactagccggcccccggacccggcatcccccccttcccatcccatcccgccccgccccgatgaagatcacggcgctgctggtgctccggtccccgggggacgcctcctcctcctcgtcctcctcggccggagggggcggcgctggggagcagcagcaggcggcggtgctggcgaacgcgtcggacgtgacccgcttcggcttcttccagcggccggccgcgcgcgagttcatcgtcttcgtcgcccgcaccgtcgcgctccgcacccgcgccggcacccgccagaccgtccagcaccaagagtacaaggtgcattgctacaaccagggcggcctctgcgccgtcgccttcaccgacgaccactaccccgtccggagcgccttctccctcctcggcaaggttcttgaggaatacctgaagagtttcggagactcgtggaggacagcggaagacaaggccacccagcattggcaatatctcgacgacgccttg

SEQ ID NO: 102162 - DNA, 556 bp, Triticum aestivum
  Clone ID: PAT_TA_102162
aaattcagggggaggatgttgccaaggctgcatgtgatgaggtcgagggatcgattcatcaaatcagttagtagcacactaccaccaaactatacgctatgtaaccattttcctttagcctattttctgtagctagctagttcgatcagtccattactactgtctaaaaataatatttttttgtttttgcctgccaaaagattaagcatgacctttcctagattagcaaatacggagtaattcactagttatattcccttctaggtagttggatgaactgagttcatttttccttgtactatctatgcccttctgtatgcttggatgaactctttttttctttttgccctaccttcctattttaagtaccaagaaatatcaagaatttctccttggttctgaacgtttgatttcacatagcactacgtgttgttactatccagcacaatattatgtgatgaatattaacaatgaaaataatatgtatgccctttctgtacttggatgaactctgttttgttgtacaacatttaactgaaccacttgtctgaatgtg

SEQ ID NO: 102163 - DNA, 153 bp, Triticum aestivum
  Clone ID: PAT_TA_102163
ggagccgccgcacctctctctcctccggtcgctcttcttcctcattcaccacagccacagacccaggagctccgttttccctgtcgagcagatccatgggctcccgaggggctcatctgctcaagtcgcgaggaagcccgggcaggaggagac

SEQ ID NO: 102164 - DNA, 533 bp, Triticum aestivum
  Clone ID: PAT_TA_102164
cgccctctctccaccgcgcagcgcccgtcgtctctgctctccagcggcgcccggggaagatggagcatctccaggacggccactacgtgcggctgcggagccgcgagcacggcacgtacctgcacgccgacgaggacgggcatggcgtctccctccaacacctccgggcttccatgaacgtggcttgggtggtgcacttgtatgaccagggcaatgccgacgccctggcccagcacatgcttctccacagcgccgcctacggccgctacctcgtcgccacgaacgcgccggcgccgctgggccaccgcgggcgccgcgtcgagcagcgaaactacgatgatcaagaggaggtggccatcaggtgggaggccgtcgccgccggggccgactccgggaacgacgtcctgctccgcaacgtcgccggccgccacctccgcaacggcgcctggcgctacctccgcgccaacggcaggtacatccacaccggcgccagcgtcgacgccttcgacaacttcagcaccaagatgcactgg

SEQ ID NO: 102165 - DNA, 490 bp, Triticum aestivum
  Clone ID: PAT_TA_102165
aacctcaacctcgtcccgtcttctgcttttagctcgcctgcggctgcggtgggagcttttcgctttggtttaggtgcttctttctttcccactccccactttctcccccctccccctctccctccttcattcgtgcgttgtcacgcacaccaaaagctcctgcctttgccttatctcagcaccaccctgctcgtagtgggatttggtgggagctgctctgcgctgctccgctcaacctacttgcctgcctccctcgcctcgcgcgcttctctgctccctctcttcgggccctgcgtcactctcatcccgtcaccgcaccgcacgaacgcacgcacgcgcgcgcggcgctcttctctcctcctcccggcgggctcggtattcggacggtttcttggtctgcggttggattggctgggcgcagttgcttgggcgcggcgagcggcgacggatctttgcggaattccggcgagggaggacgggagatgaactg

SEQ ID NO: 102166 - DNA, 245 bp, Triticum aestivum
  Clone ID: PAT_TA_102166
gcaatggatgatggattaagtgtaaaagagaggatttgctttcttaattccatgatggatcttggaagtgatgttcaagttcgtgctgctggaggtcttcttgctatattagatagcgagaggcttcttgatacccttgaacaaatggaaggaggagcatccattgcaattgattctgtggcacagatctcattatacagatttttgaaacttgatgcagctgctcatgaggcactacatatttt

SEQ ID NO: 102167 - DNA, 442 bp, Triticum aestivum
  Clone ID: PAT_TA_102167
cgaagctgcagcgcttgccgctccaatggatctcaccggccggcgctctcgaagctgcagtgcagcgctcggtgctccaatggagctctggccggcgtctcccattgcgacgctgcagcactctcgtcggcgagctcgaagttgcagagcagcagctcggtgccccaatggagcgctcgccggcggctcctagtgctccaatggagcctcccggcggctcttggaactgcgatgcagcggctgacggcggcttcggtgttgcaaagtgctttgccggcggcagccgtgatgcttttgcagcggcggcctagacgacgatcgaagcaggggtggctgatgcggtgcggggaggaggacatcgagtgtgcgttgactgtttttcaagggctgagataagacagatcggatggctggcgacccggctgatttctccaggaaatca

SEQ ID NO: 102168 - DNA, 477 bp, Triticum aestivum
  Clone ID: PAT_TA_102168
cctcacgcccgccgccagagaccagccgccgcccgccttcaaatcctccaggcccccgagcccccgccgcacgcgctccggccgcgcgcccgagtggaccgccgccgagaccctcgcgctcgtcgccgcggtcgccgccgtggacgacgacggctgggcccgttccgtttccgccttccagaagtgggccatcgtcgcggagaacatcgccttctccgacgccggaggggcgccctcgaggcgcagggggagggcggccggcgagtgcaagcggaggtgggaggcgctcgtggcggagtacggggcggtgcggcgctgggaggggcggaccggggggagttactggcgcatgagcgccgcagccaggaggaaggctgggcttcccgcggagttcgacgccgaggtgtatggcatcatggacgcgctgatccgggtcgatgaggcgctccttggtggcgccgggggaggagagggcga

SEQ ID NO: 102169 - DNA, 521 bp, Triticum aestivum
  Clone ID: PAT_TA_102169
ggtctttcttcacagcaaaacaaagatgatagtatactcacatggacagatgtgatggataaaagcatcaaggcatccacgtcaattgaaaggtcagtaaacagtgacgccgatgaagatccttcacaaagcacatctgatcatggtaacaagcccaactccgaagaaagcaagtacaaggaaatgatatttggagaggatgctttgaaaatccttccttctgcaccatactgtttgggtcgcccgatcaggagaggccattttaatatttctcagaattattcgttacatcaggttttagaagatttgcgcactatttggaactggatgctgacggagaagttgcatatcaacccaaaggacagacatctatattctgcaattcttgttcttggggaaacatttgacaaccgagaaatgaaggagatgctgtccattgtactttgcgatttggggtttagcacggcagtggtacatcaggaagctctagctgcggcatttgggaatggtttgtcgacagc

SEQ ID NO: 102170 - DNA, 505 bp, Triticum aestivum
  Clone ID: PAT_TA_102170
ggtggatgctgcggcggcggaggacgagctgcgctccgggtgcgaggcggatatgcaggcggaggatgcgtgggactccagcgctgctgatctagagagtcgctgtttggattcgtacattgagtggttgagaaaggaggtgagcttgacagaggaggagaactgcaagttatctgcccagattagtgtcattggagagacagtgttcaaagacacgatcccgctggatgctgagattgaatcactggagtcttcactgaacacacttgattcagagggtttgaaacatttggaagcaagtcctatctcaactgattcaggcttcaaccaaatagatattgagaaggactgcgaatatgaggaactgaaactagatcatcaaataggaaaaagtgagatggacttgaagctgctacaaatacaaagtatttcaatgcaaagggatgaagaaatttggcagcttcaatctctggtttcaggaccaaaagtcttagagtttaaagac

SEQ ID NO: 102171 - DNA, 344 bp, Triticum aestivum
  Clone ID: PAT_TA_102171
gctattttttctatgaatttctagatttttgtcgtatttttcatcagctattttttctatgaatttctagatttctattttttctcagttttttctgttttagtattgggcctgttttccttttgatgcccgcaacaggcccatgttggcgtttctggacgtgttcgcgctgggaggtctcccaggccgcacgagatcgttcggtcgttcccccttgccatgccgaacgattcgttcggaatcaggtcgatagaaatctgacgttcgctccttatcggggttctacctacctacaatttccgcgtgctaagatacctctaagagacagactccttcctttttta

SEQ ID NO: 102172 - DNA, 452 bp, Triticum aestivum
  Clone ID: PAT_TA_102172
ctccccgtccgtccccacacacacacgcacgcgtttgacattttccgcccaccaccgccggagggagctccagccatggccgccaagtgctacccgacggtcagcgacgagtacctggccgccgtcgccaaggccaagcgcaagctccgcggcttcatcgccgagaagaactgcgcgccccttatgctccgcctcgcgtggcactcggccgggaccttcgacgtggccaccaagaccggcgggcccttcggcaccatgaagtgccccgcggagctcgcgcacggcgccaacgccggcctcgacatcgccgtcaggctgctcgagcccatcaaggagcagttccccatcctctcctacgccgacttctaccagctcgctggagtcgtcgccgtcgaggtcaccggcgggcccgaggttcccttccacccggggagacaggacaagcccgagcc

SEQ ID NO: 102173 - DNA, 462 bp, Triticum aestivum
  Clone ID: PAT_TA_102173
gctttcttagaagcaattgaaaatttgggatttgattacatagcttcaggacattatgcacatgtagtccatccacacgttgagaatgctaaagagccatcggtgctccaacttttgaaagacgaggatctggcggtgtatttatctgtaaatggagctcatcttttgcaagatgaagttcgcagtctggctgttcagatggaccttcctaaccaagctagaaaggattctcaggggatatgttttcttggaaaggtcaaattcagtgagtttgttcaaagacatgtaggagaaatggagggtatacttcttgaggctgaaactggagattacctagggatgcaccgtgggttttggttctatacgattggtcagcgacaaggtttgcgactttctggaggaccttggaattactattcgctggataagaggaggcgaacatttcgtgttggatcgctgaac

SEQ ID NO: 102174 - DNA, 454 bp, Triticum aestivum
  Clone ID: PAT_TA_102174
agcagcatgtagaagacatggtggtcgagctgccagtggtgcagcaggagatgtcgtcccatgtgcaccaatccgccagcggccatgcgcagattgtggctggaccggcgtcgggcggagttaggttggagagctcaccgccgtcgtcagagttgtccactaggaaaatgactccgcgagcccctgggtggaacaagaggttgaggattggagctgctgccccgagtaggccaccgtgtccaaaccgcatcagcgcgtttgagaaggctgtgcggggttttgctgagaaccctacggagaatgttatcacaccagttactggcacaacatttgactcggtgggagaggcttagacttctacaacttgtactcctatgagaaggggttcggtattcgttatggcaaaagcaggttaaatgtggagagggccaatgcatgcaggaaatagtttgtg

SEQ ID NO: 102175 - DNA, 443 bp, Triticum aestivum
  Clone ID: PAT_TA_102175
gcaccatggagtccagcacaaagactaaagaagagagagaatatgtgaatatcgagtgggcattgttcttctatgagtgtggcatttcattcaatgctgcaagtagtagacaatttgagattgcaattgaagccgcttgtcaatatggttcaggtcacaagcctcctagtgcctatgagctgagagagccattgcttaatgcttgtgtcaaggaaactactactttgaggaagcaacatgaggcagcatggaaacaatttggatgcacactcatgtcggatggctggtcagataaaaggggacgccatttgatcaacttccttgttaacagtccagagggcaccgtcttcttggagtcgattgatgcctcaagtgaatcacacagtgctcaaatgattgctgatctgctggagaagagaattatggaaattgggaaagaaaat

SEQ ID NO: 102176 - DNA, 263 bp, Triticum aestivum
  Clone ID: PAT_TA_102176
cggacgcgtgggcggacgcgtgggtggctgttaaacatctatatgagaccaagctgaaggatgcatctattctcattccattgctatcctcatttccgaaagaagaggagctgcctatatttccgagactaggtgatctcttacctgacaaggtccaagacgcacttgctcggatattgcagggatctgctcatactgggcccgcggtaacccctgctgaaggtctgattgcaattcatgatattaatcccgaaaaggacaaa

SEQ ID NO: 102177 - DNA, 184 bp, Triticum aestivum
  Clone ID: PAT_TA_102177
gcgagcggctgccctttttttttttttttagagatgcaatgcactaaatgtcatagcacgagataaatattacaagcatgcacgcagcacgcgtacaaatgcacattctacacccaccctaacatatatacctatcgcacgctcacgtgtcccacgacgacggctaccatgcacaggacgacga

SEQ ID NO: 102178 - DNA, 507 bp, Triticum aestivum
  Clone ID: PAT_TA_102178
atccgagaagaaagcaaagaaaacaaaacctactctggcttctgcatctggtcctactaaaaagccttctttctctgcgaacaagagaatacatgtgacaccattccctgaatctgagacgccaatgagacctcagaagattatgaaatctgaagagatgaaagataaattgaatggtgatgttcaagaaggcaaagataaagcatcggcctctgataaactgggaggtttctcattgtcaccctttttttggttaagggaaggagaggatgcagaaggcggcactcttgaaacgttaagtgaaccaccatcactggccacgcccttgcgtcacaatgcaccaacctttagtgacatcaaaggttctgatgctggaacccctcctaacacgactccaaatagcaaagctgtggttccagatgcctttgatagtgaaatctttgaatggtcccagaggccttgctctcctgagctgcgttctactccacagaaaaagcagggtaaatt

SEQ ID NO: 102179 - DNA, 458 bp, Triticum aestivum
  Clone ID: PAT_TA_102179
aagttccctgccgtgcctcgccttcgtccccccaccgccgcttccccgaccagctgctactgtagactgcatcccgactcccgtctttgggcctggacggggccggcctctccctcagccccgtcagaagctgctgtccgactgctccaaccatgcaatgccaaggctggatgatgcggccaaccggccggaggaggacttcgtcgtcgtctcagccacgccggagatgcaggcggagtcggcgctgctctccaccaatgcagcggtggcgtggtttgagggagcccgcgaggatgtcccatgccacgccgtcgcagttgcattcgcctccacctttggcttccgtcaggcggccgtgagtgtggtgcggcacttccccgagcagtatctcgtcaggtttatgtaccaaacacaattgtgccgacgcggtcaaccgcggcgacttcctcgtcggcaac

SEQ ID NO: 102180 - DNA, 549 bp, Triticum aestivum
  Clone ID: PAT_TA_102180
ggcatatttaccttggataaagatcatagattttcatacttcaggttagtttttgacgcagatatggatcaataatcctaaaattatggtggatctgtaggtggtttgctatttttaatgcgcagattttagccctggttagtgcactagcacgtgtacaatctgttttcttgcaaagctggacatcgatacgttggcatgaatgttgcctagtccattggaatgtatggtgaagaggacatgtgcgttctaactaaatgcccactgaaataactcttaagattattttcttcaccctccaatctcctttttttctcctttagacccaatgatgctgatgattttgaaatttgaaccgtacaaagactgaaaaataaatggcgatgtaatatatactccctcagttcctaaatataagtccttttagagattccaatatggactacatatggagcaaaataagtgaatctacactctaaaatacgtctatatacatcagtatgtagttcatattgaaatttctaaaatgacttatagtatttaggaacg

SEQ ID NO: 102181 - DNA, 243 bp, Triticum aestivum
  Clone ID: PAT_TA_102181
ggacgaaagactcggtgatatgcagttattcgacaagcagcatgtcattattccggatcatcttcaggtcacagagtcggaaaaatacggactcagttttggcagttttggcaccagttttgaacaagctccgagcttttcaaatgaccatgggagcgagaagagctctatactgcctgaatatgaatcatcacaagatctggaggaagttgcggaagaacctgcctctagtcataagagtgc

SEQ ID NO: 102182 - DNA, 443 bp, Triticum aestivum
  Clone ID: PAT_TA_102182
cagagaacattcagagcacacagtcaagcccaaacatatacggaatcaacaaaggcaatgcaacacctgtattccgaaaaaacaggcagccaatggaagacgttggaaacctagaggtccggaacaatgccactccgacgcaaaaagcgctaaagtttgatattcctggctctggcatcctcgtcgagcataactcgcctaactcggtcaagaattgctgggttgataacgcagctgttggtgacaaccaattcgagaatagcaattctgttcgagagcaggagcctaatctcaccactcacaccctggcttcgaatttgttctatcaaagatacactccggggccgcaaaggggtagggttgagtcaataccaagccaggagtcagacgaatttaatggtgttaccaacagctgttcctcagaccaagacatggtgatgtca

SEQ ID NO: 102183 - DNA, 458 bp, Triticum aestivum
  Clone ID: PAT_TA_102183
tgaagctaatccatccagccccatctcccgcccctcgcacactgtcattccgagctcccaaaccccaaaccctagccccggctccccgctcgatcccgttccgatgggcggatctgctgatcccgaggagccggcgccgacgcccacgccgtccccgtccccggcgaagccgtcgccctcgtcgtccgacgcgaagcgcctgaggcggtgcgtgcagtcgcggctcccgtttgggtcgggtaggccgggcggcggcgcaagggtcgtccctcccgcgcccgcggcggaggaagcggctgggaaggaggccgcggaggagccggagaagggcaagaagaaggcgaggccgcggagatcagcggcaggcaggaagccatcttcaaataaagagacaactgggttggatccaggtagcaaggatgaagttactttggttgatgagagccctcagaaaaagc

SEQ ID NO: 102184 - DNA, 257 bp, Triticum aestivum
  Clone ID: PAT_TA_102184
cttttgcctccctccccccccgccgccgtcccccctgctaaaatgtgatgtccaatccatcagattgcttctagttcagtcccccactcctctcctggttatgggatccggcgagctggatggacgcgcattggagcagcagcagtagcgggggcgaagctgcagacgggggatctggatccgaggcaccaccaccggggtcctcacggaggcgacggcgcaagaggaagaggaggtggaggtggaggtggccgctg

SEQ ID NO: 102185 - DNA, 301 bp, Triticum aestivum
  Clone ID: PAT_TA_102185
gcccgaaggaaatcgcggccctcccaagccgatccgagacaccggagacaatcctcgaccgatcgatcgatctcgaccgcggcggcgatggatttctccggcggggcggggggcgggggcggcgcgacgctgtcggagatgtaccagagcgcgcggcggctgctgctgtcggcccgcgacggcgtggcccgcgtcgagcggctcgcctcggcgcccgcctcctcctcctactccgcctcggcgccgctcgtcggcgcgccggacccggcgggcgccgaggccgtgcgcagggaggtggcgc

SEQ ID NO: 102186 - DNA, 314 bp, Triticum aestivum
  Clone ID: PAT_TA_102186
gtcgtagggtggctcatccatctcatcgagttcgaagattggggatcatttgtatcctttcacttgctgtcatcattgtgttagtacttctggtgttttatctgagacacaaactatcgaggaacagttcattggttattgtgcccgctggtaaggccaaggctactgttgagccaacctcaactgatgagctcctaggaaggaagtcacgggaacctctgagtatcaatctcgcaacttttcagcattcactgttgcgggtcaccattgatgatatactgaaagccacaaagaatttcagtaaagaacacatc

SEQ ID NO: 102187 - DNA, 403 bp, Triticum aestivum
  Clone ID: PAT_TA_102187
ctctggtggaggaggtgagtgagagtgaccaggagaggggatctgccaacaagcagggcggcttgtccggcagatgtgtgagttacagaccgccgtgttgggaaggcagaagagcccgctgcagcagtctaaactatcaactgatcaaaatcgagcagcggaggtcgcaatcaagagtgtgatgcttgttggtgtgcctacggcgagaactacttacccggatctcggcgatgtgccaaagcagcctcggaagccggcgagttgcaaaaattgtggtgtggtggggcaccataggaacaattttacgaaagcgatggagctgagattagctggtggcgtgtaagtggtgagtgaaaaatggcaagcgatttcagtaagtttgaattgtcaatcgcaagcatga

SEQ ID NO: 102188 - DNA, 369 bp, Triticum aestivum
  Clone ID: PAT_TA_102188
cacagcacagagcagacacctccttctccatccccagccccagccccagcccagcatatgagaatactatgatcccttccctcccttccactccatcttggcttcacctcccacacatgcgtacaagagaaaccacgcactgaccccctcccccacccccaatcaccgcctccgcctccgcctccgcttcaatggacggacggagccacccccttgcaatgcactgagcagaccggcattgccgccacctcctcgtgttcttagtcagtgagccacggttgtgtgctccaagaaggggcgggacctagccaggagcggcaatggccgccgggaggaggctgtcggagctgctccaggagcagcaggagc

SEQ ID NO: 102189 - DNA, 297 bp, Triticum aestivum
  Clone ID: PAT_TA_102189
gccatgtggctgaccagatacgtgcttccggaggagtcattcgacgtggtcagaacggacgtgctccccctcgccgccggactggcgcgcggcaggtgctcggtcctcgcacctgccgagggctgccaagtggtacaatatcagagggatgcgagatcctgggcacatccatgcagtgttcatgtccccggatgagttcaaatggaggccgtacggaggcagtagctttgctctgacacaagccaaaggtggctgctgggtgcactgcaatgaattaacaacaagcaagggattgca

SEQ ID NO: 102190 - DNA, 367 bp, Triticum aestivum
  Clone ID: PAT_TA_102190
aagggcatctccgtgtcgtggcatgaggccgacgctccagcggccctgatccgcggcgcgctcgacctcgacgcggcgtcgtgctgagcaccgccacgccgtacatgatcatgcgtcccgacgtgttccgcgtgttcgccaaggcgttcgacgccgccattaccaggtattcatcctttcatcgtgaaccacggcgccatcacaggcaagtaggagtgtcaattaaaacagctaaactaagctcgctgatggatggctgtcagaaatggcgtgcagggggaagaagaatccgacgagcacggtgaagcgggtggtgccggcgccgaagccgttcgagctgtgctacaagggcgggttcccaatgctg

SEQ ID NO: 102191 - DNA, 223 bp, Triticum aestivum
  Clone ID: PAT_TA_102191
catgggtgtcctacggtgagcgctttgagggattctgcagagcagttctccccggaggcctgatgcatccaaccgtacaaggaaacttgaaaactacaccacaactcttaggcttgccaaaatatgaggattatcactcagtcatgagcgaaactggatgtacccggtaaggatggaggcgagatggggccatatagcccccttttgcgcaagagggagtatg

SEQ ID NO: 102192 - DNA, 308 bp, Triticum aestivum
  Clone ID: PAT_TA_102192
ccggtcactagaagcacctcaccattgatgcatgagctctgaagcttttaccctggcctggaactgcttctggctttcatggttttcctgcacagagcttgagggctgatactgtaatggcaagacttcttcacgtgaaactgtcactgatgacttctgaacccattgtgatgttttgggtggcactagcggtgcagatggaaccagcaatgtaatgtttgtagtggtagtaactaagaactggagcagagtgactgaggcgcgggtttcgcgggaaatggatcgatttcaggcattcacaaacacct

SEQ ID NO: 102193 - DNA, 553 bp, Triticum aestivum
  Clone ID: PAT_TA_102193
gaatattcgaatgataatcataaaagggaatgtcgactagtgaattgtctattttgcagcaaagtgcgcaaaggcactataaactacaagtttctgtccatgttgcaatcgagatgagcatatgaaagaagagaaggaagagggacttgagtgtgatgaatattaaagcttcaagggcaagaaagaaagagtggatggatcaacttgtgaagtaggcagagaagtagaagggccgaagtgcaaaaatgcagatctgaggagagggtcaaaatccctagcagcagccccgatcccctttcgggcctggcatcacatctctctccctcacccctccttcttcacctccggccgccgccacggccaggccggcgtggtggtgcgccatccagccaccactccattaccgtccctccaacgccatccatcaccaacgccaacacccaccaccagcatccaccactcaccaccatctccagccaccgccgcatcttgcacgcccgaccagacaagggcggcacgggcgtctggtcatccgcgtgaacgcccccgcgct

SEQ ID NO: 102194 - DNA, 261 bp, Triticum aestivum
  Clone ID: PAT_TA_102194
gacggagatccttctgtcgccgctgatctacgaaagccgctgggtctacaagctcgtatttgtgcccaaccccgccagggacgacttcgtcaccgccgccatctgtgacatcgacaggctagcctacgtcaccgggggggccaggaggtgggccatgctggatcccgtgcggctctccagcggagatcagctaggcgacgtggactaccatgaaaaaggtagggtgtactggctcacccgctatggggatgttcacgtgct

SEQ ID NO: 102195 - DNA, 303 bp, Triticum aestivum
  Clone ID: PAT_TA_102195
atgctttcacctgtgatctgttatgcaggaattgcagactctaatatgaatttgtttaaagtccaatctagtttctattggcacctatgtgctaatagggtgtagtctggtcgggaagaatcatgggcagcctatcttatgatttttaatcttatatataattatctgtgtgtctgtctaaaaatgccacttgtgcacctagaaaaatctaatcttaatgtatgccaactgccatagtcaggaaagtcgattgattccctgattttagggacttatgaggtgattaatccagaactatgtagc

SEQ ID NO: 102196 - DNA, 389 bp, Triticum aestivum
  Clone ID: PAT_TA_102196
gtccgagacccgcgacttcatcccctgcgccagcgagggggattattccagatcctcggggtcgtcggcggcggcggcggcccagccggacgtcgccagctgtaccggctcgtcggaggccgccccgcgcgacgacgcggacgcggacgcggagatccaccacacgcccgactacgcccggagggcccccgcggcccgcctcaggatcgcgccgctcgaactcttctccgcggccccgtcgccgccggcggcgccccgtcctcccgccaaagccgcggacgccgaagacgccgccgacgacggtgccgccgcgccggatgccggtgcgggcggaggggcgcatgagggcgccatgggctgccagatcgcgcgcaccgacaagggcaatg

SEQ ID NO: 102197 - DNA, 273 bp, Triticum aestivum
  Clone ID: PAT_TA_102197
catgtacccttctttatgatttgattgcacatgattgggctgtgcttcctctgattacattcagaattgtttgatgttaatgatgatgatatattgggagcattactttcacctacaataattggctcagtttaatatagtataaccgacagaacatctacaaatccagtcatgattgctttgtactgttaagaacaaagactcattttgactgtgtgtgttttgtgtgtgctatcctgtgttgaatgaattcaataaagttctcataaattc

SEQ ID NO: 102198 - DNA, 366 bp, Triticum aestivum
  Clone ID: PAT_TA_102198
cggacgcgtgggctctccctcgtcaacacagccgcgactccgttctcccttcctcttcaccatggaaaaccacctcccaggcgtcgccagcaggagaggagccggctccgctctcctacgcacccacacaaacatcgtcgccttgggtgaggagttcgtgggaggagaagccgagaaggtcggggagtgggaggaggaggaggagttagttcagcagatcagcagcggcagtgccgggagaggaagggccatggcggcggcggctttcggactacgcgttgagcggtatctctccgtgccgccgggacggcaagcccatggagaagcgcggtcaccccggtacatggccgtcttccatctccatct

SEQ ID NO: 102199 - DNA, 306 bp, Triticum aestivum
  Clone ID: PAT_TA_102199
gcaacacttcatgtatatatataatgtattgtgagccttggatcgagctcatgtgtgaggctaatgtattgtgagccttttactttgaaatgtgtgataatgatgtgacagagttatggattgtggacagcaaatttatgtgacaattctgtaatatggtgcctaattaagtgtagatctgattatttggtttttgaacatgtggagtacccatgatggcctgacaatgcccaaatgatgccaattttttttgtctaatataatactgataattctggtaagttttaaaaaaaaaaaaaaaaaaag

SEQ ID NO: 102200 - DNA, 436 bp, Triticum aestivum
  Clone ID: PAT_TA_102200
cgttgcacaagaattcctcccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctc

SEQ ID NO: 102201 - DNA, 446 bp, Triticum aestivum
  Clone ID: PAT_TA_102201
gaggcgcttcctggtgacaacgtcggcttcaacgtcaagaacgttgctgtgaaggatctgaagcgtggctttgttgcatccaactccaaggatgaccctgccaaggaagcggccaacttcacctcccaggtcatcatcatgaaccaccctggtcagatcggcaacggctacgccccagtgttggactgccacacctcccacattgctgtcaagttcgccgagctggtgaccaagatcgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgc

SEQ ID NO: 102202 - DNA, 414 bp, Triticum aestivum
  Clone ID: PAT_TA_102202
aaattttgtggaagcggagaaaccagcaaggattagaacactctaaagagcacagattaaaagaaaagtattacgtaaaagcgagtttacttcgatgctaattaatgttgcttttgtttacccgcaaaaaaaaatgttgcttttgtttcttctgaagtgacgtatgtttgccgatgtcttaagtgtaataataacattatgcatctttccgtcataatgacagtcatatgtaaagaaaacatatctgaaccttttattttacagttgctattcaggaaaaataattgtgcgtggttgctaagatgttgttttcttaggtgtgctcctgacctatgttgtggcaagcttttagctaatgctttgctgagaaaagattttcgggaaaaggattttgtccaccggaagccttattac

SEQ ID NO: 102203 - DNA, 581 bp, Triticum aestivum
  Clone ID: PAT_TA_102203
gaagccttagatatgaaggtctaaagctcaatgtattcttgcaatgactgcaactgcaacaactcaaaccttgcaggagatagttaatgccttagaaattccatctggtaatcttatccagacatctcaaattagggaaaatctaaagctgtctatcagcatgagtgataacaggctgaaggatttaatgttgctattaaagtctcccccttttgtcaatatgagaagtattatcgtctattgcaaatttcagacagaaacggattatgtttgtaagcacttgtgtgataacaacattaatgccaagagctaccatagtggacttttgatgaaaaagaggagccgggtacaggagctgttctgctctaacaaaataagagtggttgttgcaactgtggcgtttggcatgggtcttgataagagtgatgtcgaaggggtgatccactataggttgccagaaagccttgaagagtacatacaggtaagaacttcatgatgtgatatacacttctccattctactctcttctagaatgtatggacatgctctttcaggaaactggacgtgctggaagggatgga

SEQ ID NO: 102204 - DNA, 534 bp, Triticum aestivum
  Clone ID: PAT_TA_102204
gttctgaaatcaaaattggaggaacaccatactgaggcgtcatcactgctacaggattctggatatcagttgacaaatttaaaagaacagaacaaagagcttacgcagaaacttgctgaacaaactctgaaggcagaagagttcaagaacctgtctatccagttgagagagctaaaagaaaaggctgaagctgggaaaaaggagaaagaggggtcgttgttcgccatacaagattcccttagaattgcatttatcaaagagcaatatgaatcaaaggttcaagagcttaaaagtcaggtgtttgtctctaaaaagtattctgaagagatgttactgaagttacaaagtgctttggacgaggttgaaactgggaggaaaaacgagattgctctggctaaaagaattgaagagctatcaatgaaagtttctgaactggaggtggagatgcaggatttatctgctgataaaagagagttgtctaatgcatatgacagcataatgacggacttggaatgcacaaaactgaacttcgat

SEQ ID NO: 102205 - DNA, 454 bp, Triticum aestivum
  Clone ID: PAT_TA_102205
aatcgaggatggaacaacactgaaaaccttcactcagttgctgcatcgaaacagaaaggttgacttcatcgagcagtttaacgaaaagcttcttgtgaagcaagacaaggaaaacctgcagattattgatgtcagaaactctggtctgattgaggtcaacaaaacggagttcatgaccccttcagcgttcatcttcctgtatgaaaataatctgttcctgacattctgcaatagaacggttgctgcttggaatttccgcggagagctagttacatcattcgatgaccacgagttgtggcatcccaactgcaacaccaataatatatacatcaccgccgaccaggacttgatcatctcatactgtaaagtttcaggaggcggcacaaatgacgctgatgatgaaggccaggaaggttcccggatgggatcgatcaacatgagcaacatcttcacg

SEQ ID NO: 102206 - DNA, 429 bp, Triticum aestivum
  Clone ID: PAT_TA_102206
gattcttcctcacacgacccaccacgagactcctgcagaggcgcgccagccaccgcaatggcgcacccaccgccgcttctctcttctccaccgacctccgtcgcttcgatccaggccgagtatccgcaaagccgctgctctgtcctcaacccagctctgtcgctccgctcgacaccgggcatctctgcagcgacgctccatggcgagattggtcgccgccccctccgtgaaattcacggtcggcggcgtcgatgccgaccaccacgacggggaatgtggaactgcggcggctgggctgacgcctaccctcgcccctctctctcccgcggctcccaccgcaccggagtcagcggcgcgccaggactagtgggccaagcggaggccttttcagcaccaggcccaatgctggtcggggcttcttaagtcatg

SEQ ID NO: 102207 - DNA, 386 bp, Triticum aestivum
  Clone ID: PAT_TA_102207
cgatcacccaagaggaggatgccacttcttctcctcctggcactgctcctcctagccgtcgtggtcctgctcctggtgtcggcggccatcggggtgctcgtcatgcggcggcgccagcaacgctggcagttcgccgaggaggatgaggaaggatgggagatgatagactacagcccacacaggatcagctacaaggacctgcacgacgccaccaatggcttccgcgacgtcatcggcgtcggtggtttcggccgcgtgtaccacggcgggctcccgaggtccggcgtcgaggtcgctgtcaagaaggtgtcccacgggtcgcagcaggggttgcaggagttcctgtcagagatcacgagcatgagccggctgcgccaccgcaacct

SEQ ID NO: 102208 - DNA, 414 bp, Triticum aestivum
  Clone ID: PAT_TA_102208
ggccttaccaagatctgcatgttctctagacaggaaacgaaagtccgccttccgcctaacactaaagctgtcagggatatttgtataactcctgggggccttgctatttttgcatctcttggcaggaaattgtcacttctcagcatgacaaccaacaatgttgtccttcagtatgatctaccggtgattctttgaacttgaagttcacaaatcttgcaagctccaggctggtcctgttcaggggatcaaactggccccaaccatgtatatgctggattacagaatggcatgcttttggtctttgatacccgccaaactaaaggaccactgcactccttgagtggtctatctacaaacccagttcatacaatccactctgtcgtagatgatagcggttccatgaagatcatctct

SEQ ID NO: 102209 - DNA, 214 bp, Triticum aestivum
  Clone ID: PAT_TA_102209
gaaggggccgttctatcgacttctttatattaaaggagtaatgctcctagttccaagagaaatcaacattgttgatttcaaatataattgacatcaagattcttaactagtagtacttctgaacgttatgttcgggtctttttgtgatactttcttctatttcgttcctgaaaaaaaaaaaaaaaaaaaaaaaaaaaaataaaaaaaaaaaagg

SEQ ID NO: 102210 - DNA, 377 bp, Triticum aestivum
  Clone ID: PAT_TA_102210
aaagtataattttccatctcgaaagcgttttgtatgcagaattggttagcattatctctagatacaccgtttactattaagtagataatttacatgttgtcgtggactaaaggtggtgatatatacttatatgcccattcacaactgctattatttaatatgtttccctttgggcatctacaatgctaggagcttacataggcgcttacgaacaaaataataaaatctgaagaacacctaagcgcctcatccctcaacgctagacgctaattaactaaacaacgtagatgctaagtgatggaagaaaaatggccaagcgccgggtgcgtgatttggcgtcgacgccagggttgacgccaggattatagccggcaacc

SEQ ID NO: 102211 - DNA, 452 bp, Triticum aestivum
  Clone ID: PAT_TA_102211
cgccactttctcctaccccggaagaagaaaaaaacacacacagtagagagcctcagcctcccctgagcgcgagagatggcggcgaagggcgatgggccggcgatcggcatcgacctcggcacgacctactcgtgcgtcggcgtgtggcagcacgaccgggtcgagatcatcgccaatgaccagggcaaccgcaccacgccgtcgtacgtcgccttcaccgactcggagcgcctcatcggcgacgccgccaagaaccaggtggccatgaaccccatcaacaccgtcttcgatgccaagcgtctcattggccgtagattcaccgattctactgtccagagtgatattaagctgtggcccttcaaggttgttgctggacctggtgacaagcccatgatcaatgtccagtacaagggtgaggagaagcagtttgcagctgaggagatatcttctat

SEQ ID NO: 102212 - DNA, 443 bp, Triticum aestivum
  Clone ID: PAT_TA_102212
attaatttagagaaatattttcattatgcacagtttaaattcttaatgcaaattttagtttgaaagtaaatagtcgtgtttctcgcaaatcatgtggcaaaaatagctgacattttatgagaatgtttactggattatatgttatttactgggatcttttgaaaatttatgcacataaatttctagatttgtcaatactaccgttttacgtgagaaaatgggccgggtcattcattggaaacatacatacaagctgaatattgaccagattaggcgacgtgactagagaacttatatggacaccatctcatggcactacataatccagtaccagcaacaataatctgagagagagagagagacagagatcttaaaatgttttttttgtaataaactctgctacaaacttataagttctggagggtaaaatagacacgtaaaac

SEQ ID NO: 102213 - DNA, 482 bp, Triticum aestivum
  Clone ID: PAT_TA_102213
cgctgtgttctcccagattagttctagttcattgttgagtatagtctttaaattctatgggcatggcgcacttggatgcataattaatgaactatttcattttattaaatttcttggttcctgctctaaaccatatgtatttattgcatctgctgatattgagatccatctgctataatatatagtttacttgggttcttagttatttgtgtaattcatgaatgattgttaatggtgccaccaactcttttctttgttaccttattctcagcaaaaaaatcctaccaactgtttgtttgttagcgcattctcagaaaaatatcctctgattttcttagtttctgagcaaaattgtttgctgaactgaaacaatatgagcagattgcttccacaaagttaattagtcaagtactagttggttcatctgctataatgtatagtttacttgagttcttagttgctggcgtggttcgtgaatgctt

SEQ ID NO: 102214 - DNA, 307 bp, Triticum aestivum
  Clone ID: PAT_TA_102214
caattaaatattgccaccactgagcaactctgggtgtttctactcttgtcagttattgaccatttgcttgttcttaccttccagtctgcaaaatctgtttggatcatcaggaggtattgatgcataatccaacacttgttccgagggcggctttagccgcccatgtgatgtcattcttgcatctgaatccaccacatattttttttcatttggtctagtttttattgatctggtcggtatcagaggatgaaaccttcaaacaatcttaggacaccttctgacacagtgcttattttcctgtgaatga

SEQ ID NO: 102215 - DNA, 329 bp, Triticum aestivum
  Clone ID: PAT_TA_102215
gatcacaacataaactcacaagctcgttgatcacctctcgcaagagagcaaacaccacacaaggctaacacagcaagcgccatctcggcattcttcttctaatacacaatgacacgcactacgacgagtgttcgagaaaagaaaacgaaaaaggctacaacaaccaccacctcttctgagacctagtacacatatgattagctagcaaaccactactactgacttgcatacggtaatcgagacctagtatacatcgtcgcgacaagaaaagaaaacaatctcactagaacaccactgcaaggacattgtttgatgcctcgacacacatt

SEQ ID NO: 102216 - DNA, 433 bp, Triticum aestivum
  Clone ID: PAT_TA_102216
attaactgttagtacaagacatcaagtgcacggctactagtttgcttactagctcttttctattgggatatgtatatatacgtgtggattttaagcatggttcctgtatatgtgataagtgcataccactacaactcctctttgtctggtattataaggccatttgattgaatgcttgaaaagatgagtcgctaaagtgaatgtgcttctaagtctcatgtagttccagaaacacatgcatttatctgccatgctctgtttttcctgaggataaaattcctctgtaattcttaaaactctcccatagttctacaaacatattgcattgtcagcctcatgtatcatctgtattcttcttttggtcctgtggataaagctcctctgcattgcttaaaagaatgggagtttgtgagggatgttctcatgtattact

SEQ ID NO: 102217 - DNA, 317 bp, Triticum aestivum
  Clone ID: PAT_TA_102217
gagagggatgtgcacaggacttgaacattgtgaagaggaggcaatctgataccttcatctgccttccagaggcaacagaggaagcagtatcctgtaataaggatcaggcaggcagggaaaagcgtgagctccttgtggacaagtatattttggtcaatctgatagttcaagatttgctcttggcaagccagaaatatgcaagtctcaatgcttggatgtcgaaaagcgcaccctgcgcattccaaaccctccaccaagaccttcagtgtctctgccacattctggtccatctaatggatcgactgtaaatccacccc

SEQ ID NO: 102218 - DNA, 241 bp, Triticum aestivum
  Clone ID: PAT_TA_102218
aggagaaacctgtcgtaccaaaccctacccagatcactcacctctcctcccttcctcccgcagcctccctctctctctccccgatccagatcgacgccaccacccctctctaacactaccttcccgtcgccggcggcggcgccctccttccctcgccctctcctcctcccctcctcccctcctgatgggcgtctccaccatgccacgaatccccgcgacccaccccatcttcgtgcctgcc

SEQ ID NO: 102219 - DNA, 430 bp, Triticum aestivum
  Clone ID: PAT_TA_102219
tgtaaatctcatattttaatactccttagaccttagtaatgcataggtgtaatatttgttgatattgcaattttgaaggatctgcttttcttgtatagatcttttttttaatcttgaaggcagtacgagaggccctaatgacatatatacagtactaacaagaatatgggggctttcataacttgaggtagcttccatcttcttgttgtgtatttatttttcttagatgaaaatcttacaccaagaagtggggtctctcaaaaaattatcattgttattctccttttcattgtttgggtttttttctcaatatatgcttctacaaaaaaaagtaggtcggccccatgttgccaccgtggccggtgactcgggtggatccaatcccctcggcctccagggtcactgtgtcctctcttcgttacctccttca

SEQ ID NO: 102220 - DNA, 172 bp, Triticum aestivum
  Clone ID: PAT_TA_102220
cggacgcgtgggccgaaatccctaggccccctcggcccctacctccgccccatcaccttagcgccgcgagcgcgccaggcggacacggcgaacaaggcggcgccgcagcggggtgctcgcagccagcgtgcgacctttctgtagcgagtacaggcggccggtgtacaagcgg

SEQ ID NO: 102221 - DNA, 300 bp, Triticum aestivum
  Clone ID: PAT_TA_102221
tgtcagactgctaaattgttttattattcctacaatataaactatgggatatagggggtaacactgtgcctataaattccttttttccttttcttttttgtccagaattgaacaaaaaagaaattctggaagatgttttcttcccccattaagtccgagccatagagtaagagtgagatgagttttccaaattcatcatagactttccctatggcttgatagaagtaagcagcaaagagtcgtaacttaaagaaaaaaacggacagggccgacagatttacctgatgtaaagaagatcct

SEQ ID NO: 102222 - DNA, 300 bp, Triticum aestivum
  Clone ID: PAT_TA_102222
ctacacatgcctttgtatctctttgacacatatgtcacaccattcccccttcccttatactaggtttacatcattagtggtctctctactccacacacacacactccctctcacacacaaacacccacacaaacacacacagacacgcacaaacacccatctatctggatccttcttttaagacacacacccttgcatattctctccagctctaggtatgtgtatatcccccggccctctctctagctcagatgcacaccaaaattctccatctctctaagtcacacatctctccccatg

SEQ ID NO: 102223 - DNA, 300 bp, Triticum aestivum
  Clone ID: PAT_TA_102223
gtcgcggtcgggattcgcccatgcgctgcgctcgccccgcggaacgtgcaaaagggtcaaagccctagccgccagcagttctcgtcaagcccgtgccccctccgcctcgtctcgtccctgctccctcctttcccacgacgccgccctcgagcccgcgccgcctccacctcgtctcctccccgctccctcctctacgacgccgccgccatcgatgcgccgtaagggacgccgtcgacacgtcggggatacgcagcgacggagagccggagcacagcagaaacccactcctaaccctattcg

SEQ ID NO: 102224 - DNA, 300 bp, Triticum aestivum
  Clone ID: PAT_TA_102224
gatgtagagctacgtacctaaggttggaccgggagcgtgggcgtcctgccatcctgcatgccgttgccgcggtgtccggtgccggtgggcgcggcgctggggcgaacctcgatcctgccgatctgtttggtcaaatgtacagtagtagtagcactagggatggatccatgaaccgagcttgcattggccggttcaccggccgctaacagttggcacgcggtgaaagtttggtatgtgtcggagcctttccaacaggtgtggtctggttactaatggctttgctatatatgggcgtagtgc

SEQ ID NO: 102225 - DNA, 300 bp, Triticum aestivum
  Clone ID: PAT_TA_102225
agacaaacaatagcatacataatcctcaagcataagatgcaaagaaaagatctcggaaaacttcgaaaacaagcgaataactcttgcgaacaaaaaacaattttcaacagtacctaaattatgtggattagatattaacataaattttaggttaagagcttcgatttgcaaaaagaatcgaccaaatcgaagttacgaaactcaagttatgatcaaaagaagttcaaattcaaatctgtttgaaaacaaattttaaactctcaaaatactgtttaagttggttatctggatagagggaat

SEQ ID NO: 102226 - DNA, 300 bp, Triticum aestivum
  Clone ID: PAT_TA_102226
aatacttggacttgatacctcgaaataggtagtaaagggtaaattctcttataagatctcatgaaggtgatattccctataataaatctgctagtcaatgcttggatgaatttgacagttacattattaagcaagaacactttaatgcggatgttatgagacaatagaaacctaatggctacatgattgattgctcgagtgacttgatgtttagaattgacaatgatgttaaaggtctagataaacatgcatctatggtccaaactcagctagaataagtttctaagtctcaaaatgatt

SEQ ID NO: 102227 - DNA, 300 bp, Triticum aestivum
  Clone ID: PAT_TA_102227
cacgaaccatttgcgaggccccctcgcacaaaaaagcccgtttagggttccacccaccgccgcctccctgctccaccgccgccgccccatctcccgctacaccgccgccgccccatctcccgctccgccgccgcccctactgctccaccctatctcctctctctctctcactcctaacgtcctggtttcctgagttccggccgccgtcgatccccagggacgtcgcggatcaccaggacgccaccatcgcatatcaccaccgccgccgccgtcgatcccagggacgctgcagatcctcag

SEQ ID NO: 102228 - DNA, 300 bp, Triticum aestivum
  Clone ID: PAT_TA_102228
gaacctctcgcctccggtttcatttccaaactcgaattctgccttcaagaatcacggtctcaaatccggaaacttcagaggatgggggagaagagggacaagcagctcaaggagctcaaggatcagatggccatgaagcagcccaagggccctcgccgcgacgaaggcaagaagcccttctgggagaatgacacgttcaagttcgtcgccggcatgtcaatgctggtcgtgatggtcctcgcaaagcgctgagaacagcgtcatcttgtgtagagaagttaagttaggtgagcagctagc

SEQ ID NO: 102229 - DNA, 300 bp, Triticum aestivum
  Clone ID: PAT_TA_102229
gtccaaaaatatataaaggtatataagccaaaatgtcaaaacagaagatatataggatgggcaatcaaaaattatagatacgttggagacgtatcattcatccagcggcaacggcctcactccacggggtctgttcatccaatgccaccgggaatggcatccaaaccccccaacaacgcctcactgtcatccagaggcagcatcgattgcttaattagcagcagtagcgaaggaatcgtcgatcggttcagtaacagccaagggttcgatcgatcgtcgggttcagtaatgcgttacctg

SEQ ID NO: 102230 - DNA, 300 bp, Triticum aestivum
  Clone ID: PAT_TA_102230
cggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaacggcaccattgacttcccagagttcctcaacctgatggcccgcaagatgaaggacactgactcagaggaggagctcaaggaggccttcagggtgtttgacaaggaccaaaacggcttcatct

SEQ ID NO: 102231 - DNA, 300 bp, Triticum aestivum
  unsure (1)..(300): unsure at all n locations
  Clone ID: PAT_TA_102231
ctcttttgtgtagaaaaataaaaagcagggcaatctttcaaacttgcatccgaaatgtgaaatatttatacaaagagggagagatgaagacaatgcagcagggttggttatctaattggctagtcaaacatgaggtggttcatagatctttgggctttgatcaccgaggaatagagactttacaaataaaagcaggggattgggattccattgctgtcattttatatgtatatgggtacaattatttacgctcccaatgtgcttatgatgtancacccggtggatctttagctagcgtgt

SEQ ID NO: 102232 - DNA, 300 bp, Triticum aestivum
  Clone ID: PAT_TA_102232
ccgctcacaacctcaaccccatcagcattcaatagtcaattttcgattcctggccgtaaagatgagaaggactcgtaatctgttgctcctacgaaacggcggccgaccatctcccttgcggcccacgagtgcttggcgtaggaagaccgtggaccacgcccctccttcttctactctcttcaaggagggcgtggtgccagccgcggcggtgctgagcactactcggctgaccgcggcccccgccgacgcagcgcttgaacatcaacaacgcgagtacgccgtcgagctagcgcgtaccac

SEQ ID NO: 102233 - DNA, 300 bp, Triticum aestivum
  Clone ID: PAT_TA_102233
acccagaagccacccaccacccacccatccctgagtttgatcggagccggaggagagcatccacaccgaggaagaaggagaagcggcgaggcgaggcgaaagatggggaagatgccggtgcggatgaaggcggtggtgtacgcgctgtcgccgttccagcagcaggtgatgccgggcctgtggaaggacatcaccaccaagatccaccacaaggtctccgagaactggatctccgccacgctcctcatcacccccgtcgtcggcacctaccagtatgcgatgtggtacaaggagcaggag

SEQ ID NO: 102234 - DNA, 300 bp, Triticum aestivum
  Clone ID: PAT_TA_102234
aggatagagaaggacagcagctcctactacctggacatggccttctcccccaaatccagctccttcacgctggacgtccacggggaggccctccagctgctgcagcaggacttgctgcaccgggatcacgcgctggccgtcagcgccttgagcatcagcaagtacgcaggggagagcgaggtgaacgtcaagctcctgtcgtcggtgcggagcctctcgctgagccgatgcgtcgtcacggacaggctgctgggggtgttcttccagaacctgcagtccctggagaaactgcagatatct

SEQ ID NO: 102235 - DNA, 300 bp, Triticum aestivum
  unsure (1)..(300): unsure at all n locations
  Clone ID: PAT_TA_102235
ccggaagggagaagccgggaggaccgagggtggaaaggagtntggtgaatgngcgctgctttgtaggattaagccaaggnagtggaggcccgcccttgacaccatctttcgaggcttaaaatcgaanatgattnatggcacccgtctgtagggtagaataggaaatccaattcattcattcgttttgttattttttggtgagtattgatcatccttntttttcaagcaagganagaaggtattcggttgacgtgtacatttgncttggaaaccttcaacttattttggagtagaaggttg

SEQ ID NO: 102236 - DNA, 300 bp, Triticum aestivum
  Clone ID: PAT_TA_102236
atattctccgcgccgcagccagctggttttggcgccgacgacgcggaggagcagaacacgcgtgcaactgcgaggagccgtttgagcggcgagcagctacggcagggccccgaccatgggctactccaccacgtgctcggctacagctcggtgagctcggttctccggagccgtcggtacgacgacgaggacagcagagcaaacatttgccttccgcttctcctggcgcgtaaagatgcaattgaactgtggatatttacaaccattcttcatttttttgttattgtgtaagagatctga

SEQ ID NO: 102237 - DNA, 300 bp, Triticum aestivum
  unsure (1)..(300): unsure at all n locations
  Clone ID: PAT_TA_102237
tgttatggtaagttaacacggttcgttattaaaccatggatttgatttaccaaatccataattattgtatactctttgatagatatagcgcaacccaaattaattcctaatccttattttaaaagttcttaatagttctcttttcttattttgaatgcaaatacctaactaaatactaataaaattctttgttgacagcaatctatgcttcacagtagtatatattttgtatatcgaagtcctagataggagagtagagtaggcacagatcctccacaaaaggctnaaaaaaagaanaaa

SEQ ID NO: 102238 - DNA, 300 bp, Triticum aestivum
  Clone ID: PAT_TA_102238
caagagaaatgttgggagcaatatgattcaagcggtaaagctgaaaaaacggctgataaatggtgcagcttggatccaaacactccgttggatgttgggcatgctcatgtttggcatgaaaggtggggtgagacgtatgatggcagcggaggcagcgtgaaatacacggacaaatgggccgagcggtcagagggcgacgggtggtcgaaatggggtgacaagtgggatgagcatttcgaccctaacggccacggcgtgaagcagggggagacatggtgggaaggtaaatacggggaccgg

SEQ ID NO: 102239 - DNA, 300 bp, Triticum aestivum
  Clone ID: PAT_TA_102239
tcatgggacccatctgttcattgttttttctcctctttttttctctcctttttttctgatgatggagcaagtgaagatcttcacatgcccttgcctgcgtactggtggttgtactctcgatcgaccctcgtgtttagtcctagtgggattttttaggggctgtggaggtgtaagtagctcttcagatgtgtaggtggtgaggtcaacttggaatcaaatgggttggaaaaaaattgaagaggatctactcgcacggtttggcctggcgcttacgtttggccctagcaaggaagagaaaag

SEQ ID NO: 102240 - DNA, 300 bp, Triticum aestivum
  Clone ID: PAT_TA_102240
caaataacagatgttggacgccttatggcagagctccctcttgacccttcgctttcaaggacattgattgaagctaatgaactgggatgtctgtctcaggcattaactgttgctgcagtcttgtctgctgaaatcacactgcggcaaactagaagcaaggagatggaaggaaagagaaaacggcaacagctccctgatggttctggctggggtgaccatgtacaattgcttcaaatatttgaaagctgggatcaagcagactatgatccaagatggtgctcagatcatgatctacaggta

SEQ ID NO: 102241 - DNA, 300 bp, Triticum aestivum
  Clone ID: PAT_TA_102241
cattaaggaaccttttgatacaaatgaacttcttgatttcttgcctaggagttaaattattgctaaaaagaaagaaactcctaaggattataagtgctctattgaagaattgagtgccaaagatggcaccacttagatctatcctcgcttttatgcctagcttggggcgttaaacaatagcgcttgctgggacgcaacccaattttatctttgtttttttgtttttgcttctgtttagtaataagtttttcatctatcttctatttagatgtgtttttatgctttaatttgtgtttgtgc

SEQ ID NO: 102242 - DNA, 300 bp, Triticum aestivum
  Clone ID: PAT_TA_102242
tgtgtgctcatattgtattttctcgatgctccatttgagccaataaaactcaccctttatcgaaaaaaggtccgttcaatttggaaactaagtgccgaatcaacacacagccattacagcaacaaagcctttggtcccaaacaagttggggtaggctagagctgcctcgcccacaattgcatgcaattaattaggtgggcagtcaatcacatcatagtcgacgccactgcgtccgaggacaatcggtcacacaccaccactctttagatatcgtttcatcccgtagaaacgcacgggtat

SEQ ID NO: 102243 - DNA, 300 bp, Triticum aestivum
  Clone ID: PAT_TA_102243
ctgttcaagcggtcggtgacgttcgtggagcgcaacgagtcggacttcacggcgcgggtggccgagtggggccgtctccacgagttcgccgacatgatatggcagccgcagcacaacaaggtcatctatcgccaggacgaccgcgtcgacgtctcgacgccgggcaatggcctcggcgagttgttccttttccgctccgtccccaccgccctgctcgtgggcggaagggccatagaggagcaactgcaggagaacggcaccgatatcgcccggtgcgcggccgagcaagaggggttcacg

SEQ ID NO: 102244 - DNA, 300 bp, Triticum aestivum
  Clone ID: PAT_TA_102244
atctgggatagtagtcattagtgaaaaaacaatagttatacaaacgagtgaagtgaacccatctccaatagtccaataattcttatctttagaccattctgagccatttacgaacattacagcgaatatgatcaagacatttatggctcccacataaataagaagttgtgcgacagctacaaagtaggaatttaataaaaaatagaataaggatatacaaacaagaactaatcccagcgaaaaggcagaataaatggggttggtaagtaatactactcctagaccccctagtagaagaac

SEQ ID NO: 102245 - DNA, 300 bp, Triticum aestivum
  unsure (1)..(300): unsure at all n locations
  Clone ID: PAT_TA_102245
tcgccctctgctccgagttcatgaacggtggaacagataccacggtgaccttgctggagtggatcgtggccgagctcgtgcaacaccccgacgtccagaccaaggtctacgaggaggtgaaagctaatccagagctcaacaacatgcaggcaatgccgtacctgaaggccgtcgtgctcgagggccttcggntgcacccgccaggccacttnntcctcccgcacggcgtgcagagcggcgacgcggagatcgcggcctacgcggtgcccaagggagcggaggtcaacttcctggtagcgg

SEQ ID NO: 102246 - DNA, 300 bp, Triticum aestivum
  Clone ID: PAT_TA_102246
tcccagacacaaaacagcacaacaacttctcagacacacagtgctacttcaggcaattcacatttccaaagttcgtaatcagggaaccctgcaatttatgagggcaaggcctttatatgtttgaaaagtgctatcagtaagtgatgttgtatatgtagaaactagtaaactcagctttttatgtcgtcctatgtaccaatttaaacactgtaggctcacagcagaattgagtagccaaaataaaaacgagatttctgttgcatgctatcttgcggaatcgaaactactttactatttaga

SEQ ID NO: 102247 - DNA, 300 bp, Triticum aestivum
  Clone ID: PAT_TA_102247
attaacgcaggtggtgttattttgctcgagtccccaggagtgcttaacggaaagcactgtttgaccagtccttgccatgcccttctccctcctcctcctcctcctcatcttcttcctcctgtactccaccccctctctctttgttgctgctttaacttttttggatcacgaaacttccatggtttttctcccccttttgcttcctcatctcatgtgctgctgtgagaggcaggcaggaaggaggcagctatggtggcggtggcggcagatctgcaatacctggctgcaagtggaaagctg

SEQ ID NO: 102248 - DNA, 300 bp, Triticum aestivum
  Clone ID: PAT_TA_102248
atgtaccctgagatggacgagggagtgaacaccgcctcccagaccctcatcatgggcgttgccccctccaagggcaccccgtcgttcgaggccgccgccgagaacggagggtgcaagtgcggccccaactgcacctgcaacccgtgcacctgcaagtgatccatgaggcctcaatcaaatcagatcaaggagatggcatggatggacctgatgaaggagcgagtagtagttatgcatgaatcgcaagcgtgtgtttcgttttaaattgccacccagaataagacgagatctatcgtatcg

SEQ ID NO: 102249 - DNA, 300 bp, Triticum aestivum
  Clone ID: PAT_TA_102249
accactgttgtgggttgccatccccatgaggttgctgttgttccgacgcgtctactcgtcaaggtcgttgccgggtagttgtggctgctgggaattgttgatgccagtggtaaaccatgaagacaccatacatgagagtcgtggggtagcagtatcaccatcttcactacacgaatatctcatatgttaacttctagcaccgtgctttgagaccttgtatggcttataccttacttcgcatggtggattgtcttggaattctagatttacactttcgctctgtatggcttaactaatttc

SEQ ID NO: 102250 - DNA, 300 bp, Triticum aestivum
  Clone ID: PAT_TA_102250
cctcgcttgcgcttgcctctttagcactaaagaggaaactggtgcactgcgcccgctggcgcccacctggccttggtcgtcacgtctcacgtcatgtgaacctcgcgaggtgccccctgcatagatatctcagctcctcgggagccggcctagcgaggccgcccccagggaggtcttggtattgtctgcctcgcgaggcttggcccctcacgagggtcttggtttgtcgctgctgaagctgggccgtaccaggccgttggtggagccacgcttcgggccgcaggcaggcaagtctgggca

SEQ ID NO: 102251 - DNA, 300 bp, Triticum aestivum
  Clone ID: PAT_TA_102251
tcatagtcaggtatctgtctttaaatcttgtggttgatacagttacatgaccggtacatagatgctactcatcgttacacttgctgccttcatatgctgtcatgtgttccatttgggcactacattgagatgaaatatattttctccacttgctttgttttgttttgtgttttatatattacatttctatgttgcttatgtcgtaatgtttcatctatctttctcatgctttctttctggttacaaaatcctctatttatatcaatcactaatggtagcttcattctattgaacagcacc

SEQ ID NO: 102252 - DNA, 300 bp, Triticum aestivum
  Clone ID: PAT_TA_102252
agggcaggatgctacggccagcggctgccgccgtttatccgtcatcctaccacgccccaccgccgcgattcccagcatttccgtccggacgacgctcggccgccatagccgtccggtgcgtgaaccgcgacgcgcccgatacctcgaaggcgaagctgaaggtcggctcgccgatcgtcatcaccgaggaaccgccatgctcaagaccgccgcgtcggtgccgtcgctccggcagaacgccggccgcgtcaagcccggcgacgccgggaggataatggcgcagaagccgaaggacgtctg

SEQ ID NO: 102253 - DNA, 300 bp, Triticum aestivum
  Clone ID: PAT_TA_102253
ttgcgaagaatttccccaaactgctgcttgccgtggtgatgggcttgctaggccgccggctggaaccacgtgcgtggtgatgtgcgccaccacagcctataggaggggccatgctagcgcgtgcacgccagccgttggccgcctgtgtcgccgggctgcgagccgcgacatggtggtgctctgcctaagggaggagccgtgcgttggctaccgctgtcgagaagtgggcgccccacttggcctctgccgccgtagacctccatgccgagggaggccgcaggtgcgagcgcaaccatgcaa

SEQ ID NO: 102254 - DNA, 300 bp, Triticum aestivum
  unsure (1)..(300): unsure at all n locations
  Clone ID: PAT_TA_102254
agagcaatacaagcgttgtgctgctaggcgaagcggttgagtgccgcaccctaaatggctanagtccagtagccgaaagcatcactagcttacgctctgacccgagtagcatggagcacgtggaatcccgtgtgcctgttgaagaatgagccggcgactcataggcagtggcttggttaagggaacggaacccaccggagccgtagcgaaagcgagtcttaatagggcgattgtcactgcttatggacccgaacctgggtgatctatccatgaccaggatgaagcttggatgaaactaag

SEQ ID NO: 102255 - DNA, 300 bp, Triticum aestivum
  unsure (1)..(300): unsure at all n locations
  Clone ID: PAT_TA_102255
gagcgggtcgcttcgcgcatcgccgggcagtcgcgccgctcaacttcaccccgcaagaggactgatcgctcgccggattctcaaggcacgtcgctcctttgtatctcataaatctctttgctgngtttattcggagactctgtccgtagaagaaatcatgacaatggagtctgaataatggctgggatactctggtcgctgcttgactcatcttgcggctgtatccagtaattggatgttgttacttctgaagctcttcccctttccaaatacttacagcggctcgcagtatgaggaaag

SEQ ID NO: 102256 - DNA, 300 bp, Triticum aestivum
  unsure (1)..(300): unsure at all n locations
  Clone ID: PAT_TA_102256
gacgacttacaggcttgcatgccgcgatctttgaagagagggtgcctcggaacgcgacacagtggtgcatggctgcgcagtcgtgcgaaggtgtgggtaagttcgacgagcgcaccctcgtgttagttgcactatgagttggacctcgagtcggctcagctgaggagagcgaggaggacaccgcaggctactgaggggacactgcgcgncggcgcgcgcttcgcatgacagactgagtcggacgaccgcgcgacgcaagcacacacacaccacgacacatgagatgacggacgagatcgg

SEQ ID NO: 102257 - DNA, 300 bp, Triticum aestivum
  unsure (1)..(300): unsure at all n locations
  Clone ID: PAT_TA_102257
ggacgaagcccattgtgtccgagctctcaacaaggacttcgactcgtatgtctatctgagtcagcctggtcatctattctcagaagattgtgatcaagacctgtgggactaccatgctcctgctaccattcctaggattcttgagcttgctgaagagctgtgcatgccgcttgctgccgcaagtactcgtgggatggtcatcttcccgcgcacagctgnncccacaggagcttctctgaggagggtgatgcctgaaccgtacttcggcactgaagctggngcaatgcttatggatcggag

SEQ ID NO: 102258 - DNA, 300 bp, Triticum aestivum
  unsure (1)..(300): unsure at all n locations
  Clone ID: PAT_TA_102258
agtcgtgcgatcgacactcgatggctgatcggagacggtgtctgaagcattgttcgacacgccgagacattgcttatcgagtaaccacatgatattgtttccagcgatgttttctgccaaaccatacaaatttataagcttgctcactactatatgcaaaggcgcttctttgtcagatccgnggcacacatcgcatcaacgcggcggcgtctggaagngcaaggcggcgggttgcgcttgccatgtgtgtgacgatcactgacgacggcgctaagagtggcaagaactacatgtcgagac

SEQ ID NO: 102259 - DNA, 300 bp, Triticum aestivum
  unsure (1)..(300): unsure at all n locations
  Clone ID: PAT_TA_102259
acaaaaagcatggtctaggatttgctagctaacttagtcacatcagaaattcattctaatntaaattttgtgnantaaaggtgaaatatagccacangagtacatgtgaactggtaattcttcagtactagtatgtaccatttctaaaatgtattctctacacanttatattgaccaaaagtgggttgggattccttcatggtgtaagtggtgcaaggcacatctgatttagcaancaatatgatgggaggtctaggaaggtggcaccttcctgaacaaactactttggtcgttatagag

SEQ ID NO: 102260 - DNA, 300 bp, Triticum aestivum
  unsure (1)..(300): unsure at all n locations
  Clone ID: PAT_TA_102260
gagctcgtgcgatcggccgagatttttcaatttggtaaggagggatcaaaatgagtcacttatttgtggtagcttggaggatagaaatatgactattgtttcaattagctgttttgcattaattgcgacttctcagtcttagaattagtgaccccttgattngcttctctgatggtggcaaataataaaatgtgantttctggacatcattatggattgnctagtcttctcgactatctgaatctctattcctaaataaattggtaatanttantaaccccataaaaagaataataaagg

SEQ ID NO: 102261 - DNA, 300 bp, Triticum aestivum
  Clone ID: PAT_TA_102261
gagttggcacgtccaggtacaatagccaagactcaaatacaaaaacctagagatgatgtactgcaaccatcacttggtcaaattatcgcacaagaaatgaaggattccttggtagatgcagttcaagtggaccagaggtccgtgtcctcaagtaccaataattccaaagaggtaaacattgtgccagcagagatgcagcattcagaaaaaagagaagagtcacatagggaacaagagattgacaacaccgagaaagatagtttaccagataagataacagcagataatgagaaaccttct

SEQ ID NO: 102262 - DNA, 300 bp, Triticum aestivum
  unsure (1)..(300): unsure at all n locations
  Clone ID: PAT_TA_102262
acgagctcgtgccgaatcggcacgaggcgtaccgatctgggcactgtctcggagagaggctcggcgacatagacatgtctgtgaagatgcggactacctgcacctggacagaaagaccctatgaagctttactgtttcctgcgattggctttggtcctttcctgcgcagcttaggtggacaggcgaagaaggcccnctttccgtgggggcccgagccatcagtgagataccactctggaagagctcggatcctaaccctgcgtcagacccgcggcccacggnacagtctcaggtagacag

SEQ ID NO: 102263 - DNA, 300 bp, Triticum aestivum
  Clone ID: PAT_TA_102263
tgccgctcgtgccgaattcggcacgagggctcccagatcttcagcgagggcggcctcgactacctcggtaaccctagcttggtccacgctcagagcatccttgccatcgtcaccggtaagggtccgcttgagaacctcgctgaccacctcgccgaccccgtcaacaacaacgcgtgggccttcgccaccaactttgtgcccggcaagtaaacacatgagaatcgacttctcaggagtatatgtgtgctctggatgtatgattaatatctgatcgttgatgttgtacactatcaaagatgt

SEQ ID NO: 102264 - DNA, 300 bp, Triticum aestivum
  Clone ID: PAT_TA_102264
ggcacgagctcgtgccgaattcggcacgagttcggcacgaggagactggccacgttagctcagtctcgcacaatactatttggattgtatgatgttcatagtattcttctaaagattctatttcttaggaaattttctaataaacaccccctgggtcagatgaatggtgttgccaaaattcctttggacggagggagcacttttctgtgttagaattccgtagtgatttcagaataagtagaaggagttaagtgtgagaaagcaaaagataacagcgtaagaatcacactttcgaaccgt

SEQ ID NO: 102265 - DNA, 300 bp, Triticum aestivum
  unsure (1)..(300): unsure at all n locations
  Clone ID: PAT_TA_102265
tattatttgtgccgcctgaagatccctccctttttgccaacaacatcaaggccaccagatccctncgcaaatggttcagtcgngtcaagacttcccagactcaggttattagtgcgggaacattatcatgaattcaggaggtatggccaggaggccattcaacggcaccagaggtataatctccattcttgcagaaccttgaggcgtaggtttgtgtcccatggccctatgattcttccaaggccatatgaagaaactgcagacatagtaatncgatggcccgcatgaatgaatttatca

SEQ ID NO: 102266 - DNA, 300 bp, Triticum aestivum
  unsure (1)..(300): unsure at all n locations
  Clone ID: PAT_TA_102266
agctcgtgccgaattcggcacgagcgacacggcgaccgctcaacgccccgccgcaccggncccgccgctgcgagccgacgcggcctcttctcgcctggctacatgcggctgctgagctgctagcctgctgcgcgtatgcgcctcctcggcgaggccgcgcgggggatcccctcctgtggcgtcgctcgcggtagagccgccgctagcggccgggtgaccgaccaagtctcctcaagttgactgcgaggccggatggacgctgccggtctctccgcttttcgggtgctccacgtttcgacg

SEQ ID NO: 102267 - DNA, 300 bp, Triticum aestivum
  unsure (1)..(300): unsure at all n locations
  Clone ID: PAT_TA_102267
acggatatagcttagaagaataaacagtctttcgtaacttgatactgaacacgaacagatcgttaccgttgtgaaaaagagaaaaactcttctaccccataccaataaaaagcggttangaaaaattgataaagagaagaacaatggagtcatgataaacccctctacttcttgattttttacaantttggtaaggagggatcaaatatgtagcaacttatttgtgtagttggaggatagaaatatgactaattgtttcaattagctgtttgattaaatgcacttctagctagaatagag

SEQ ID NO: 102268 - DNA, 300 bp, Triticum aestivum
  unsure (1)..(300): unsure at all n locations
  Clone ID: PAT_TA_102268
ctcgtgcgattcgcacgagcggcacgagctctggttttctgttttctttttctctncatgacgatccttctgtgcatgattgagatgccgtaccctggtacagtactgttgtgggtgcagttgtggggcaaagnttgggttgcctttgcatgtctagntgctttcggagntaacgtgggtacttttagaaacacgggcaaacacatattcacacacgcacacacaaacatgcacgctcacccctatgaatgcagacacgcacatcaatacccctatgaacatcttgggagaccaaaccga

SEQ ID NO: 102269 - DNA, 300 bp, Triticum aestivum
  unsure (1)..(300): unsure at all n locations
  Clone ID: PAT_TA_102269
tcgacctgcagcaggagacacgagatcaccccggcactgntggtcacatgaaggtcgncaaaaatgcacgagagaggtttggacggacgctgatcactacccactatgacgccgccgatcactagcacgaaggacaccagcaggttgaggatgaagtacatgacgcagacaatgaggacgaccgaaacatggaatccgtacacatagcaccaactgcaaattcaaaatttctgtctgatgatttgattgctacttcttaaagaaagngtacataacagttagatgtttctgcaagaaagg

SEQ ID NO: 102270 - DNA, 300 bp, Triticum aestivum
  Clone ID: PAT_TA_102270
aatggggtggttgaatatgcccagcaagggagaaattgggaaacactttgcttgagctgtctcagaagctcttggactcaaaccaagccacctagcagatatagagtgcaaccaagcacaggtcttactgtgccactattaccctcctgccccagccagaactcgccatagggacaaagccgcattcagatggtgcttcctaactatacttctccaagacgaaatcggcggcctccagatcttcaaggaggagcggtgggtagacgcactcctactccggagcattcatcgtgaacattg

SEQ ID NO: 102271 - DNA, 300 bp, Triticum aestivum
  Clone ID: PAT_TA_102271
aagaagagaaggtataaataaaaaagaaacgaaataaaaagagaaaaaaataagttatgaaatgcagttattgatagacagaaaaatcatggtatgcatttccgtgtattagctaaagcattgcgtatgtctgggggagatcatatccactccggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggta

SEQ ID NO: 102272 - DNA, 300 bp, Triticum aestivum
  unsure (1)..(300): unsure at all n locations
  Clone ID: PAT_TA_102272
gcacgagctcgtgccgaattcgncacgagcgacgagaagaggaacacggacaagtggaagggctcttgcgtacgatatctccgacgatcagcaggacatcaccagagtgatggtcatcgtggactcggtcttncaggcgcccacggccgacgtgacccacgaggcccgtctcagctcctacgagtacgtcangtcaggggactcacgaagtacgacttccacaacaccatggcgaggcttctacatcgctcctgctttcatggacaagcttgttgccatctctccaagaacttcatgacn

SEQ ID NO: 102273 - DNA, 300 bp, Triticum aestivum
  unsure (1)..(300): unsure at all n locations
  Clone ID: PAT_TA_102273
cacgaggaaagagaggggtgccctcgggaacgcggacacaggtggtgcatggctgtcgtcagctcactcaccacgggccacatataaagngccattgcggttttgtcaactctgacattgctttgggctttccttttccatttatctttcttgcttgntcctaagataagaatatgtgtatgtccatgttccccgacatgactcgagaaagcatgctcgtatgtgaatgctacgcgatggctatgtatatgcacatgcacataatattataagtacaatctgtcgactatgtatttgngt

SEQ ID NO: 102274 - DNA, 300 bp, Triticum aestivum
  unsure (1)..(300): unsure at all n locations
  Clone ID: PAT_TA_102274
agccgccatgggaggagggcttgagcgcccgcgccgcggcttcaccaaccggagccagaccttcgtgcaccgctctccgcatctcaggcgcggtcgttcgtgtcctcggcgctgacgtagaccatgctgctggactgggggtcgccggacggaaagctgtactgnggcgtgcagggcgcggagctgcgcaggtcacgtcttttggtgtcaagaagcagcaacagcctgcaaggcggcaggaggacatgtactcgtcgtggtttgaacgacggcggtagcgacatgctggcggcgcgtagg

SEQ ID NO: 102275 - DNA, 300 bp, Triticum aestivum
  unsure (1)..(300): unsure at all n locations
  Clone ID: PAT_TA_102275
ctcgtgcccaattcgcacgaggatcgcaaggagcatcacacccacttagttgaggatttctataggtcttagtctccttgngnttcaggttttctctcattgatgcgacaggcaccgtacgattcgctcgcctcgtccgattccatcacgcggtcaagattcatcaaggcgctccactctgtgagaaaaagaaagggaagaaagggcggccaggacaggattcgaaccctcgacctcctacagatcactccatgtaatgcaaggattggaggcaatttgtgctttcaggcaacagagcgg

SEQ ID NO: 102276 - DNA, 300 bp, Triticum aestivum
  Clone ID: PAT_TA_102276
ctgagaatcgacgagctcggcgatcgacgaaactgaagagcgcacgcgagaggagctcagatcactcgcatgggcgcacagggcgcttccgcgggtctcttcgcgcgttgagcggggaagaataagcgtagcctcgatcgagcggttgcagcaatgcccacggagaaggcggaaaagcgtgaccagttgtgacagacgggcacgcgcggtcagccattaacccaagaatggctgagctgggccgtcgcgcgacgacggctttattggccgcacctcgcggctctcggggcgcgctctcgt

SEQ ID NO: 102277 - DNA, 300 bp, Triticum aestivum
  unsure (1)..(300): unsure at all n locations
  Clone ID: PAT_TA_102277
ctcgtgccgaattcggcacgagacggtatctgaggaataagcatcggctaactctgtgccagcagccgcggtaagacagaggatgcaagcgttatccgcgcctgaaagacgtacgcgcagtgcacctcccggttgntccttcattcttttgcgagaccgtgtaaatacgcccgacgacgacccaccgcgaaatacgtacttactacgtactcctactctattagctagtcgcagatcacacgaacattatcggtgtgccattattttgctgtacatatataatgnatcggaactgtcgga

SEQ ID NO: 102278 - DNA, 300 bp, Triticum aestivum
  Clone ID: PAT_TA_102278
cttaccagggcttgacatgcccgcgaatcctcttgaaagagaggggtgccctcgggaacgcggacacaggtggtgcatggctgtccgtcagctcgtgccgtaaggtgttgggttaagtctcgcaacgagcgcaaccctcgtgtttagttgccactatgagtttggaaccctaaacagctcactcaccacgggccacatataaagtgccattgcggttttgtcaactctgacattgctttgggttttccttctccatttatctttcttgtttgtcctaagaatatgtgtatgtccatgtca

SEQ ID NO: 102279 - DNA, 300 bp, Triticum aestivum
  Clone ID: PAT_TA_102279
cacgagctgcctgcaaagttgagatcatcatcgatacattcaggaagaacacagagctactcttgcacattcaggaagaagaacacagagctactcttgcacagtgctagctacagaacttgagcttgctactccaagttcagaaactgagggcacacagagcttgagcttgttactccaagctttgaaatgtgctactccatccttgaactctcaagtgtcaactgaacctctaccgaatcgtgtacacattgcaccacaaagtagttactacaaacctatctgcctttcttttgtaaa

SEQ ID NO: 102280 - DNA, 300 bp, Triticum aestivum
  Clone ID: PAT_TA_102280
aggaaaatggaagaattcttcttattgcataataaaataaaataaagaaaccttagaattccgtttgcataagatacgctacaccatactatcgaaatcaaaaatagggtatgagacaattaataaaataactttgaaaacacgaaatagttgataacataagttgttgttcagaaataggaaagtggaatgaaatccagtcttagtcaaatatttcatatctcttcgtgtccaagcagaaggaaaaggatacaatttgagctgagcggaaaatccatatctctcttatccatttaaagc

SEQ ID NO: 102281 - DNA, 300 bp, Triticum aestivum
  Clone ID: PAT_TA_102281
gagaattcggcacgaggttgccaggtcgaagacaggacatgtttgatctcggagctttcagtcgtagcagcacaagaaaaggtcatgcttgacgaatgcagagaactcttagctatggccgcagaactggaggtacaggagtctagcctgcggacacatcttatgcaagtaaaggacttgtccagatgaattaacaacctgggtaaagctatacgatatacaccattcttttccactgtatttttttgacatctggagagagaatgtacaaatgaaatttgagggaaaaagatactgaaa

SEQ ID NO: 102282 - DNA, 300 bp, Triticum aestivum
  unsure (1)..(300): unsure at all n locations
  Clone ID: PAT_TA_102282
gccgactcgtgcgattccggacgagcttggtaccctagtgtctaatgcgcaactgacacaaaaagcacgagggctgatgantgcagtgactcagagtatgaaccagatgctgaagaggangcctatgtagaggaaagaggatttgagagatgaagangaggtcgctctttcaaagccaaagcaatggaagcattatcaaataagccaccaacattactcatgagaattggactagccttgcaataaatggtctgatgaaagaaacaagaaaatatgtcanatgaataaggaaaacccgag

SEQ ID NO: 102283 - DNA, 300 bp, Triticum aestivum
  unsure (1)..(300): unsure at all n locations
  Clone ID: PAT_TA_102283
aaggatcccggctgatgaatcgacgacaaccagaagaagaacttgagagacgaccgagatggcagctcatgatacctcgcgatgnggcgcgacgagcgtgcgtcctctcccgcggggctctcttcgccgcgctgagcggtggcnagaagacaaggcgataagcccctcggactcggaggcggcttgacagcgacatcgacgccaacggcaggaangtctgcaagaagggcngtgtaccaagttgtgcaacggacggtgccaacgtcgacggctacaggccaatctacacccagaggaatg

SEQ ID NO: 102284 - DNA, 300 bp, Triticum aestivum
  Clone ID: PAT_TA_102284
cgcctgcagatcaagaactcagctgccgcctcccacctgtaagcggcggccggagtagtccgtaatcgcacctccgtcatctgtagatagcactacgagtagagcagcagaacgtcctgcccgtctgacatacatagtcttgtgagttacgggagggattgttgaatctgatgatagactgactgttatgtcgctacggtggcccattaaagcctgatcgaagaaacaactgaaatgcgtcggcttcttccgatttggatggatgaaaatgtaatggctctgacataacagttgtgttgc

SEQ ID NO: 102285 - DNA, 300 bp, Triticum aestivum
  unsure (1)..(300): unsure at all n locations
  Clone ID: PAT_TA_102285
cgccgatctgcagaacccacagtttgacctggatgggaagcccgcgctgccatcggccagagtggcctcatggctatctacgatacattggntaaccaggtgggtttgctaaatgtcggtctttcttttgttattggtgntgctgaggtatggtctttcttgctcatctccaatcaaatgcttgtgagcttaaaggttcttgtttgcttgttcccttcctgttcaagttgttcgtcgtctatgtcgttagccaacaaggttagatgtgctctcattgccacgcttgattgcttcttgcaa

SEQ ID NO: 102286 - DNA, 300 bp, Triticum aestivum
  Clone ID: PAT_TA_102286
caatcccagtcgcctgcttacctcgcgttgctgtagagctaggctgagaggacgctcctgcatggccgcggcagagctgcgttggtgatgcgcgaccacactgcggcacgtcgacggcggagctgcatgagcgggaggtgctacgagctgctgcatgaccagcggcgctgctgcacatcgacagcgaagctgcgttgcagcagcaaagagctatgagctgcttcatggcggcagcaaagctgcatcgcagcatgcacaggcgatgcgtcaatgaagctttgccggagctccactgaagat

SEQ ID NO: 102287 - DNA, 300 bp, Triticum aestivum
  unsure (1)..(300): unsure at all n locations
  Clone ID: PAT_TA_102287
aattcgcacgagctcgtgccgctcgtgccgaattcggcacgagcggtggctcaatttgcggncattgacccagcggcggactcgggcgacttaacgagcaacagcgattcgccggtggattgaagcaaacggagacggcccaaggcgcggcaagcctcggcggaggtggcggctcatcggagtagtagggcctgcccgagcggcggcttgacagaagtgcgtgagaggaaggccagttcttttgtactccaaattagacgtttaacttgtttttacagcatatgtcgtgtgatgtgatat

SEQ ID NO: 102288 - DNA, 300 bp, Triticum aestivum
  unsure (1)..(300): unsure at all n locations
  Clone ID: PAT_TA_102288
acgcatacctgtccggggaatgcatcgagtgtatggctacttcagacaatgtggttcgcgctggtttgacacctaaatacagagatgtgcagaccctctgctncatgctaacatacaaacagatctttcctgaaatattgagaggggtgctgtgcaagccatacgtacgacgctacacccctncgactgacgagttcgaggtcngactgctgcttgctgctcaggtgaagtggttgttatgccaccggtaccaggtccatncatctttcttgtcatgaccggggagggcgaggtttangc

SEQ ID NO: 102289 - DNA, 300 bp, Triticum aestivum
  unsure (1)..(300): unsure at all n locations
  Clone ID: PAT_TA_102289
ctacactatatttcctgntatctagatttaaagatttaaaattatttgaattcaaacaaaaatttcattgatttgtcccaaagaattattttcttttatctcaatatttatatttaacattatttgaatttaaaaaatagttgatttccccccaaaaaaaaggttacgtacattcatacgacactatattttctttatctagattcttagattctaaatctaaaattaatcaaattcaaacaaaaattccattaatttgncccaaagagtttacgtacattcattcgccgctatactttc

SEQ ID NO: 102290 - DNA, 300 bp, Triticum aestivum
  unsure (1)..(300): unsure at all n locations
  Clone ID: PAT_TA_102290
gggagctggtacngccagcagtgcggctcgcaggccggcggcgctagtgcccaactgcctctgtgaagcaattcgggtctgcggagcacctacgactactgcggaggcggntgcagagcagtgaatggctgcggcggagcggcggtgggttgatcatcgttcagggactcttcgatcggggctctcatcgacgacgcggcgtgctgcccgcgggtctacacctacgacgctcntggccgcgcagcgcgtcccggccttctgaccacgggagactaggacacgcggaacgagaggtggcgg

SEQ ID NO: 102291 - DNA, 300 bp, Triticum aestivum
  unsure (1)..(300): unsure at all n locations
  Clone ID: PAT_TA_102291
ctagctggttctccccgaaatgcgttgaggcgcagcagttgactggacatctaggggtaaagcactgtttcggtgcgggctgcgctgagcggaccaaatcgaggcaaactctgaatactagatatgacccctcgacggtgatccccgtcgagtcctcggaggaggaggactggggcgactcaaagtacatgaatgnagtacctcaaactangtagtggttgaactagtaatagttgagtttgatatgttttattaattataactatgtttaattatgtttgaaatgaaggagcagttgaa

SEQ ID NO: 102292 - DNA, 300 bp, Triticum aestivum
  Clone ID: PAT_TA_102292
aggcagcgtccgtattgacctgcaggtcccatgcgttggctcactgcagcccggtgtttgtgagtgcggcggtgctgcgatggagcgcccgctgttggtagagtgcgccgatgcagcgtctccggtggcgtgggagcagagcgccgatgcagtgtctccggtggcgcgggaccagagcaccgttgcagtttctccggaccatctccgtctccttgctgctgtcggtgacgctgtaatgaaggaaggggcgctgctgccggcggcgcgacaagttgaggacggcgatgctgcatgaagtag

SEQ ID NO: 102293 - DNA, 300 bp, Triticum aestivum
  Clone ID: PAT_TA_102293
ttgatattcaggccttactcaggcgctgcccttgtctgcgcgtgctcaagatcatatctcttgatgccaggcgcatcgtcattcagtcggcgtccctgcaggaactccatattctgaatgccgtgaaacgttgcgaatacgacacatacagtattgatatcgcagcccccgcactgaagcatttaaacctttccgtcttcacccaccacaactgcagcttgaacatctcggctccaatggtggagcagttctcgtgggagtgcaagtacgcctacatggcaactgggattggtgaactgt

SEQ ID NO: 102294 - DNA, 300 bp, Triticum aestivum
  unsure (1)..(300): unsure at all n locations
  Clone ID: PAT_TA_102294
gaaatgtgctaagcagtgagaacatcggcagcatctacctgtttgcgaagataataatattatatatatatatatatatatgtactgcagaatatctcgcttgtgatgntcaaaaatagtattactagtatatcccaaacaagtgatctcacacagtncatattccttggcaacaatttcaaacccaagaataattccctattattagctgcttcatctgattttattatcacttaaatttgtatatgcagnctgcatttcagaatattaatttaatttgtttttaccatttccaaaaaa

SEQ ID NO: 102295 - DNA, 300 bp, Triticum aestivum
  unsure (1)..(300): unsure at all n locations
  Clone ID: PAT_TA_102295
tgggcgtgagtggaactagttccgctggtatgcgtcttggatgtgtgatattcagctctgtgcagctgctactgctgtttcttgattaccctattggcaagaagctttctgatggatgcttaggaatctctggactttcactttatgattgtattcagcagagacaacatccttatgcatccattcccatgtaagtgtagctgggtattccggcggtcctatcaggctatgcatggtccttggaacctctagttgacanggaactactgaaatgaatctgctatgagggtacaaatttgg

SEQ ID NO: 102296 - DNA, 300 bp, Triticum aestivum
  Clone ID: PAT_TA_102296
gctgacgtcaagactggccgttcagagactcatcgactgacgggagtccgcgactcggtggcacgcggctgcgctgaccaagactcgcagaccggagtgaggtgatcactacggtgggcgatgtcgcgcctgggtggtgtccgaatctgtcaagacggataagtcgggaggccggtggtcaaggccgcgccaatctttcgaggcggctcgactactggcacccaactgtgacgccagagatctgcattggcggtaggtgggctatgcttatcgaggctccgcgtggtgcggccctcgcga

SEQ ID NO: 102297 - DNA, 300 bp, Triticum aestivum
  unsure (1)..(300): unsure at all n locations
  Clone ID: PAT_TA_102297
aatctttgttaccacgatagggcctcgatattggtggagcgtagcggcagcctcaatcggacggcgcagatgacgccggaagcgaacttcttctctgctgatccgtggcaatggccgccggtcgcgcttcgnccgcgcaccgatgcaaggtgtggatcgggttggttgggatcgatcgatcccaaccctaaccgctcttttactcggtgcggcggccgttgggcaccaaaggccgngaggccaggccagcacctgggggacctccgntgcccttcccctccgtcggccgggncgaatcat

SEQ ID NO: 102298 - DNA, 300 bp, Triticum aestivum
  unsure (1)..(300): unsure at all n locations
  Clone ID: PAT_TA_102298
gctcggccgatcgccgagtgtataccggagttaggtggattatgttgcatatgcagctctgccgaatcttggggcgatttgattacaatttggtggaggaacttaggacatcttggggaatgcacctgggcagcagctaatcgagtgctttagaagctgtgacaaactcgacgaagggcgcgatcttgctcgcgaaggaatgaaatatccgacagcttgaaatggagtctgactaccgcagcttggaagatggaaagncgatcaaatcgagtcagccggagatctatgataagagataaa

SEQ ID NO: 102299 - DNA, 300 bp, Triticum aestivum
  unsure (1)..(300): unsure at all n locations
  Clone ID: PAT_TA_102299
cacatcaggctaccaaggctcttcgtacgtctgcgtcggaacgagtcgccgctgcgcaccagaactcgtccggcatgaagaacgtcagggcgcgctcgcttcgctgggctgggccacatcaaggcacacgtcggttcgaaggcattctcgncgtgacagccgccctcgcggntcttcaccgggagcgacgcgataatggcccgtggngcaagatcttgccgaccggcgcgccgtcatgctaacatctaccgtactgtctgggctacaacccgagcgcatggacatgagctacgcgcttta

SEQ ID NO: 102300 - DNA, 300 bp, Triticum aestivum
  unsure (1)..(300): unsure at all n locations
  Clone ID: PAT_TA_102300
cctggaatggctttgggccttctgccagcttaagtggaagcgaagaaggcccctttcgggggggccgagcatagtgagaaccactctggaaanctcggattctaaccttgtgcagacccgcggccaagggacaagctcaagtagacaggttctatgggcgnaggcctccaaaaggnaacggagcgtgcaaagggtttctcggccagacggacattggtcctcgagtgcaaaggcagaagggagcttgctgcaagactcacccgcgagcatgccggagcgggggtgagattctcgccacaa

SEQ ID NO: 102301 - DNA, 300 bp, Triticum aestivum
  unsure (1)..(300): unsure at all n locations
  Clone ID: PAT_TA_102301
taggagtgagccaaacatgttgctctgtatgcgcttggtctgtgaaacatttcctctcactgtagacgagcgagcttcgggtggncgacatcggcgagggcatcgcttgtcatagtagccagcangaagcgaagaangtccagactgccaaccctacgggcctgtggtgagtggtgtcaaggaggcgtcgatgccgtcggaagggcggncaaggggaagggtgttaccagtttgccgacaagtattgagcaaacgttgtgggtacagcccgtatatacccagaagaatggctcaagtgtg

SEQ ID NO: 102302 - DNA, 300 bp, Triticum aestivum
  unsure (1)..(300): unsure at all n locations
  Clone ID: PAT_TA_102302
tcgtgccgaattcggcacgaggccaagaacaaacccgactgtgcacacaaacagttgtcggatcatagtaagctcatcatgaaatttcgtatcagtagttgttccttagttacattgtatatgcctttcgctgcttcagctttacctaattaatttttgatgttaatgtgatccagtggntacatggctccagaatatctttacagaggtgaaatctcggctcagtcagacatatacngtttaggcctagngataatcgagatcgccacncggagagcagaatcctcgcgaaaaagacca

SEQ ID NO: 102303 - DNA, 300 bp, Triticum aestivum
  unsure (1)..(300): unsure at all n locations
  Clone ID: PAT_TA_102303
gtgccgaattcggcacgaggagctcaaggtgaaggagctcaagaacggccgcctcgccatgttctccatgttcggcttcttcgtgcaggccatcgtcaccggaaagggacccgttgagaacctcttcgaccacgtcgccgacccagtcaacaacaacgcgtggcccttcgccaccaacttcgcccccgcatgctaaatgtgtttagccatccgtccgtccgtccgtccatcggacgagatatgcatgcgtacttgtacgatgnggatcaacgccctgctcgaccgtcctttgcgtcctta

SEQ ID NO: 102304 - DNA, 300 bp, Triticum aestivum
  Clone ID: PAT_TA_102304
gacatgaggagcaagactctgaagggggtagctgctccaagtgaaatcttcaagctcctcgaaaaagaagaaggtggagctgcaagaggatcctcggttgctgtgtgaccttctgcggacatagaagacgaagagcctaaacgtctaaaacaactattgtattaatcattgggagcgattcaagtggcgcttcattttctagatgctccgttgcttgcactttaaaatagaagaactcagcatttaaggtctggtcatttcggtaactgacaatgaatttcttgccatgaagcctctcta

SEQ ID NO: 102305 - DNA, 300 bp, Triticum aestivum
  unsure (1)..(300): unsure at all n locations
  Clone ID: PAT_TA_102305
attgtcatccccatgatgttccgcgagatgaagtggtactatgttgtcattgcgtacctactggctcctgccctgggtttctgcaacgcctatggcgccggccttactgatatcaacatggcctacaattatgggctttggatcttcccttcggccttgcttgcactggccaagatcagcccaccattctgcatggcatttaggcctacacactagggacagnaacaaactactctatgtacagttagaagacatacatcctggcaagaatgcagtaaataggttttgcatagccgggnc

SEQ ID NO: 102306 - DNA, 300 bp, Triticum aestivum
  unsure (1)..(300): unsure at all n locations
  Clone ID: PAT_TA_102306
gtgagccgntgaaccgtcaaggcggaggcggtggccaaggacacgtcgagcatcngtgagagaaggggcggcgccatgaatgtggtcaagcccnagaggaggaggcctncatangctaagactcaatatatatcattgcatgatgcgataggggcatgtaattcggcctcatttcattcgtatgatcgctggngtggactgngcgtgtagaggaagacatgancgtggatgctacttctcatgattcttncctttttcagtaaggtgtgccatctattgnactactaaaaaaaaaaaaaa

SEQ ID NO: 102307 - DNA, 300 bp, Triticum aestivum
  unsure (1)..(300): unsure at all n locations
  Clone ID: PAT_TA_102307
gataccacacagtcgcgcattcancggtgctagcnaggtcgagcaaagcagcacagagatggctgctgccttcttctccaccgtcggtgccccggcttctacgccgaccaacttctcgggaagaagctcaagaagcaggtgacctcggncgtgaactaccatggcaagagctccaaggccaacagggtcacggtcatggcaagcggaaaacatcgacgagaagaggaacacccgacaaagtggaagggtcttgcgtaccgattcttcgacngaccaggaggacataccagagggaanggc

SEQ ID NO: 102308 - DNA, 300 bp, Triticum aestivum
  unsure (1)..(300): unsure at all n locations
  Clone ID: PAT_TA_102308
attctcaccaacccccaacaggccttccttccttctcggcaaagtttctgcaacaaccggagcaaactaaagatggcgggattcggcagcctggcacccaagaccaagaactttgtggtggctggaggactgctgctttcgtcctcggtgnattactacaccatgagagcggtgggaggcacagatgagctgcaggtcgccattgataagtttgaagacatgaagaaaaatgatgctgggaactcatccaccgcgggatcctaagaacagggttagaattggctccatgtccgcctctat

SEQ ID NO: 102309 - DNA, 300 bp, Triticum aestivum
  unsure (1)..(300): unsure at all n locations
  Clone ID: PAT_TA_102309
gccgacacatctcacactttgtgcgtagagcaggtacaatggcaggctataagccagctccaacatattttacgaagataaatcaagagagagaagagcaacgggctacagatttgtagccagctgtagcacggactccaagacgcagtgtgtctatgacaggtgggactagatattaatagtggtagtatgnaactattgtatgaatgggctattagattgactatagatgaattggagctagtagttgctatactattgaacttgctcttatatagcaacaggtacagnatatgaatt

SEQ ID NO: 102310 - DNA, 300 bp, Triticum aestivum
  unsure (1)..(300): unsure at all n locations
  Clone ID: PAT_TA_102310
ggcacctcgtgccgaattcggcacgagcaaatcgtccgagcgccgccgccgccgccgccgccatgggtaaggttcacggctcgctggctcgcgccggnaaggtgagggggcagacgccgaaggtggcgaagcaggacaagaagaagaagccccggggccgcgcccacaagcggatgcagtacaaccgccgtttcgtcaccgccgtcgtcggcttcggcaagaagcgcgggccaaactcctccgagaagtagatctagagatcgctcctttgcccccgtctcattaattaatactcatgga

SEQ ID NO: 102311 - DNA, 300 bp, Triticum aestivum
  Clone ID: PAT_TA_102311
acccggcgaacgcgcagaggcacaggatcgagcagggcgtggcggcggtggcggcggtgggcgccggcggctacgcctaccacgagcaccgcgagcagaagcaggccagctacggcgccaaggagcagcagtacggctacgccaggatgccgcagcagcagggctactactgcaactgattaattattaatcacccccaaattattaataatccatgcgtacgtacgtaccactaaataaatactggctactacgtacgtatatatacggtacaataagatgagcaaggatgtacgtacg

SEQ ID NO: 102312 - DNA, 300 bp, Triticum aestivum
  unsure (1)..(300): unsure at all n locations
  Clone ID: PAT_TA_102312
ggcacgagccacagctcgatcgctagccctactcgctagctagatcggcggccatggtgaacggctacttgttccgggagtacatcggcgcgcagttcaccggcgtgccgcttctccgacgtgcccgtcaacccgggcctcagcttccacttcatcctcgccttcgccatcgactacttcatggcgacgcagtcctccaagccggcgccagccaacggcgtgttcgccccgtactgngacacggccaacctgtccccgcgcgccgtcgccgcnggtcaaggcggcgcaccccaacctcac

SEQ ID NO: 102313 - DNA, 300 bp, Triticum aestivum
  unsure (1)..(300): unsure at all n locations
  Clone ID: PAT_TA_102313
aattcggcacgaggtaacttcgggagaaggggtgccccctaggtattctctacctacccacctgtgncggtttcgggtacaggtacccctttgttgaaggtcgttcgagcttttcctgggagtatggcatgggttacatacttcagcgccgtagcgcctggtatgagcctcgtgnagaagcaatggctagtccacggggctcatacttcagcgctgcagcgcttggtactcggacctcggctcgagggggggcccggnacccaattcgccctatagtgagccgnattacaattcactggc

SEQ ID NO: 102314 - DNA, 300 bp, Triticum aestivum
  unsure (1)..(300): unsure at all n locations
  Clone ID: PAT_TA_102314
acagctctgcgattcgacacgcacgagggggggccgtcccatcgcctnagtngtcgatacattactgccgcgtttacaacgtctgctggaaacctgcgttccactaatcgcttganacatccccttcgcactgcgaatagcgaaaggccgaccgatcgccttccaacagtgccanctgatggcgaatggaaattgtagcgtaatatttgtaaaatcgcgttaantttgtaatcagctatttttaccaataggccgaatcgcaaaatccttataatcaaagaatagccggataggntgagt

SEQ ID NO: 102315 - DNA, 300 bp, Triticum aestivum
  Clone ID: PAT_TA_102315
ggcacgagggcaaggcggcggcgaatctggccgccgttccgcccgtacgcgcacggcgcgacctctgcggcggcaagctcggactcggatggatatggaggaacagcggcggccacccccacgacacgccgcaatcgatgtccggagcaagcgctaacaaaaaattaacatatgatatagactgtgaggatgtatttgttgagtcaaaattttgttgtcataccaagttaattttttaattagtaaggataccaagcatatgatgtatatgaaaaagggtttctaataaaaacatagccg

SEQ ID NO: 102316 - DNA, 300 bp, Triticum aestivum
  Clone ID: PAT_TA_102316
ggcacgagcttgagtgaacagatgctcttgatctctcgccgcctgtaaagaagacgaagcaacgaacacccgaggaggaatcacggcggcctctctccggcgaggcaccgggcgacgtcgacgtcgccgactcgccggccggcgaccctcgccgtggctcgcagatgaatccggccacctgcaaaaatgaatctggagaatagcaccacgcacttaagttgtagtcgatcttgtaaaatgagcctgcaaagcctacatgatgatcctgtttacttcttgtacatgtgcatcactgtatca

SEQ ID NO: 102317 - DNA, 300 bp, Triticum aestivum
  unsure (1)..(300): unsure at all n locations
  Clone ID: PAT_TA_102317
ggcacgagggcctcaagaaacagccagcttacattgatcacctaatgtggagcccacatcagaactggttgtacaaccatcttcaactttacctcgaacagtaaatgcagacctatattcactcgtagtagatgattttatatttgagtttgnatcaatcttgaaaccaataggttgtttggcatttgactttacaccatcatcaccacgtgaaggtggatgtgaacatttatcggtgtcctctacttcacgattttcagtcttcgctttanaatctatttctggnagaggggaccgatc

SEQ ID NO: 102318 - DNA, 300 bp, Triticum aestivum
  unsure (1)..(300): unsure at all n locations
  Clone ID: PAT_TA_102318
ggcacgagcgacagctccccgccgtgaaccgggacgagctgctacgcctgctgctgcacacaagctcaagtggccggccgagtcgtccgttcaccgcggcctactgcatctgccggcaaggagctgaaagatgagggctgcggggaagccgacgagcggcggcagcggcacgtcgaggtcgagcaacatccgtggcctactgcaggacttcctggagcagcagcaccggctggacgtgcgacggcaggaggcgctggagaggcacgcgcaggagcgtcnggccatcgagcagcaatggag

SEQ ID NO: 102319 - DNA, 300 bp, Triticum aestivum
  unsure (1)..(300): unsure at all n locations
  Clone ID: PAT_TA_102319
tctcttctctcttgctangctggcgcatctccgcactccgtcggcgacgacgacgacagtccaagatcgaaaggcgaacccgcgttcgtggcgcgctacgcccgctcactcttccaccgagccgntgctcttctctctctcgcgcgcgcaccgcttctcatcgggcgggccgcccccgcgccgactgcccgcgcgcggntcgacgcgcgctttctcgctctccggacgcggcgngggctccgacttcggcgccctcggggtacctggtgcagatcaaaaactggaaagatagtggagtga

SEQ ID NO: 102320 - DNA, 300 bp, Triticum aestivum
  unsure (1)..(300): unsure at all n locations
  Clone ID: PAT_TA_102320
cacgaggtcctgctcgcgtgaaagataagcggcgctctgctctgctcgcccgaggagagagagaagagagagagagagagctagagatggcggcggcctcagcggcggcgcangcggagggaacggtgatcgcgatccacagcctcgacgagtggaccatccagatcgaggaggccaacagcgccaagaagctggttgtgattgacttcactgcatcatggtgcggaccatgccgcatcattgctccagtttttgccgatctagcaaagaagcacacaaatgctgtttttctgaaggttg

SEQ ID NO: 102321 - DNA, 300 bp, Triticum aestivum
  Clone ID: PAT_TA_102321
ggcacgagaaggagagatgggagagaaaggggaggaaggccatctctctgcttttgcctgccggagcatatgccatggtcaaccgccgctggccatgaccgtggaggcagcgaagacggtggagacggcgctgggtaaggaactaacggcggccgccgggcatgttgccgccaagctcgttggcagattagtgccattatcaagctctagcctggatccacgttgccgttgaggtcgccatctgcttcgagccggcatggagctcgtcagccagacctgcgcgaccaccaaaatccacgc

SEQ ID NO: 102322 - DNA, 300 bp, Triticum aestivum
  unsure (1)..(300): unsure at all n locations
  Clone ID: PAT_TA_102322
ggcacgagcattgcacctctgattattccatttggtgttgcttactttgctcttggatggattatagtgaaaaatcaggttctccgagtttatgntcccagctacgagagcaacgggcgaatgtggccacatatgcacacaaggatcattgcagctctactgatttaccagatcaccatggttggtgtcatcctgctgaagaagntcttgtactcccctgttcttgtgcccctcatcccaataagcttcatcttcgcctacatttgccatatgcggttctacccggcgttcgccaagacc

SEQ ID NO: 102323 - DNA, 300 bp, Triticum aestivum
  unsure (1)..(300): unsure at all n locations
  Clone ID: PAT_TA_102323
ggcacgagctcgtgccgaattcggcacgagggcatgggttacatacttcagcgccgtagcgcctggtatgagcctcgtggagaagcaatggctagtccacggggctcatacttcagcgctgcagcgcttggtactcggacctcggctcgaggcattttctctaccccttcttaccctgaaaaagcagngtcaccttgcgtccttaaacctataaccatctttcggctaacctagcctcctccgtccctccgtaccaacaaggggnagtacaggaatattgacctgttgtccatcgactac

SEQ ID NO: 102324 - DNA, 300 bp, Triticum aestivum
  unsure (1)..(300): unsure at all n locations
  Clone ID: PAT_TA_102324
gcacgaggagatggccctccgtganggcgttgnagnccacaccgtcgctcccttccaggggctcaagtgcaccgccggcatgcccgtcgcccgtcgtccggcaactccagcttcggcaacgtcagcnnatggcggcaggatcaggtgcatgcangtgtggccgattgagggcatcaagaagttcgagaccctctactacctgacaccgatcaccgtggaggacctcctgaagcagatcgagaacctgctccgttcaagagggtgcctgctcgagncgggcccggtacccaantcncccta

SEQ ID NO: 102325 - DNA, 300 bp, Triticum aestivum
  unsure (1)..(300): unsure at all n locations
  Clone ID: PAT_TA_102325
cgtctagactagtggaccccngggctgcaggaattcggcacgagttttaccatctgagagcatcatacttgagaaaggccagcaatttttggtggangacaatgtgngcgctcttcaatatatgatgaccaagtccctggattgcaaccacattcccagcacacacactagaaactggcctcaggccctgcccaagcatctcatacaagtattgcagctccacttcctgtacatgcttctgcatcgcctcccctttcattggatcatacagtggtgacaacacaaataccttctgncctg

SEQ ID NO: 102326 - DNA, 300 bp, Triticum aestivum
  Clone ID: PAT_TA_102326
ggcacgaggccgtgcgcgccctcggtcgaggccgagccgttgggacgcttcatcctcgcgtgtacgccggaggggctggacgagctcgcgcgtggtcaaccagccgcatgtacaaccgcacagtgaactcatgactgccgacgcccgtccaaagcaagttaacctcaaaggttgcttttgtaaataaagtcccgcgcagtagcacggatactcgctagcgtacataaaaaattatgttaaattttctttacacatgattttcttagaagttattaatagttatcccgctggcttataaca

SEQ ID NO: 102327 - DNA, 300 bp, Triticum aestivum
  unsure (1)..(300): unsure at all n locations
  Clone ID: PAT_TA_102327
ggacgagtcccttctntctccggctcgccagctccgcacttctaccttggcttttccacaccagcagcagcagccgccgccgctcgttgtcgccgcgtcacgaccggtggttgccgcggtgaccggagctcggtgcgccccaccgccggctgcgttgaaaggcgtgacgcgagctttatgctcgaggcagccttgcttcttggacgctagtagcagcagcatcggcgggagtggacccgcgtccacggaacttctgcaaaagaaagattctcgatggaggcgagacgtcttcgggacggc

SEQ ID NO: 102328 - DNA, 300 bp, Triticum aestivum
  unsure (1)..(300): unsure at all n locations
  Clone ID: PAT_TA_102328
cgatccccacaaggcggncgtcatcggtgacaccatcggagaccctctcaaggacacttcaggaccctctctcaacatcctcatcaagctcatggcggcgaatccctcgttttcgccccttcttcgccacccacggtggtatcctcttcaagttgttctaaaccgccactgttgggtgtaacaaaggccatagttntgttggggatgagcaaaatatgtagactattttgtcatgattngctccttgagntgatgactccattgnctacttgatttcccatttttgctctagntccaggn

SEQ ID NO: 102329 - DNA, 618 bp, Triticum aestivum; identical to SEQ ID NO: 74137
  unsure (1)..(618): unsure at all n locations
  Clone ID: PAT_TA_102329

SEQ ID NO: 102330 - DNA, 581 bp, Triticum aestivum
  unsure (1)..(581): unsure at all n locations
  Clone ID: PAT_TA_102330
atccaatcccctctccgcgatctcaccgggaaattcctcgaccgattgaaagccaaggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcagaaggagtccaccctccacctggtgctcangcttcgtggaggcatgcagattttcgtcaagaccctcaccggcaagaccatcaccttggaggtggagtcctcggacaccatcgacaacgtgaaggcaaagatccaggacaaggagggcatccctccggaccagcagcgcctcatcttcgctggcaagcagcttgaggatggccgcaccctggctgactacaacatccagaaggagtccaccctccacctggtgctcaggcttcgtggaggcatgcagatttttgtcaagacgctcaccggcaagaaccatcaccctga

SEQ ID NO: 102331 - DNA, 531 bp, Triticum aestivum; identical to SEQ ID NO: 74138
  unsure (1)..(531): unsure at all n locations
  Clone ID: PAT_TA_102331

SEQ ID NO: 102332 - DNA, 533 bp, Triticum aestivum; identical to SEQ ID NO: 74139
  unsure (1)..(533): unsure at all n locations
  Clone ID: PAT_TA_102332

SEQ ID NO: 102333 - DNA, 583 bp, Triticum aestivum
  Clone ID: PAT_TA_102333
gatcccccgggctgcaggaattcggcaccaggagggatcttttaagagggctccagcctcttactagatggcgacggacctggcctgtggctcacgggcgatggcggtcagccgcccgcggtgatcccgtgcaggaagcgcagctgacgtctgggcaagccctaaagaagactgggctgaccaagtccgagctgacgctgcgataagaacaacaaacggtgacggggtacacgaacaactctttcaggggagcgtgtcgcccactgagcgtgtcacagacagaattttggccaacaccacagaaggagcaagccggtagaaaagagaacaacagggactggcttgtgacgccgagcaaactatagaataactaccggggctgcaaggagtaggcgaatcgttaactacggttaggaattcaggacaggtggaaatatcagcaaaaagtactcaagagttttattaagctgaatagaaacgggggggacattgaagaaggcaaaaattgagcgtgggttaccaagggcctttaaagcgaaatttgaagggcaggccagttggcctttagaaagaccggctagag

SEQ ID NO: 102334 - DNA, 545 bp, Triticum aestivum; identical to SEQ ID NO: 74141
  unsure (1)..(545): unsure at all n locations
  Clone ID: PAT_TA_102334

SEQ ID NO: 102335 - DNA, 516 bp, Triticum aestivum; identical to SEQ ID NO: 74152
  unsure (1)..(516): unsure at all n locations
  Clone ID: PAT_TA_102335

SEQ ID NO: 102336 - DNA, 486 bp, Triticum aestivum; identical to SEQ ID NO: 74161
  Clone ID: PAT_TA_102336

SEQ ID NO: 102337 - DNA, 521 bp, Triticum aestivum; identical to SEQ ID NO: 74142
  Clone ID: PAT_TA_102337

SEQ ID NO: 102338 - DNA, 641 bp, Triticum aestivum
  Clone ID: PAT_TA_102338
gatcatgtcgagagctgtttcctgtgtgcaaattgttaatccgctctacaattcccagacaacatgagtagccgtgaaagcgtgaaagtgtgacagcctgtgggtcgcgtcatggcatcgcagctaaactccacctatggattgtcgttcgtctctacgactggcccggctttgcccagtgcggggtccaaccttgttgcgtggtccccacctgtccaatcgagtctcataccaggacctaacgacggtcgaggagtcgagcagacggtttattgccgctggtactgggagacgcttccttttcccggttttgcagacgtccagctactgggtgaccgcggtcgagtacggccggcggctttcggtattccggttcctgggtgggttcgggaggcattgtgcatgctagtactgacactttgcgggtaaacgggttgtattgagatctgaccgggccggcactcggctctgaagtttagtgacaagattttgctattcgagatgcctgaatggatagaaggttaagtaggtaggttatgccatattctaaaaagaaccattaggaaagtgcatgattaattgtcacctaaaccgccaaaaccggtgtgagaaataaaacgattaatatttaggatatatgc

SEQ ID NO: 102339 - DNA, 285 bp, Triticum aestivum
  Clone ID: PAT_TA_102339
ccacttggccgtccgttttcacaacgatcgtcgactggagtaaaaccctaggtcgttacctccaactgtgatacagacttagcactctacgatgcccccttttgcggaccaggctgttcgtcatattagccacatggagttaacccggcagccgcatgcgtccccgtgcccggagccaggttcgtctacagtccgcgtaatcgccaaggatgtagagcagtcctagcagcgttataggcaattttcgacagaccccgttatcccgaattctgcagcaccctcgcc

SEQ ID NO: 102340 - DNA, 620 bp, Triticum aestivum
  Clone ID: PAT_TA_102340
tttttttttagtaaggaaacataattttacatttgaatctgataacaacgagcaaaaattagaataaactggcctgccgattgacatcatgtctccgacttgatgccaaccgaagcataacgaacggagcatactttattttattacagcagtacactcagcaccgatcataatgaccggactgactcaagccacgttgacctcgaaaaatggcgcacaaactgttgtcccagttcggctacctatcccaaaagggagtaggcgatgatggcgggcacaccccgctgacgccaaagaccagcagtctttcttcgcacgcgaccccgaccccgcagtatcgaatcgttgtgtggcgtagcacgcacgccacccggagcaccgggcgagcacggccgccccgcggatggtccgggtcgggatgcatccggagctagcggctttcgggcacgggaaaggtgggcctgtgcgccccctcgtcttcgcctccacgggttggagccatcggataagcggaaccgcgcctgccccggagggcagccgcaacagacgagggaccgatttgggcccctgcggccgaggccgcctatcgggttgagggtactcggggtagaggtaatgca

SEQ ID NO: 102341 - DNA, 501 bp, Triticum aestivum
  Clone ID: PAT_TA_102341
tttattgaagctcaagctcccttataatttattattaactttagcaacactacaaaatctcagaccaatcaaaatggaaatccaacatcgtatactcacactggttaaaggcgcaagatgttatatgattgtccctcctgcaagggcaaaatcatgactgtaaactgttagtctttccgttgcatgggactatggagcatttctagcttactggcaggccgtggctttcacagtttttctgacaaaggcgaaatcaattctgaatccccttttaaccttccgttacccacccaggaggtgggttccatgtcctgaacttgcgttcccaaattggccttccgaggtgggacccaattaaacaattttgggtcacgcacaacaaagggaaccgtcattacaaacacagcttctgtgtcaagaaaggtttagtccgactgtggcgcatgcgcactcgcccacgcctatgtttagaaaggtttgtaaactgaggccttactttga

SEQ ID NO: 102342 - DNA, 516 bp, Triticum aestivum
  Clone ID: PAT_TA_102342
ttattccccgcctcctgcgcactcaggtgcgctgccttccagaagggggctttgtcacgctggccaggcaactcgcctacacacaacaaacaacgaaggcagcatgcaagcaaccccaaggctactactaatgtaatctagacagaaaacctacaccacaatgtctacgaactcaatggatccaaaggccgtacgcccagaaagccgtgatccgtaaccaacataaccctgattcatcccccgcagctcgtgcctgcatgcagaagcgaataggaccggcttaccaaatctaatattctgcggggacggaagagagcgacggggctaaaaaccacagaccgatccagcatttgccttaatgaatccgaaaaggcttacttgaaaggcccaattaggaagctgagaggaagaagggaacggatggggacgggcggggaactcaaggggatgtatcgagactgggagctgcaaaactcacagaatgtgctggcggatggggggagggtccactgtggg

SEQ ID NO: 102343 - DNA, 495 bp, Triticum aestivum
  Clone ID: PAT_TA_102343
cagaccctcgcggcggcgcggcgccggacgcggagctggccggggagacggaggagcatgcgcggcaagttcctcgtggctgcgccatctacgaggcgtaccaatcgccccgcgtacgcggcgcacgggccatggaagcatggctcgcccaccgtgaccatcgacgctggttgtttcccatgggtcccgcctggtcgccacctagcaccaatgattgcggccctccatcgacctgagcgcaactgcacccataccgccaggatgttccagtgtttcctcccccctcctgcctaccagtcggaacatctctttccgagcttcccacctggtccaatccagtccggaaatgtcgcaagcaaataataatgtatgaatctaggaccgaaggacgctaatagaaaatttaagcatatcattgggcactaggacgttacggtgccaacccaagcaaagtttagaccgcatttggattcattaatattccaccgcgcctgt

SEQ ID NO: 102344 - DNA, 537 bp, Triticum aestivum
  Clone ID: PAT_TA_102344
aacctttctccttctgtcacgcaacaccccgtacattctacgacgtgttcggcattcgttctactagggcgtaccaggtccagtaacccccctgcccaacgctaccgggccgaccggcaggctacacgcaagttcccaccttccaagttctttcttgctgaaggcagtcagccgggtctggaatgccgtacctcacgataccggcggaaggacgatacgtaggaaccgtccgtccccccttcacctaaccgccgtggcgtcatcgtggtctatgcagtcaacttggtagacataaaggccacgatggcagcaaaagaaggagtccgtaagacgttgatgtcgggtgatggtagcgaatagggttaaaccggctccgtttatattcaaaattcggtcggatataaggataagtgtttctagggtggcgttcttcaaagaccagatcgatgaggtttaggtccggcagattgcggagaaattgattccctaagcctgtgagtgattggaagtcagccattagttggcccaatgatcaaa

SEQ ID NO: 102345 - DNA, 1533 bp, Triticum aestivum
  Clone ID: PAT_TA_102345
ccaccgccgctcttccaactcatcaagagtcgcctccagcgctccgcagcgcccactaccagtcacccgtggtggcgtcccgtttcatttggaccgtacgcctggccggcatcctacttatcttcctccgtcgtcttccgtctcctgatcctacgtctgcctcctcctggtacattacataacactacgccctactacctgccggtccctaccgccaagtcactcctttcacctcatgccgctacttggaacctaactttacccaactcgtacgcactacctaattcgagaatccatacgatggccgaacgcccgatgactccgtctcgccacatgccgccatcccttcgccagcggtccgtgaagcccataaccatatcgccaattattggcacccttacagcgaccctcagtcgcctgccctgcttccttgattatggataccgactagctaccctgcacgctccctcccgaccacgccgggcccagaatccccctctgcgacgcaccctctcgcggcagctccgtaccctatttggtccacacccattccggtccgttataaaggcgcacttctaacctcggctacccataacccgctcccaaacgtcgaaagagcgcaaacctgcgaccaccaaccaggcccagaccccttccttccggcacgcctgcttcgacgcgctctaacggcccaccaagccgacgcgtggctcttcctgcgaaacaccaaccaagccccggccgggaccgtccgttcccctactcacccccttacgaccaccccggcgctctgccgcctcggctgctgtccttaacactctgcacgcagcgccgtccccgcacccaatcaaagacctccgtacttgtcacactggccacccctgtcccttagtggtgaccaacgcgctccctcccaggcatccctttctcccaagcccccgggcctcaaccgcctctcccctcctcgcccccaacccccctgccccccccccccgccacctccccctctccctccggttgcgccgaccgacctccaccggtacaccccatcgccctatcggcatcgaatgcctccccacgaccgccgtccccaactcacccacaaacccccccttctcccgcttccggccttcgccttctccgcacccgtccggccgtcccccgtggtgcctcccgcaccctacccatttactgcctcccccccaccgcacccccccgccccacgcgagtcgcaacctccagtgccacccgactcccctctcgggcaagacccaccccggaccccccaacaccccactaatcctcgaacgcccacacccccagtgccccccgccgttccgccccccagccttaccctcggtcacgcgccgcccccgttacggtctacccacactctcgaccgctctccctctcactaacccggcccggaccgggctctcactcagatgaaccccttctcccccccactggcccgagctcgcccacaaccgtcccgccacaaccccacccccggttctccacactcccgccata

SEQ ID NO: 102346 - DNA, 2207 bp, Triticum aestivum
  unsure (1)..(2207): unsure at all n locations
  Clone ID: PAT_TA_102346
aagcatgtcgaagatcggagtaatcatagcgaaagtacagcggtgggctcggacagtagccgngtaagcagtggcggacaacgggttgccgacgtggcaaatgagctgacgcagaccaacaatcaatgttcaagtgaacctggcattgtacgatcagtagctcacgtactgccgggacgaagcatgcgagcgacccagaccgtgcaagggtccctggtatatatcatttcggcaacattcgctttggcccaagtgatagctatcgtggggacttgcgtggctatgactctagtgacgttagacctaaggatagatatgtcagatgcgtagacaggaagggtcggggccactcgtgtgtacgtagcaactggggcagacgggtttgtgcgtatggcatgaaacggaatggggtatgggccctaattaagcgacaaggtcgggatacatggggaaagccgccttggccggggaggttagcgatacgttcgggttcgatgctgagatctggtacatcggatatcggtgtacgttatactggtagactaaggttatcgctcgggcaagaataccgcgaaatgatgtcattggtatgagtacgagtactctggatgatccacgattcgttatggttaggtttgtggtctccggaacactcttggtattcgagcctggagatatgcggaggtaggtaaatctctggcgcggtcgtgactagttggtgtaagcctcctcgtgggatgtactggcgggtttagagatctccgcctaatggggtgtttgagcctatgaggatcagagtaccaagttgggtcaaagaataatggttcggcggtcgcgtcggccctgatacgaccacgcataatacgtataccggttaaagtgaatatggggacgtaagtttcctagggtgagcgtactgaggatcataaataaagacatcggcggtgctccgcgctgtcctccacctattccgcgcttacgtttcagaatgtattcatgttgattttccaacttgagtgaggcgtgagactatgtacaggaagagcgacttagtatctgcggtaagggtcaaaagttcatgacttgtgttgagagagtactggagagtactcgatcacgtgcattgcagttttcaagtcagtggcgatataagtattgatgccttatgtttcgctagcaggacagccgctatagcagcggtcaagtagctaacctggggtgcgatactagtgtcagagggcgagaatattctatcgaattgtgttagtgggcccacgtgacagagacggccgtggataggcgtaagaacgttatgagtgcaacggggtatattgaggtagaggtaggagtgaatggggcgagcgtttactgagcggtgctattgatcttagcgcatgtcgttgagagtccagagaatactcgtctcctagcgcgacaggatcgaggatggatgtgagcacattgaccaagtccgcccgcttgtgggatgctcgcatcgtgatatttcggcttgggtctcactatgtgggagtgtattccacctgagtgacacaagatgggaagcatgaggtgactcaacgcaaccaaaatagtttgtcgtagaacaatcttgttggaggtactaataaagttacgtcttcttgaggcacgctgtctcccatgctacggatgtagcctggaggcgtcgattagaactagcaggtgttgtcaaagattagtgtatgtacggtgcaagcatggatagtaagccagacgtggtgagcatctgcttacgcatcggataactggtgatgttaaggaactgagtcgtagagagctttttctgctccgcgacccaagccataagacataggagttgaaggaggaattggcaataggtaaatacggggagagttgtctcatacacaatttgtcttgtaatgtctaccgttagcagctgggtaccttgtgtgtggtaggaagagacaggatataagcaatcctaagaggtgacgtgggtccactcagtgcgcctcgggcctatggtggcatcgctggtattatctgggggtgttagcccagcgtggagatggcacgaatcaaggttgcgaagttttctgttgaggggattggtctccagtatttttatacgcctgcaggtggccattgaagtgtgtataaccgaaggggtagtacatatgatagctaggtagcgctatagagggccc

SEQ ID NO: 102347 - DNA, 679 bp, Triticum aestivum
  Clone ID: PAT_TA_102347
gcgaccacaacggaccagcaactggaaactgcgtacatcaatgtccactatgctgctttgccgtgtcgtggaacattggtatatccggcttcacaaatttccagcacgtaccagtacgggagcaccggaaagccactcacaagtcggtaaaaagcccgtgggtggcctgccctacgttggaagctgtagccttaaacatcccacagttacggcgtcatcaggcctgccggcctccaacggaggccaccgaaagttaccgcaaggagccgtccgaaaaggccggggctccggtggcgcttagccataacgaatctcaaccagccaaggcggcgctacctaggctgtcgaccccggcctgactcgataaccgtgggtgacaactggccgaggtccctttcgtgagttctccggtccaccgggcgacgaccaactcgcacggacgcctacccgcgcacacagtcggagccatccactcgcaacctactacgacgcacacacgcaattcgaggaataggaggctagcagttacgaacgtctgtggccaccctcccaagctgcatccggaaccggctgaaaccaccccgatcaatgacgtcatgcgtcaacggcccaagacgaagatacgtcccctgacttcgggaaaaggctaaagtggagcgccggtccagtatagcgcctg

SEQ ID NO: 102348 - DNA, 1302 bp, Triticum aestivum
  Clone ID: PAT_TA_102348
ctgctaatagcttacgtctcgtacatggctgccagtagtgatgcttcagtcggcatacactccgcagggcgcctagttaccatccaacgggcgtcaggtggtgctgatcgctgtgataggctacagccgattgcccggttgcagccttataggggtgctgcagatgttaactcctctagatgcggtcgtgaatgctaccttctctatggggcgagtactaagccagctgggcaccttagggtcaggaagtggcattcaccccgagtcatggcagcgttctcatctacgccaactcacaggcgcaataggtttgttagttttatccggagaatctttaagcgctggtcgaaggcgaggggtgaacacgcctggggccacgacgtagggagggaggatggaaatggctggagtaaatgatgcagcgccctctttggcaatgttaactctagtatgagttcctctgagggggagccattcgcttcagcagcataggcccccaacagttggatacctcagtcgcattccagggtggcgctagctaatctgacattcaacgcatgctgataaagtcacccgcgatgctcacgctaacgcgatttacattgcgtgagctaacgcggatcacgagatgtccgctgtgtgaaccgcggatgtcgccaaccgcgagtactttctcccgagccgttggcggcagtcctcggagcgggtcttcaaccgaagagtctctctcgacgcgaggacacgtcgtcgttccgtaaaggggggaggcgcagctaggtcgagcggctagtcaatcgccggcaacactgtggactcctcacaacgtgttcctgcggacgggattaatacagccgtctaggcggtctacaggccccctcgcctcttagcgcttcgaggcggatcgcccgctttagcagtagtggaacctctagagacttcgggagctcgcaggtccctgctccacctcctgtgtcgatgcatacgataccgcaccttgtgtctcccgacatacgttccgtccaggcgtaggaggcacttttacggttctgtagtatatacgttggtgctgcatgtcacaaattccgccttttattatgagcgctcgtccttgtatgatacgctgtcgcctcactttactctacgttgctagaggcgtcgtactccaaatccaaggcttatatggtccgtagtcagctactaagagtgataggtgtgttgtacgcgtttggggagtttcggtgacggctggcttcgtttcgcgttatcgagcgtaccatgaacccacacctggtcgaaagacat

SEQ ID NO: 102349 - DNA, 1513 bp, Triticum aestivum
  Clone ID: PAT_TA_102349
ccatgggcaacgaaggcaggttcaactcatcatcgaagaaggataggacctacaagccacaagtcacatatcacggccacgaagctaattcatcaaaagcttaatcgagcaggtaagaaattgaccagtcacactaatacttaaagaaattcacgcaatgaacgctagacagtcaagcaagcaagaataagatctaggcttttcgttccataattcgtagcctgccccaagccactccaaacctgccataactagtctagggaagtgacagcgacgaaaaacaaaaagatttcgagttagttcgcagccgggaaaaacgtacaccacttaccaaccaaatggcacggtgagggatcgcgaagtttcccgggagaagtcgactaccgcctgtacaacacaaaggcggaataataattttgagcgaacctagggcgccagataggatctacatagtcccaacagtggagtcacgcatcgatccgcctcaaaaaaaattgaaatcgagacagaaatgtgaagcaactaggtactaatccaaatatgggcaaatttagcgaaagacaagagggtaaccaaagccgaaagccacgagggaacgagaataccagcaatatcagtccaacaattgtgaagtcaaaaacaacacgcaggacaggcgtcagacagttcaccgcagaagtaagcagtctcgggctttgactaagacgcgaatcttaaacaccaaagtgcgcacgttgaaaggatcctggcttgaaaaccagggtgtgacggtaaatgatactacatcaggacctaccaataacccgtagaaaaatggaccaccagaaggagaataaaataacatcatgagaccaagggcaaacgtattcaaaaggcaaagctcacctcaaaaatgagacgcatagatctggtcaggcacgaccaccacgtaggacgcaaacccaagctcgcatacaccggaacaagtaatactcgcacttggaggaagggaaagaggaacattgcaggcacctctcgcacacacccacaggagaaggactaggacatgtcaaggatgagatcagtggaccccaaaaatgagagaggagcccaaggacacagcacgagctacaagatcgtactgccgaccgaaaaacccccagcaaggggtagaaaaatgagacgtgagcgacaatactacaacatccctaggatcgttaagggaaatttctcctacaatgcgcacatgtctacaaagatcccgaggatagaggataataatataatcaatagcgcgtcgtcagaacaatgggagataaaaagaacgagactcgtacacaaatggtagaacagaccaatcgccgcacaacacactctaagcaacgactgcggcggcaagaaaccatcccgaagagaatggctaaagatacaaccactaccaatgcgaatatgcgacagataacgtgctatacaagtggtaaagcagccaacgatcaaatgcgaccaggaacagcggcagactcatcagacacaa

SEQ ID NO: 102350 - DNA, 1220 bp, Triticum aestivum
  Clone ID: PAT_TA_102350
ttaccttattgcctcataacctattactacttatacttaaagatattaaaatcctacacctagcctctcacggacttattcaccaatgtccttatttcttactgctaaattctaaatgaatctattccatttcctaattccaatatttaaattagtcaggaatattctacattaatatgtttcctggcatcattaattatctaattcttgataatgtactaggtgaccacccaattgaaacccctaattacaaaaaaatttccagagctcaatattgacaatttaccatttgaatatcccttactgcaattaattctaccacggttcaccttccagccctgtctacagtacgcgtaatatttaaaatcaaatatgtttacataatttcactatccataaataactcaatcgattgcattaccctgctcaatatatcatataaccccccttagcttgacatttcaaaatttggattaaatatattcctactcctattttagtttaaatttcgctccgttataacttcttcaactggatactaaaatcaaacaaccactttaacaaataaaatctaggtacaacctaaaattccttattcttacttattaaactaataatatcaattactcacatttactgtcgcaatgattttaactttctccaacttattttccgcaattcctccattcaacatttccatatattactaaatgcattagtaaattatatgaatttactaccgacaaatccgtcatttctagacttcacctctatgaatttaataatgaaattaatctaagctttttcacaataatattttgaattcgaatcatttttaattcaagaactctcaatactctcttattactactaaattaaactcttaattccttacactcgctttttaacttttaatttcctaataagctctaatcacataattaggtaagttatatgctagccctattattatatcaatgtggcttatttgttatagtcaacttgttcatgaatacaatattcatattctaactatctaatttactatttcagcccctattatatctacaaccgatccttattcaattatgtccatcataatctatatctcattcaatcaaaactttaactgttgattgtattatccttcattaatgcacaaggatatactatatacatcgtaaccctactctacaccacaaactaaatcaaacttcaat

SEQ ID NO: 102351 - DNA, 480 bp, Triticum aestivum
  Clone ID: PAT_TA_102351
gtgacgccaggtgctttcatttaccaggttggtgggtcagcgcgcataccagacgtcgcagcagattgagtacatcgggagatctaacctaggtgaatcgtcgtgagacgagttaagatgctgttgcgccgttcaaccagcctgtgttggtgagtctgtttgcatgaagtgaaccataggctcaattggatgcaggatatgcagttatccggacgcagtggtatcgccgacgagttagtctcatgagttagtggcgcagacttatttggctaatgctagtggccggggatgtgagcttaattggtagtaggatctgggacgggggataaagatcgtgggatgccctttcccttcgtgacgtggtcccgaatcattccctcttgccctagagttttggggggatatacgaattaggatacgtaaggaggttgattaaatttctgtcgacacatatatgtctctgagcgggctccgcttagc

SEQ ID NO: 102352 - DNA, 682 bp, Triticum aestivum
  Clone ID: PAT_TA_102352
atgactttctccattcgattcttcctcttgcgtcttgcacccacatctccttcgcgtacgtagcttagctagatcgtaacgactcagtgcctacgcaatagccgaatccaactgtacgtgtcggagaagtcccactcgcctacccgtcgactgggcgcaaccaagggcagacgtgaaggagtacgcctagtctatggcatacaggggcatgccaggcaaatcgcgtccccgccgttgtccttcagtacgagacctggctagcctggctggatatacttgggccggctcaaatgccttctctgtcgtggctggggtctccacaggcgctctaatatttacgcttacccacgatcgtcccggtgtaaacggtctggcttacaatcgtagacactgcaaatggtgatctagtggaggcgtacagtcccggacaccgggctgaaggattcactcgaccgtggcagtatccgcgtattgcatcaatccctgtaaggagaagcgtgtgtatgctcggttgtgccgtggtgcggatgccgctgccggatcgaaggcgtcatcaagctgttacaggggagtcccccggctcatggtctcggatagatcagtgcacaccgcctgcaggcgtagtgatcgccgatgggagttaccagatgctccagtgcgcttcgtagcggccttggggcaa

SEQ ID NO: 102353 - DNA, 1993 bp, Triticum aestivum
  Clone ID: PAT_TA_102353
acacagtgaattaggaacgtagtagttgtggcaattacggctttttttacccagggctctacctacacggtgcacggacaatcagactgactgacacaaatcggttagaagattaccggatatgggtctagcaatacttccacacctcgatgcgtcattcccgcgtgtcacgtaatacattagcaatgcggtatctccatctctattaatggtcgccgcgctctgcgtctcgatttgctagcgagcccgacacaacagtattagttcacccacctatgcacttgatccgcgtggcattgccgtcagatcttgcaaatactggacaacagatggatcgacgctgacgactggcatctaatccgtgccctacagtctttttgtggatgagactgtacaggtttcaagtggtgtgacgctaagtaaattactgcctccattgagttatgcgcaggctcgacgtgtccgctaaacgcgcacgactacaatctcaagacctcccattagggcacgaaatcagctcgtcgaccaacaggtgtccatctcctaggcaaactcacgaatctcgccaaacacctctagatgtttgttgcttaacgcgatgggttttgtcgctggagaaccaccggatatcacagcacagcagtgtcaagtgatacacccgtagatcgcccatgaagaccggatcatcgatggcaccgccttcctggcccatatcttcccatgctattagatgtgtcccagcgataggaatcccgtcaccaacccaaatgaacgatagaccacagtcagtcgtacaatgacccacctgaattttccttgcactaggatccagagtgaccattcagtgcaataccgtctgcaaagaggactcctattcagggacagacgctgtatactcgtacagtcaccagttttacgttgtaggcgaccaagtaagcacgtacttctcctacgcgtactgtgccactacgagcattttatcctccccgtgtgcccccgcgatgcttacttcggccgtcgtagcgtcgggcagcatcgcgcagttcataagaacccctgtaacagcgtctccaacatactttactgtagctgctaccccagtctaggaacctggagagctgttgttgaggcgactaagtctgcggtctcctgctcctcgctgcgctacgtagagcgtcagctctaggacagtgccaacccataagctgttcctcacgctgatgggccataaacgctctctggtattacctcaactgcgcccgcattaggacctcccgtgtatcttgacttcaacccaggcgcaacccaaacgcagtaaccacggccgcgttccgttacgcgccagtcacatggggaggcatcagttgtctcaaaatcccacgatagtcgtgggcgttgaaatgcttaccagaagcgagctttctagtgtgcgtacccgtatcttcccactgtcggaaaggtcttgagcatatcagactacgccttcccccaatagctcggggccgagatcctagtcatacgtcttctctatgcctggaaccagcctcatttagctccttgagatctacagatcagtaagctaaagttccgctgctgaatacggagtaagggtgcataagcacacactctgatgtgagtagagtccgtggatctacctcagtaaggaataagctcgagggagaggacgtgtacccgcgctacgtctcaacgaggctctgaggaacattgttatataggcattacgtcgccgcgatgcaactctggagaatagttgctgcctgtggaacacatgtatcacaaaacctattcgataatacgctaccccacaagagctcactaccgagtgtatttacatgtagaggctgtagagtatgccaggtctgctaacactacggactcacacgacctacgatcaatagtatggccctcgggccgctgcaagtgcacttactgtagcacccgcgcgtctgcaataaagtaccttcgtactcca

SEQ ID NO: 102354 - DNA, 966 bp, Triticum aestivum
  Clone ID: PAT_TA_102354
gtacttaataagttatttcatactgtatcacttctctattatcctcttcgttatgcattgattacttatttacttgtatcgtcgttcgtaccgacataatcttattctattagcatgtcagctcagctcataggtattctaacgtgttttatttatctccaatcggctaatccctgaatttcgagtactattataaacttcctttctcctatttgactcaatgacctagatcatacgatagttcgctgagataattcatccaatttcttcatgaactatattaagatttcctacatacctataaaattgtagtggtttactacccaatgaaactatgtatatcgatggagtatatgcgattaccatgagatattcaagattagactaggaatttatataacgattgcatttctttaatcgtattcgtttaacttgctaccgaaatggcatacatcatacatagaatcaagtacaaatcaaatataacctaattatcagttagatgacgacattagaacttatttgtgcaatgtatttaattattcggctatgttataatactatacttctgaaaacatcgatggttgatactacataccaatgttccagtaatccatatctaactccataactcttagtattatccgataatcatgtatcagtaattaaatattgtcgtctattgtttaggaatgttcatctagttaagtctcgaatacaaattttcttttcgagatggattaagagtttacataacctatgtcttatgtaatgataacagttcgtgcaccttttctcggcactagtcaatcgaaattttgatgaacactactgtattattacttcgatacgattacttcactcttcatgttccttatacatatttcatatcatattacttgattaaaacattctctgacctacgctctttcccaatatattcacatattttataattctcgacat

SEQ ID NO: 102355 - DNA, 450 bp, Triticum aestivum
  Clone ID: PAT_TA_102355
ccccatccaccgtccacaacgtcctacctccggcagtcgcgaccgcaccgttccccctcctcagcgtcaatgcgcctgactctcctcctcatactgctctatctcggcactacccaccaacgtcctcacccactgcccctacccgtcatcgtcgcctctacccccactccccgtacctccctccccctcctcacctggtgccacctctcgcttctgctcctgctctcgccaccctcctccgtccgtcgtccgctcgccccatgcattaactactccgcgctcgtccgttcctcactccaccgccctcgcagcaccccgccaacccgcggctccctgcgcagcctccacgcctctgcgcccccacatctctgatgcgagcccccccctttctagagcactggccagcccaagccgagtcatacctcgtgacccgacgggatcctccccatc

SEQ ID NO: 102356 - DNA, 606 bp, Triticum aestivum
  Clone ID: PAT_TA_102356
actgtatctcgtaataagcatgtctatcttctcgcagttgaatggacagtaagggccgtgactattattcggtaccgaaggtgagcataacccggatatttgaattgcggaatgctccggaaggtaggcatggtctagtaatgacaatattatcttgaaggtacggcaaagcgctgtacgataccatgtccgcatgtgcagtcatgtacaggaatagggcatcagacgctaacattgcggggaggacgttacgaggatgggctaagatttaggcagttcagttctccggcttgcagcgtagagcttagcggacgaaccggaaagtccggcataatatctgaattgagactcttaattgtaattactacggggttattagctcgctcgatggtaagttctcgaagacgtgtggaccttttgtcgagctatatcgggaactgctcaaccggacatggatagaagattgaatggctttatagataggcgacgtgcttttcctattttaggcagatagtgatggagaagcctcaatgctgtgttccttatcggcggtctgcgcagagctgtcccagcgatatacaggtatgcgatttatagtatttgtta

SEQ ID NO: 102357 - DNA, 1800 bp, Triticum aestivum
  Clone ID: PAT_TA_102357
gccggcacaacagtgtgccatcaggctactagagcgatccgtcgtaggaggtccattcgggattggccatcagtcacagacgggtaagaatccgcagactacgtatgatggtaaggctacggtccggctaggcatgattagcatccgacgtaacccgaagtcttgctaacctcagggccggtgataagcaattacgaatcggtaacgctcagagagaagtaatgtgagatgatctatgtgacggcctcagtccgcgagcacgagtcggtagtcaccagagtacgtttgccagggaactgacgcaattcctacgagttcaatggtaatcatgttcgtggttggcgttgtatcctggtctcggagtgcggtcgggaacgccgacacagtggtagggaggacggaagaagacaattaggtcgtgtagagctttagccgcaacatcctcgatgtgacggtcaccctctaagggaagtgcttggagtgatccgtataatggattagggtctggatatgcatgtccgccgtgacggatttactgcggcttgaagtgctaacgtggaccatggtttgtgcacgcagccgtccaaactttcccattggtttaagcgagagggaggccgtagcagggaagagcagtgacgctgcaatcacgccgggcatggcaggatcgccattctcggggtaatacccgaataagttcaacggctgacaacgccgcgaaaattggggggtgagagtggatatggaccagggtgacgcagcagtacggttatggttccggatgatggcagattctagtcattctctatgaatggcctatatagggcgagtgccattaagtagagcggaaggttctgccaggttagagtaagaaggatggacggatggcggcgtgggtcctccgttgtggacgaattcaatgaatcggacttattcgctaaatgatggcaacggcgcagcttgacgtagaccataacagcaggactgaggactcaggtgcgtgagtcgattcgagctgggaacgcagttagctacgcgcctatagcgcaggggagtattaggcccggaccctgaatacagtaacgtgagcacattttacagtgggagaagatacggtgagtagactaaggtggtggccatgcacatcataccagcgaatgagagccgtatagataccccaccgcccgacaggtcatggttggtaccgaagaagatggggcaggcacaggtcgagtggcgatgtgttactacggcagcatgagcagcgtatcgcggggaaagtttctctcatggacgaagtgcagccagatataatactacgacatattcggctgataaccaaagagaaatgaaacggccgagccggtagtctgcctccgcttaccatagcacctagacatagctgctctcggcaggaaacatggctaggtgagaatcacggattggtgggccgactccgccaataggcggggtgtggttgagtggaggacaacactcaggaaacgctctttcatatatggcgggcgtggccgaggacacagccatgcgactggcgcctaggggcggaaatgtcgcggagcaggaggatggtggtggcagccaattgctcgcgacgaccaggcttgcaaacatggcgtagccacgcgggaaagagccactcgacatgtattccgcagtcaaagatgtgctatacgcaggctctgttcaatggatcagaataggagggaacgtacgtggacgcgattaggccgtgcggcctagaagggagctagaagtactgtcagagcttcttaataagta

SEQ ID NO: 102358 - DNA, 2200 bp, Triticum aestivum
  Clone ID: PAT_TA_102358
tgttctactagcatctattctctagattctgatgttgagatagatatttatagccattatcataaggccctaagttgcttcagctaaagtgactcagatcgcacagttgcatttaagtacacgcgagttattatacaagcgtatgagaaaaccggtgtcttgagatttccgtcatttagatgaaggctatgttacctatgttaagcgctaataatattgagcttcatggtactggtttgacaagttctgaacatgctatatgttaaaatctgttcatcggctcgtatatgcccttgatgctagtagtcccttaagatgccgtagtaacttgtctgcttctgcaagcagaatcactaaagcctacgagacacgtattgagcctacctacatgtagtagacttctgtccacgctggtgacgtatcggcgcggagcgctattatatccgcttgtagtagatagcgtgtggtcagtcttggtacacttaagtgacgtaaattgacgcattgaatgaaccttgcgcatcttagacctgtttaaaatttgaagttttacacgtcactcgagtgcaggtctaaaggacgtttctattatggagcatgtataggtcgagttcgccacaaatagtctccttgtcatgcgcattggccactggtgactgagtagattctgaaagtatctgtctcgtttgaaggtctagagtaaagctttcgaatcagtagggacatttgatagaacatcactttagagatgccctcgataatcggaatatggctacgccgggtatccaggacggtcatcgaatttctctatttcatggttgcagtacggtggtagctccagtattgattcgtccccttagcaagagttagatttgggctcgaatagcattcatcaaaagactgaactgagatacgctcattaaggagtcgcagttcagacgacactatacgacttgtcctcatcgaactcttgttgtctggcattgatcgtacttcggaagagacaatggagtggagacccaacatatgctgctaactgacaccctgacacgttctcggattactaagatttccaggacttcaatgtatcgcatgtgcatcttgtgtctcataaggacaggtattgacactattctgttttgtaggcgctacttgactggccaatagacgaacaagatatctccgtgatctcattcgatgggctaatgttgatcgtggtcggcattatgtctcgcgtcagttggtaaggttgttgattttaacgtgactcataaattatattggagtttagtaaaacacttgtatggtgatacttataaaatttctcacaccgtgcattgcttttcatagtgatatgcaaatgctaactccgctatccgtttgtacaagggatggtctaattattaggggtatagttctgtgagtattctgataggcgactgaacggcacacaagtcggtatcatatacggcactccagaaacgcagtgaagccgatagtctaacaacgttgtagatcttagagatatactgtacttaaggtataccctaaccagtatatacactacaatctactgtcctgttggtgtatatactgagattctaaagcattcgtaacgtagcctatctaaagtggcgatttcattttgatatagggacactggtttttacatccgtaaccatatcagacgctttggaaaacagatcgaagtcatacgtggcaaagcctcttatcgtattgaagaccgcgagaggtagatgattttcacattgttgagagattgcttaacacctcttttattatcggtactcagctcatatcttatgatgttaagaatagctcgtactgctctgtacgcgttagttctgactgacgaatatatgacgtcgctagtgagctgatcgaagagattagattaccggggtatctctaagtaagaatctctggtctactgtgcgagtctaggatcactgtaagatggttagtcgacgtggtagtccataatattgttacagtgattgagaatgacgatctcactctcaattgacgttaagacatgacgacccttctgcaccctagctactgtcatggaaatgtagtctctatatgccctcaatattagcttcgagttctaacagttgggtcggtgggtactacaatgttgatatcagcactaagatacgtagtgttcccatggttg

SEQ ID NO: 102359 - DNA, 1460 bp, Triticum aestivum
  Clone ID: PAT_TA_102359
gccagcaggccatccagacattttcactggtattgcccttggtacagatgttctctctctgtgtggtctgttgtctctagcactatcgccaactgttaggcgatagctgcgtatacttcacactactgcactcaggatactgagctaaactgaaggctgccacaagaaacgctacaacagtaaccgactcacgcgtgggagccttaggatcaatacggcatttactaagccaaaatcgagtaggccgtatccgtcgaggcggacccaggtcgtatattgggcagacggcaaagactaattcttaacgacaagccacccacgggacaccttagcagggacaagtcctacctactaccgacaatcctcaaatcaacaacgtggtaccaccctgcaggaccttgggactgaccaacattcgttaagcgaggaaagtctcgtatggaactggtaagccccggcaagcctgcaaacctagtgacagcgtccagggtacgccgaagtcaagactagctagaaccctacggtgggattaaatacccagggctacgtacgctctgaatagcgcgaggaaccggcatttaaacacatgcctatgaactggggaaatcgcttcgagacgtaaggagcccttaaagcctccctagtgactgtcacataaggtcgttcttaagtgggtccgtggaagtcatgccaggcaatggcttcagtctctaaatttgaccgacggtcgaatgtggaacacaatctcaatcgcgaacaaccactgcttcaccgggcccagtgaccttgagagcctccctttggaggatcctgcatatagcgtgactagtctccccgttctccagatcagcagccctaaggagacaactcgctggccgaaaagttaggctaccaggactctaaatcggctgcgttcaagggtcagcccgcactcgtggaacccacggaggtcgtcgactaccgtgttgagacacggctggcactactcgggccacgccggtctccccacaagtagtaacggaagaacgaagcccctccccagaatgcgctaactcccggcgcgggggccacgcccatcgagcaaagtggcgaaccctagcacaagaccagccttacccagtgttatctataagggatgcgcatgacacatccaaacacgacaggtgcgaatcgggctcgtcaaatgagctctcggaggatctcaccagtaagtcagacaaacttacgacagcctactccagcgcacacttaatgacatgtggcaggcactcttgagaatgggcttcagcgcaggttatgggcgcagtcctgagaacacgcttccagaacgtgtgggacggtcgaggacgtacattcgaaccgaatggctaaagttgtccctggccagtttcagtgcgtccctgtacaacgggggtaagtgtactgcccaatctataggtgagtaaaccgtggtctgacgt

SEQ ID NO: 102360 - DNA, 1000 bp, Triticum aestivum
  Clone ID: PAT_TA_102360
agagagatctcatgccattacagccgttcccgtcacgaatgatggcatgtccatgatacttacagaacatattccctacggggaccctctcaccatggctcagtactggagctacatcaagcgattgtcctccacgatcgaagcgaaatcttccatccaatagcagtcgggcaggccccaatgatagcgtatttagatccagagctttggcagtcgatatacaaaatattagccattagacccgttgtgatattatgggatagaggctggcaggtcactccccgatgtgagaatatccggacgatagaagagccgggtctccaggactgttaccggtcgttagctagacaacctcgacactctactatgtgagacaaatgcaatactacctcgtgcgctgtcataacggcccggctggtagtacgaaatgcccattctcccacggcgacacgactgctcggtagactcatagaggccttttagtacagggagcaagataagttttcatactcggctactattatgcgctacactccaatcataaacgcaaataaactccaccctccaggtaatcagaacggcaggcactgcctttcgctatcattgtccagacctacgcccgatcccatcctcaactgtcatgatttatctcgctcattttgagcgagctcacgtgtagtcagcccgcgtatgcttggacgattgaacaacccctccaggtgtgcgcagagtgttggagcactacgcagggtcgacccatgtccttgcaacctgtaagcgcactgggcgcgcgagagtcggggggctataacctgaacgactcatctctgggtccctccaggcacatcgcaccctgtggtttagagggaagatgatatgcggtgtcctactatgaccgcactcagcccacattctcgaaggtgctcctaggtcgaagtccagccaatcgacgactaagggcgagcctagggtcatacagaatgcactaaatcactccgag

SEQ ID NO: 102361 - DNA, 1639 bp, Triticum aestivum
  Clone ID: PAT_TA_102361
gctagaatcgcgtaagcgcttctacggccgtacactggagatctagtccgctagtgtgtacgcgacatgagggtgcaaggttcagctgttgacaggcagcgataatgggcccgaatcgctgccggaacctaacgtccttatgcaggctagcgcagtgtagattacccctgagaattagacccaatggtcggacagtctttcctggacatgctcgaaacgccatgccaaccacaggttggcgctacgttttgtgaaaccggctggtcagcgatccccgaacgatccagcaggtgaatcaatgcccgagcgctgtggaaatccccggcttagatccatagcagaatcgtacgagtggacggtggcatatcctgcaatcttttctcactctcgacgaactacagtctcgatcacaaacccaatgggcatgcctcccaatgatgtatcctaactattagagtggaatatgttaaaggtgcactctatcagcgggagtttccgtgattattaaacctcctgaaactggtcgtgacggttaactccacgtccctcccttgcctcggatgcggcacccttcgcagcgctagccgtcaaatctcggttgagaatctacttccctaatgccaggacccaaatatgcaggtccctcttgtcaaaaggctacacaacataaaaaggtctaatcaactccgcaatttgaccgcagcccaacctgtgtccgtcgaatagtctctcgcgaagcattgctccccagatgggaggcctaaacgactgcctattctaggcttgcgatgcgagtctctgtaagactccctgtgcacgtgcctcatttactaggccgtcatcccactgtttgggtactgggtcctcgaacaacggagctgctccactcgaatcacacttgagcagtctcgatcaagtatgcatgcctagcctgcctgtactcatagtagatcagatgaaacagacttctttcacgtcgggagggatctgctagaagcgcgaaagagtaagtcgtgcgctagaggcgttgtaactcatgccggcactatataagagtggagcaattggctctgatcgtgtcgcgttgtgtaaccctgcacgccacgtaagatctcctgcgtgacgtaacgagttctgccgcgtcagacagttgagggaagggcgcgcggatgtggtgagcgctctcttccccgcattatctggtatagagcgtgatggatcgcaagatgccacttgtgaggtgcctactatgccatcctccccacataagtcggcacgtctaatggctgttcagccatctatgcgactgcgcaagcatccgacagggtgagcagccctgcgaatgctcggcttgactcaacgacgaactgtacaccggcggcaggtggctaactgtcttgcgacgcgcctgcctgaaggaactgtgtatgtcggaagcaatctaatgtcgcggaatttgagcgaggataaattcccaggtgagcactcgtctaaaaaccgtcgcattacatacgcaccagtaacgtgttagagagatacgatcgagacgttatgggtagctcgagcaggaagtactttcacgccatctatcccaaacagcacgcgcggataccactctcccgtagccccatatgcccgg

SEQ ID NO: 102362 - DNA, 2100 bp, Triticum aestivum
  Clone ID: PAT_TA_102362
atcccggagccatcgcgcagccgccaccccacgatccaactgcatgctaagcccgcccgcccatccatccggcattagcaatccagttcagacatgcgtagtctcatcagccgtccttgctccctcgaactacatccgacccgcctccgcactgacgcagtccgacctcgtaatccatccagcccctttaacgccattcctatgctcgcccctcagcccagccggccctccgtccgcctcgcacgccctcacgtactctaacccgtagctgcgttgactgactccatcgcgtgagacccgctggacagccggcccagcccggagcctccaactcatgaccccggaggcatagcacatctattgacggttcccagaatttcgcgacacttcaccccagtcccagcccatatcgcggccacccctgcgcatcaagatgcgatacactggcgtaactccactccctatacggcgatccgctgaacagcatctcaaaccaactcacggcgcccatcccgggtcccgacccccccattgctgcgaatccctccccctgaccaatccctttcgaccaaggcccgagccagcatggccccgtgcccttccccgcaacccacacgctttcgcgccccgcacatctggcatctaagagaatcgctataccggccgcggacatttcccctcgctgctacggcgctagcacgttcacgcgaatgctacccgagacacctgcccccagatcgccctaacacatacggtgccatcgccccccttccaacagccgtacaatccagtccaaccccgggactccacgccgctgaggcgcgcacgcgaagcggagcctgcggtgcccccaatcgtgttccacacgtcaggcacccttccctccccaacccccttccaggttgtactccaatacctcgcctattccgctccaggctacacttgccctaaatgacttcctggcgcatttcccctgcttgccgaagtcaccaaatgcccgccagccctcacccgaccgagaacttgccaacgtctctagggcaccccttccgttgccaacacccattccgtgaaatctctaccagccctcttcccccgccccatttcccggacccaggggacccgcgcccagatcttccgccaggttcaagcccaatgaatgcccacagcggcgcgccaaacgctagcctgcgccagactggccacaactgtcgcccctggctttccgccccacccccgcgaggacgccgcgtatccggctcctcccagccccttccagcctcaagcctcccaacgctcacacgtacccccacggacgcgctccccgtgcgccctgcgtctggcccgcccttcagacatgcgcttccgagcacccacccgcagctatgtgcccccccccccaagcccttctccaccatgccccttcctcctcaccgcgacaaccctcccccaaatctactccctcttccctttctggacctcctggcgaccacgccgccattccccccctccagacctcaacccgccaggagcctccgcctgcccgcgcaaacgcggcgtacatatcgcacaccttcatccccgtatcccccccgagaatcttcctgctcccgtacaccaacaccaatccgttcttcgcccttggttcccctgccacggtctctctccacgccatacgtacccccactgcacctcatcgctgggtcggggcacacccccccgcggtccgtctcaggccgctcagtgcgagaagccacgcgcccaacccggcgctgcccggccactcgtgccacgcctacagcttcccgcgccgcgcatcctgcccgactgccactcatcggcttctccacactccagcatcgcctcgacgccccccccgctgtgctcctccgggtcgccccgccccaaatgatacctctatccgctacccccgctagtcagctgccgtgccgtcccaagctccgccgtctgctaccaggacgtagcccgcaacgccgcgtaccacaaaagcgtcagaccccgcttgtgctcttctgccgcccccacctctccgcagcgcctctaagttcaccaccaacaagctccggggcccgtcgaacc

SEQ ID NO: 102363 - DNA, 1769 bp, Triticum aestivum
  Clone ID: PAT_TA_102363
aagctcggcgtattagtatcaatgacttcttgactgctacgcctatgcgtggatcgctttaggcttgatctggtccagcatcatcacgattaattatcgtgtggtaggcaagtatcggtgggattccgcgatgagggtgagagattaggccgtcatgttggtccaggactgcacggtgtaagggtgcgtcatcgtaaatcggcgtgcggttatcagcgatatacgtcctggatcgtggagccattcgaggtcgtcagctactattgcgctcattatcaacatgcaagcatcgcgaaagatctatggtaccggttagttatcgttcaggtgcgtgagttaggacaccgcctgagaggggacgttaagttatggagctaaattcggctgggttcgtcattagtcatccttatatgtagtttttgatgctggtgggtgacaacggccttaaaaatggatcggggtttcgagagcacctggacaggggagttggcaagttcggtggtggggatgtaacggtgtatcatgcatggttaggtacgtaccttccaagcatgcgtagcaaactcgattttggcatgccgtaatatagtttacacttaggtgggcgagacgtgggatcccttgtagactaaatgtccgtgtagcgcgtcaaatagtagtactcgtaaagttctagacctgggacgtcaagtttagtccgattggctcaagaggtttggagcagttgttgtgtaagtcgttaaactttgaagcctaggaaatgatcggggacgcggatgagcttattacagcgttacccgtattcgcacagggctaggctcataatcgagccggggggattcatagcgcggaagggacaggtattgagccggtcgactagacacgtctaaactagcactgttatgatagacgcatataagagcattggacagggagccgagagcgcgagcgaatactctgtgtataggtcatacaagatatgcgggcatggcgatacgtagaggacgggggcttgactctacttagacagtcccggctcgctacggaaattggtagtcacgaggataactggattaggaatgttgaactcgtacggggctggtagaatgggctctgaggaggcgcggtgaagcttgttatcggtggaaaggtcttatgaatcatatagctgcctcatgcgcggtgggagaatggtgagaggcattgtggtttggagtgttaattttggtatgcgtaagtggaggccaaaactacgctcgagtatcggcttataacataggatacgcatggcggagataagtcagacgtgtatagtgcgtgtccaatttttacagggatgttagagttaatgtctgcctggccttgttatgtaggacgtgtaagaggatgctaagcccttgcgtactatatacaggttccacaagagcgttgttcgacgggaaccgggtagatgcgaacgggactttcaaaagcatgcaacgtaggtgatagtcctgcgaaggagtgtagctaatggttggtacgtgggggcggaactgggctcccgtgagcaaagaatcgctggtgcagagttggtccgatagaacgttatgcaaccatgctagcgtgagaaacataagcgggtgattcggtgaaggagctcggtagttagtggggcgttgcagcttgtgagcgcgggcatgggatttaatgggggatctattcgattcgggaagaacacgaaagcttctggtggatactatgggcgctgtacagtatggagcggggag

SEQ ID NO: 102364 - DNA, 1733 bp, Triticum aestivum
  Clone ID: PAT_TA_102364
gccacgtagcaaaataggcgcaactagacgtagcctgcagctcaagaaacgaccgctaacaagaacgagtgctaaccacaggatcatatggacgataagcctaacaaggccgccaagaatcatacgacccattccggattacacgcaggcctacagtgaagagtcggtaacgacgccaccttccgatctgaattgaccatgtgaccatcagattcaaacttctaatggttaaagaacccatacagccggaatcactaatatatcaacccctctaccttaccagcaattgccaaatacggaatggcttcctggctaccaaacgctccaatctccggtaacatcaaaattcagaattactaagcaactccgggcaggcccatacctataaaccaagcaagcgaaacttcgaacaaaatcgagcttgcgcacttccttacccattccgaattcctcgcaaatcaaaagatcttaggatcatagacagcggccaaaacgctccattactggcgacttaagcgtaaaaaatggtactgaccaacattctcaaccaatagcatatcccactggaaacccctgaaactggtaatggaattgcccaacactgaagccacacgacaacgaatggcttaatacggaaattaaacccgtagttggggttatcgacctaaaatttctagtagattgactaataggttcccgggtcagacaactagcccttgaattttcggctcagaccaatcggcaattaatagatgaatccaaccaaaccatccacaaatcaactgagacagctaataagtgagtgtatttcatacgacggttccttacacaatatgaccctgcggtggagacactggatttactcatacgacaaggagcgatgacctactgtctagggaaggaacgaagcacataagtgccgacatgaaacggtagaaatggtcccaacggcatggaatgggaaaatactgaacctgattttaacggcttaaagggagtaaaaaatgttggtctaacaacggataaactaaagttacgagcccaactccgggaaatattctggaccattctgctacgtttgctgtgcgtttggcagcgccaaaaccggaaaaagcgagatacaatacagaaacgaaaatgaagccacagtaggataggtagtcaaagaggtgagattcgcgcaagcgaaaaacgcatcccaaacgccgcccactagagttaagggagtttaaaccgaacgaaatatcacgcaacgcgaaaatcccgtcgaatgtggagatagagtcgagacatagaaaggtgaaagaaaggtaaagcaccgcagccaattgaggacgcgaccgacgcaacattgcatcgccgcgtaagtagaacctaatctccggagaaagaaagagagaacaagaagccataagagaaaaatacgcgccgcgggagcctaaccataccctagattgaaatcgggcccgcgtaaatcgtaataactccttgagtgagccaacatcagagccaaagaataatcaatttcacaataccgtaacagattaagcacctgccgaacacacacagcaacaaaccaacatctcgaacctatagaacaggaaaggcgagaaatactaaggtgacgataagagtagaataagcgtacgtatctgcatgcacaagtgaataatagcttcaaagaataaaaacaccgaccaccaaaactggtaatgcaaaaaagctaaatcacg

SEQ ID NO: 102365 - DNA, 918 bp, Triticum aestivum
  Clone ID: PAT_TA_102365
ccccctacggagcatgcccagtataactaggcatgatcagggctcgttaggcaacctgccgaataaccatggatagtagtcatggcgcatcattagtgatactgatgcttcatcggcaagacggctcaccatcagacatcacagtcatggtcacgcattcctagttcgtgaggccttccggtactggctaagtcgtgggatgcagaactgcaaccggcaagcgctcaatggggactgactccgtgtgaaggggccctaggggaaccttcgggcagatctatcacggattcagcggtagctgaggcagtcagtaatctgagcacagattggtcttcaggagcgaatggtcccatcagtcaccatgccatgacagccaagaagtatccacctagtcaatgcaggcttgtggtgtgggatgaatcgtatggtatgccagccgacgcacgcatcgacgtcactcatgcctagctacgtaatcaaatagaggcagtctgagcaggaccctgctacgttcgcatgtgttttgacgagttgatcacaacgctatagtggacaccgtcttcacgcgtggatcggtacaaactaactgcagctcatagctggccactttttctcttaaaacgagagcggcgctagagtgtaggacgagttgaaataattcggtagcaagcctaaaaccgagctgatctactcgagattataacgaacgagccctttggaagtgaagcctaagtagtcccatgggggactggcgactctggcagcctcacactcagaggtcgacggaaagatagggcggctggacctatcctcggcttatgattaccggttgagcctgttcaaccaatgccgggtggtgtgtacctgctagacggaaaagctagcgccgttcccctcacggtccccaggataagagtc

SEQ ID NO: 102366 - DNA, 819 bp, Triticum aestivum
  Clone ID: PAT_TA_102366
gtgctatatagttacttttgtacctagctcagctgagcaggatcatcaactaaagcaagtaatctatatcatcacttgatatggatgataatctcacttacgtacgtgcctatgaacatcgtaccggcaatcggctgattaggggcccggccgcaattcttgctatggtgcgtataagaatgagtccgtcaatgaactaagcgttcggcacagcgaagtgacgaggaccggattacactcgcattgtgtgaaacgggtgatgttgtgagaggaaattatgagatctgatttgtatcggatcatataatatgtacccaggtagttttgaaactccgagaatcataaaacgttgtaggacgagaggaaattcaatacgttgtctgtgccgcgtcttgtcaatctttctgctagatctcgtcttccataataaatggtgtgttttacctagtctcatgtcatatagatgctccagtatagtaattgaatcttgtcgcgacaatgggcccagattcatttgcataagctgtaagatcgtgtgtactaggatcctagtagggcggtttgagtgagtctggctcacaatcggaaaggggagcttgtgagcgtacccgtatatgtgcgttgagatattatccagattagaagattatcggatgtttcaatacttgagcggtgttgagttgcagcgccactaatttactacatgatggatattctgtatgtgctggtatcagtacatgtcgcttctctcgtagtgtggctctttaagcgatcctccttttcatagtactctatctgatcaatcgtgagtagttttga

SEQ ID NO: 102367 - DNA, 2760 bp, Triticum aestivum
  Clone ID: PAT_TA_102367
gtcgcttgaacactgtcatgagggatccggacgactagccgttgcatgcgcttatctgaggttagaccgacctttagattccccccgcgatcatcttgaatgcaatttatcacagtagagcgctgcgtgctcgctgttgcttggacgcacgcttaacacccagactttcaagggttcgtcgatgtgcgcaagaccatctgagactcgaaaccgcatccagggccttcgctcacctgaacgtgacgcttgtactgacatgtcccgagatttcggcgcgaatccacgcagccatgagctatctcggattcacgatgtacgctttacacgtacgacatgtggactcaatgtcacgccaagccattcagacacccttgcgtctacccgcgctgattggcgcgatcggctctatcagaggctcctaacaggattaaggtaaatcgtgggacagctgcggcggcctaactgacagggggacaaccccttgagtgccgaaacgtttaagcccgcggattttggtggctggtgcgactttaaaagcggagtcctccgggcttcactgtttgctcggaagtaccggcgcatgaccttcgcgccaatccgcgctggaatcacacggtatagcgttaccacgcacttaccaggtctcaaggggccactttccaaaagccccgcccagttcgccaagagagcagtagcacatcgggcattacggtgcaatatgattacgcgacaacccgggagctaccggaggcgtgtcaagcgattccgctattgcaacatgcgacatttagggcccgctcatacgcccaggcacgcttggtttggacattgggacgctcgccgtgagatgtcgtcccccctagtgccgcatccaagtttacgaacggctgatctccagaccaccactcaagggcgtatttagggcagaagcgaatgacggactccctaaaggtagcccgaaggacccacgtacgcctacgtgtttctggtctgccgatacgctgtggatagcgggtgagcgcatccagtgtgtatttcataagccagacatgcctttggcaccctctgcaagccttggccgggtgtacctcccgagacccggagccgtggcacaggtatggacctctcagcaaccaccgacattactaggcgcccgagacaacttttaggaactggcgcacgattggatacatcgggtcgaaccgggcgatttcaatctgttgcctatgggcggagttgttacggaacgggaatctgcagcggcaaccccccctctgtgacagctaacacccgtggcgttcgacggagcgcttataggggctaaccaatggtccccggggtgctgctgggccgaggcaatttgtagtcggcatacgcgggcagcgtggccggtcagagggcgagtgggtgtctgtaacttgcggacgctactcactagctccgtaggagagggagtcctcggtctagtcaggtgagcaatacgggactgagctagcctcctgtgttagcataagagcgcgccacagacgtcgctattgcacgtagcagagcctcgcgagtcgcttcgtgttgccattacgctgtgtgcgcctccccccccgtactagagccggcgcatagctccatatagtgaactcgctcagtagtggatgcgcaggtgcacgtgcggatcatggcgcggccgcctaagacaacgtgtgcgttcggcatgaaccgcaaccgcacgggctggttaactcccgcattccctgagcgctcagctcgcgctcctgacgcctagttgctcctgctcttagcgattgtctacggtgctagcgacggctacgtacagctgctctgggtgcccggcgcggcgaatagcgtgatgttatggtgagggcgtcgggtagtactatcttgatgcggcacagcgctcagtgagccgcaaagcgtaagtcaggcggcattggagtatgacctcataggtgatgatgaggcacagtacgccgcaaagacacaataggcactaaaaagaactcactgtcgtatagttagtagtacctgatcacccgaaacacggaaagactgtccgatcccgcttgtggacccgactagtccaaccaaaagagcgacgactcgccgcatgtcggagattgcatcacgcatgtcacgacgtgtgcacatcgcgaatgatctgcatcggtgcgacagacattagagtattgatcgctctagtataaaagtgaacataagctcgcacggcgtatactaaaggtggtgtaggcgataccagcatgacgtcccattgtcacccccaggagagcagactgagctctcaccaaacattgataggtggcatcggcccgtctgagcatcgactgccacagatcaatgtcccgtaccacgatctgagacgagcactagtgcccagattcagctggtggatcgaagtgcgtctactctctgcgccagacgagctggtcgtcctctctgctagtagttgcggctattgccgtagcgcccccgcgcatacactctgtgggacagcgtgactctccatacgacgcgaatgagacctccagctctcggatgctaccgtatatccgctccctcttcgtagcctagggtctcgattgtatctatgtgcctgggcctgaaggtgcgatccgtgtccccgccacctcaaccggcacacgctcctcaacaacagtgtgacagcggcacactctgcgggttatccgtaggagatggttgtggactacacgagactccagcggttct

SEQ ID NO: 102368 - DNA, 628 bp, Triticum aestivum
  Clone ID: PAT_TA_102368
atgccatctaagttgcctaacatcgcctttcgtggagacgaatccactggcgtcggcgtggctccgggcttctagcctgatcgaatagcctggcttccgtcattgcaggccgatacacggagattatatatggtacgcgactactcttcaggcatcgttcgcctgttcgactatccagtcataatgatctgctcgacttctctagtcgcactatggcgctagactaagcttcccaggccctgcggtataaaggcagtctctcttagcagcgcattgttctaacatttcagtcgctctcaatagccatgggtcagcgttctcctatagctcatgccagtccctgcctgctggtagaattccatgtgcctgactagtcgttcctatcgcagtatgcgatttgcgctgatgggtcaggtactagaatgttctattgccgcataaagcctttgttcagctggtatattggattacaatcatcgatactacgttgcgcaccgtcgggattcgttgcccctccaggtgggttggcttccgatacgacgcaggccgactcgcgttttcccctactgtaacagtctcgctagggatagaacgcatactttacgtttcgtacgaggctagtgggtca

SEQ ID NO: 102369 - DNA, 521 bp, Triticum aestivum
  Clone ID: PAT_TA_102369
gtcggtatttgttttgtagacacctcacctaagttgcccaaagggtgtacatcgttagggatttgataggaaatgtaatcactactcaagtcgaggcacgaatctcgagttgttggggacgacgcgagccgaagctaaacttcgctggcatgggcaccacgacgatgcaggccgggaacctcgtggcctattacacacatcttggtcagaaagtgggctcacctgttgcatctctaggagggctcgagggtagccttgttttagtccattgccaggaggcctcattctacagggccagtggcatggaagtaggtaagcttgaaaccaacgaagaactcggagctcacttcgcgccgtactcatttgctgtcggctgttactacactgcatgccggcacgccaattggggcttgtgcggtcctggcgtcccaggacctcaggaggccgtctcggcactgctcccaagcttcgcgctcagttacgggtcatcatcagactcctagcaacacgttggacggcgg

SEQ ID NO: 102370 - DNA, 1212 bp, Triticum aestivum
  Clone ID: PAT_TA_102370
tcgatgataccagacattcattatacaacatccttccgtactgtatcactatgtagtaacataatccttcatagctcacatcaccatctaccatacttttttatgtttaacctttactttgccatttcaacacagtactactcttcaccgttacttatactttctttacattccagactcatttttctgtctaccctacgcctacttctgatatctcataggtactattgcggaatcttttatcatcgctgcttataattttttactcacctccatttcattcaatgaccgtgtacctataacactgccatcatttcgattgtcgctagatcacaattctatttttacctacggaaatgcattagttacatccttatctttgagtttcataaacaccatctattagatcgctcattcttcgatatccattcactttccatgacatcttagacccacttctaaccatataattattctacgatatcatcatatcttaataactactacgattttttctgggttatccacctaccatcatctaaagtcacaataaatttccttgtattatagatttacaattatgatggctgcatggtcaatctcttaaaatctttttcactttctataaagttactcctctaccatttggttattatattataaaccgtacatgttagtctactttgataaactcaaggcaattttacccttctattaaatatagccacaaggctgttaaaattagagcaagcaaagtactaaccttccgtaaacactatttctctatacagtaggatctatccataacgcactgatgttccacaactaattttgcacgatttatctattactattacgtaattcattccagtcactaaatatcttcttcatgaaatttcagattttccccatgacgagaattaaatatcgtaccacatcttatataattttttgcatttttgtataccaatatgattataattagtgtattgactatactttcattttccaaaatttcaaatacccctttctatttcaatgcatcatatccttctaaatttattcagtttacaagaacagctcttctcaatccataaatatattcatctctttttataatatagattactcatgctctcattacatacttctcacttaatattttaggcttccgtttactgttttatattgaatatattcgtattttatata

SEQ ID NO: 102371 - DNA, 1114 bp, Triticum aestivum
  Clone ID: PAT_TA_102371
gctgccggaatacgtagggctgaggctctacggcttccgacaatgagggctagtgtagggcaaccgcagattgggctaatgctgacagctgcctttccttgtagcggtaatcttgatgccttttgcgtctattataactgagataattgcaaagatgagcttgttcgacatgtccgagtgtttaggaattcattgtattctgactttcatcaaaggggtgacataggtgtgactgtgctctaggtgtcgtgcaatagtctcgggaagcgtgtgaggccctcgttggttagctataagagtcagggtttagaagtggagggttagggtctctgttgtggggggaagcggagagtccctacttcgtgtattcgatcgaggactggtgtctcttgtgatacgctatactggagagctggtcccgttaggctgtgtgtttgagtagttcagtggacggtgaacgctggacactaagaatagcatgtggtgcctggtatggtagacaggtggagctgatgattaacctgatgtaattgcgtgcggtatcactgtttctagagggcaatgcttgggagtgggggtgtgctgggatcggcagaggcatgcaaggggaagtctgtgaattgagcttagtaggcaatgacacaactagtggagcttgatgtttggtatgtactcagaggggtgagtcttgatccaagtgtgaacttgctgtggcgtcatagggaggagggctagatctacgtgcctcgcgtcctaggtaatcacttctgtaagggtggttgccgtcaatagcagaaggaggaggattgacgtgtcgagatacagtagctagtagtgcaactgctatgcgtttgggaatcatcttattcaggtcggagcatgagtgtatgaaggaccgtggagggtttattgcttcgactgcatagagtgatggagagtatgagttaagctcagcgtagagtgagataacagtccgttcagtagtatcctgtcttaagtgcgatagttagtggtcacggcttatatttgtgtcggccgctatgtctgctcttatgggaggaggcttaacggaggtagacgtcctctaacattgccttctaattgttacccgggg

SEQ ID NO: 102372 - DNA, 1008 bp, Triticum aestivum
  Clone ID: PAT_TA_102372
agatcgacatattaagacgtatcctcgggcaaacggataccacacgtgacacatacatacatgcggactgtacctctaaaatagtcatgatttagcactgtaaatagatggttgacgatttgtcaaagggaaagagcacggaggctcggcctctgaggaacatgtaaggaactctcccagcgagacatagtcagaacagatgaatctcaatcagacgcgagtacaaaccgtgtactatatgcagactacatcgaaatagagcatataccagcagggacgtctaaattgcagagtaaggcgatttatatgctgcttgcagtcctcttcgaaatggttaatccaacacatgtgaatccgatgagcgtccagtgaaggttacccggcgcagacgccgattatcccaatacagatcggtggtaagaaggaaaaattgctgacccgcaagcccaaagagtcgcgaacaatacaaacaatataaccagagagatctacaactgtaacattattcgtgaacaattttaggtcgatgtcccaaacatattacaaccaagcgatggtaataatactccaccatgtgtggtagatgcagccacacactaatcatcgattactaagcagtcacggatgtacttggtgacccatcacactgtaaacatgcaccagaaagcgcgaataaggtcctaaccgcacctgcaacagtaaggcgtggccagtaaccgagcctagagcattagagaggccaacgtcataagtagtaccgcgacgacggaaagacaagagacacagatcactattgtacagaataccggtgacagtaagagcgagttaaaaccatgtgaacgaaaagaatcaaaatagaccacccagcaaagatgacgcatgaaagaaacgcgcagtcctatacaatgggcggtcaacagtaccgacgtcgtacgcacgaagctctggcaaactatccaacaggacaccgcccacacgttcgagaatttggcacgcccgaactgccga

SEQ ID NO: 102373 - DNA, 326 bp, Triticum aestivum
  Clone ID: PAT_TA_102373
gacgatttcccactagagaacatagtcccattggttgcgtcacattataacgtgcagccccactcgtcgggtgcttggatcaagccgattcgagtcttctgaatgcagcgaacctttggtcacatgcatatctctgtggtaccaacattcaacctgaaccaatcacgcactttccgatacatcccaggaacgctcgcctagtccgcttgcgcagtcatcgaccgccttaagaatcgcttctcgagtctagcctgcgcgaggcgcacatcgatcgtatttcagcatggcagctcggggccggcagtatggctcaagagcgttaaaca

SEQ ID NO: 102374 - DNA, 627 bp, Triticum aestivum
  Clone ID: PAT_TA_102374
atgacttggctgtacgtccagcacttcgcactattcttctgttatcttataggtagatgcaagtttgctttaactccattgaccactcgtactgcaatttcgactttcgagaaaacttccaggtattactctggtcgagtatccaagtttggtacgattaacagtaaattggtaacctcgggcggacattcgatcaggagtttcagcgttcggggctaaggcatgggtttagctctgcattggagagtacggttcataaattccacactatggtggtagtcaaaaatgaaccgttaagctaaacttatttcgtggttagatggcaaaagggggaatttggagatgggtagtttgtcctaaggttcacgtcgcaaagttccagtcattccgcaatctttgtcgaaatacggtaactatagcgtagtgaatcgctcttcctagaatcacgtgagagtatgaaagactaaaactgtaagatggtcttcagggcactccggcacgaaaaattggggcccgagtattcccctagcagattcgttgtggatattaatccagcgaacacgcgaaatatgtgctgtggcgagtgttcggcttggggggcatcaacaaattagcagattgaggacg

SEQ ID NO: 102375 - DNA, 915 bp, Triticum aestivum
  Clone ID: PAT_TA_102375
gttgccagacaccaagtggttccgctctagaatgatatggcccggtgggattggcctgtcaccagcgcatgccaggtgctataggataccaaattgtccgttcgcggcgaacgtccttcactcattcaaatggacgttcgacatcactggctttcaagaggttaaacgtcacgactgtctcgtaagtctcgggcatgcgtacgtaactcggcacctggtatccgagtttcttctctttgaacctcggaagaagcgcagtgcccgagtgcaatgctagtctaggatagggtcagggttaaaaccgacccgaccgcatatagcctcgatttagaggacgatagtcggatgggcgcggttcgtacatttaactgctatctgtcgacatatactaatatggccaagtgaaattccgttgcactttaagaaacctaatttaccaagtggcataatataacacctttgagtactatatgcgatattccttctgtttgccaaggccgctaagtcgtaccaaagttatggcacaaaactgcgggacttggaacacagcgtgctgcggttctcaacagtgcattacgctaaagtaacacatgcctgcgactgagatatatttttctcgctcgctaccgagcgacatatcgctaatactcagatctgtccatagcgcgccggcggacgcgtccggggtattaacgcaagtggccctgaaggcggtatataaactgccgtggttgttccgggacctaacagcgctcccttctacgcctgatacctgcaaaatatcgcagggtgtcacgcgcgagcgcctcaggtcgtaccgctccaccatagaaggcttttccgtcagtttcccgcacaccgctttgggttcgatccgggctggcacatcccccagaagagggtctggttcgacgc

SEQ ID NO: 102376 - DNA, 533 bp, Triticum aestivum
  Clone ID: PAT_TA_102376
agcgccaccgccgcacctccaacgcgtcacgcagcgcctggatgcaccagtccacgcagcactacaagtccatacctgctgacagcaagcctgcctccgtccgtccagcttagcaaagcctctcctggtactcggtccacgcgctagtcctcctcgtccgactgctaatctctgctgcccgtgtctcctactagtacaccttgattaccatcacgccgtcgagaggctggccaaacaccccgaccaaacgccccctgagtgaaccgtctttcacctgcccgtcactaatctattcccaaccccctcctccgcgcttccccccccaggtctccagccccacgccgaattacctacatccttcagcctcagggccccgaccgcaacctctgctcaacccaccgcccgccggatctccattctacccccctatggcgttccgacacctacccaacacccaagctcccgctccccccagttcccacccggccttcgggccatcgcccctctccattcggcctacctactcgccccgg

SEQ ID NO: 102377 - DNA, 1139 bp, Triticum aestivum
  Clone ID: PAT_TA_102377
tacaactgatgcctacgcagttacgtcttaggtggtagtagtacacgggattggacgagcgatgatgcggtatggttcggaggcgtgtttgagtgctaggttctgtctaggcatggcggtagactagcggaggaagcctgattacggacaattgatggacttacggtggaagaggatcatacgaagaactattggtcgtatgacagtatgcatgcttggaacggctatgggaatgtcctatggagggcggagcgttatgcggggaatcagagattggcagctaaagagatgtcacaagtaggtgtttggcgttgactgactgccggagcaatgacgcggacagttgtcggcacggaatgtgaggtctgatgtctatgtcattaattagtggcaatctgtcgacgggtgagtagttgcgcgtgatatggcgcgtagtttaggggtaagatccttacgtagggtttacctctggtgtaatgctttggttaaagcgtaggcttttgccttgcataaggatccttgaaccggactcataggtggtgcaagaggagccatcgggaatgtgggataccggtaatccgagccatggtcggatacgtgtgccacattcgatcggcagaataagtttccagtgtgaaagagttgtaatatgttctattgttcactttagttcagattgggtgggtctagttgcgggaagaccggggatgtgtagtgggagattgcgtcgggaatcagaggtggcatggctgagaaggttgtggcgaaacctgtctgagggatagtggtggaacgtttggataagggtgattggggtctaagtgctgtgatcttgaatcgtaggatgatgctgttggatggtgtaaaagtgtcactaggttgttgtgcctagggttacatgtgggtggacctagagttgagtgattcagaagcatgtcccaatttcgcactgcaggggacgaggtttagactaacaggaagggtacgtcagacatttagtgaatattgtaagagcgttatgaggaagggtaccacttgtgagcaatgcgacgacgagtgtgagaccgtgggggtgaggtgcgccggtgagtgcggaggccagatccgacgagaatagagagatgtggagctcagcgtac

SEQ ID NO: 102378 - DNA, 358 bp, Triticum aestivum
  Clone ID: PAT_TA_102378
ccgggcatagattcgtattatacaaaaatgaaaggtaaactagtgaggacgacacaagaatgggcgttgagataagtgcgccaccaacaaaacgaaccatgtaagaagtgtaacttcaagtagtaacgtgaaatataggatcgtccgataatcccagtaatatgaaaaaagctttggagcaagacccgcaagattgacgatagaatcagtaatacgcagtacaaactgaataaacttgaaaagaacaaagcgagtgcgacacgggagacaagcacagggtctcgatctacgcttggagacacaagagattgaatcgaaaatagcatgaaggccagacgatatcctgccaatcccaaga

SEQ ID NO: 102379 - DNA, 343 bp, Triticum aestivum
  Clone ID: PAT_TA_102379
ccaccctgctgttattgggccgcgagtccgcgacaggatctggtcccgggcggagcggcacacacagccagatattatgtgatgatggaacataacaaggcgggatgagtcttatgcgagtgcctgatttggaacgcacgctgtcgggacagctaatagtgtccctaggggtgagtcatcaaacgcagatgtattcaatcgaccgattcggcgcgcaatctacgcatgaatccaaccatagaggagaaaagtctccgcgatctaacaatgcggatggtaacgacaatccggggtgaagtgtcgtgagtcatacaaatgaatgacaaatgacgtgcccgcaatc

SEQ ID NO: 102380 - DNA, 1615 bp, Triticum aestivum
  Clone ID: PAT_TA_102380
ctgacaaatctaggcatgggactggtacggtttgacttgcagggtttcagatagatccttttgctatgagaaagggacagcgatgttcgtaattcctggacgagttgtacaagtgaggtctagagtactactagtccttcttctcattaacccagtgttcaagtggtccggactggtattcgcgagttacagctatatcacgaactcggtttcttttcgtataggccgcagccctgtatcgcaagctggtggaacggaagcagttgctatagagcccggcggattcatcgtccttggtattgctgatggtattgatcagaactgtatgccaccatgcggcggttagcggaatccgtacgcttccgggcgctcctgtagaaacgcgtacatgattgatgtgagtacgacctaatgcgagtttctattagtagctactatattttccgagttagatcgcacctattatggccttactgtccgtggagtcttaagttaatgtcttccaagtcaacggggtatctgattagctcatgccccgattccttagtcacttaattttggttcgtgctcttcgcttggtgctggctccttcgtgctttagcatttagtgcaatgttgctaatgtggttacccctatgcagtttcccttgatgacaacggtccaagcgctttaatactggtgaaggtagctttgtacttcgtttatcttccgtgcttgcgtattgatgcatcatagcattaggttacagatgctatacccagtcatgacgatagatacggggcgcgactatcgctaatcaactttcagggcgtataatgtccgttcttatggcttcacgtgaccgctagcttagtagcctttatatcactgagactcgcgtttcgctgtatatctgagattccgggtattcgttagtatgtccttgtgttgtcatggatgtttggggtctgcgtctgcagtggagtcacgcatcccgatggaatgttgtacgttgcgatctgattggattgtcacgtttatgcccttctgccaccgtgtttgggtttctgtgttccgcacatggtcagacctgcgtgccactctgcgcctttatggccgtaagtggagtctctatctcctggtagacactgtttttcgtcctgttattgtttgaccggtataaagcgcactgatcgctatgaaactctattgacccaattgtcggaccctactctacgggccggccatgcccagttctctgtattttgtgatatgcacgcgggttgataacttctttacgcgggctagagtaattggctcgtttccgtttcaaagtcagtcttagcgggatcgggtgtatatctggtcgcgactctctaggctttttgcccttggttgggctatttgtgagaaagtcgcgagtgtttaaggtaagtgtcgcttagaggtcttttttttgtattcggacgttgcgtatggcatcgtggatggaggagcagggttgatgcaacttccaattaggatgtgcccttagccgattcgagtaaacctccgtggccgttctccatgcacctcggtgcgttttctgcgacctaacttccagcatccgttgaaagcacattttgacttatcctt

SEQ ID NO: 102381 - DNA, 241 bp, Triticum aestivum
  Clone ID: PAT_TA_102381
ctcgagattatgaaccaccagcctaatacgacatctaaagaatatcatcacaccgaaaccgttcagataacgactactgtattaacaaagatagtcaagtattactgataaggtatgtgatatagacctcatatgtacaagaactcagaagtaatgtgaaggttaccgaattaaaatataatcagcaaatttattttctgaatactaaaactgatagcacgtcaaattctgagatagcatc

SEQ ID NO: 102382 - DNA, 243 bp, Triticum aestivum
  Clone ID: PAT_TA_102382
aatgtcggaggagagtatgaggatcatctgtcatgtactggttggttgcttagtaagatcgattagggagcagtattggtctgtctcgcgttgtttaggacatacaccgtagcgtgacagcgaggattgcttattcgggatgaatttgtacctgggaggttaacaactgatttggcgtgtgtgacattaagtcgaggacttgttctgtttagaggccctctagtgagaatcgagactggagtc

SEQ ID NO: 102383 - DNA, 1474 bp, Triticum aestivum
  Clone ID: PAT_TA_102383
acaggaactggacccgatgcccagattagcaacaaagtaccgacgaagcataattcagacggactacgtataggctcggtcatcgcacgagaaactcctgacacaatcgtgaacgagctcatgttcaaactgagagcgtcaatcagaacacgatcaccacttcgcaaaagcattactggcttactgactactgtgtactgagtacagatccttacttagtcgtcattcgtgactcggccggtgttatgtgaaactactccatcttctacaacacgtcatggacgttaacgaggggcaacgattacgagaaacgaactgagagaaatagcgtaacgccacgaagaacaatgaattgaacgggacaagacaaagataatatcagcttatgatccatagaacacatttggcatgagaatctcgagactactttaataaactaacccgaacccgtgtactactccggttaaatcgagaaggagaaagctaggcagcgaatgagatagagatatcttcggaaaaagatggctgaaatgatcaaagacctaggatggcgaggcaaccaaacactacggcgacgaacgaacgtactaaagtaatcggctgtataagtcgtagcatgtagagaggggaccttaagaggtccaaagtacaagtcaagtgaaaacgtggcgactgcaagtgtcataagttacatagcaagagtcagcacaccgaacgaccagagaaagtcgctcagacaaagtgagggccaatgagacgaaagaacaaccaacatgcaacaacaggacgtagctggatatagccccgaataagtaaaatacactagggacacagttcataagagtcagtaaaaaccatgagaaatgataggaggtacccaagcacaatcaaactgagtgtaaaaaggagtgaaatgaacacagtaaagctttggggtgatgtagaaaacataaaacaccgacagacaccgagagaaacaagacccacaaaacacagccaatcaagaagcgaccctgaaagcgagtaccaagaagtgagcatgtacaggaggattcaacccacacttcaaaagactaacaggaccactcaactgcgagacgtcgatggccacgggacaccgatcctaacggaaccgtgtactatccccaggctaactttcctcgaactgagacataggaccagcaataggcttcataacgagagctttccaactgaagcgccacacagctacgaaaacacagggcatggcgaggccgcgcagggtcatggatatacacgagaatacaagctccacaaagcacaagtcggagaccccaagcaggagtctaaagaagaatgggaacaagccaaaagatgacgggctctagcaactataagaatgagggccaaaaaagtccaacgagatgaaggatgacgtatggcagtgatccgaacgaggcacactctcccaatgctatgtgcgttactacacgca

SEQ ID NO: 102384 - DNA, 553 bp, Triticum aestivum
  Clone ID: PAT_TA_102384
agcgcgcacgtgctcctgtcgctagttctccggattcaatcattgcatgcgacggacggcatgcacctggtcgcaagtcatccgcgtccggattcgcgattatatggctttccgcagacataattcgttataacgtcattcccaccgcgcaagcacttagagcactttcacatgggctgaccaatgcgccgctatgaaagctggctggtctgggatgttgcatctcttgggtttctctagtggggatgactgacgctgatatccctggccattgccgataactcgagacgtttccaacacagattctcagagggttagtaaccattacatgacttcgcggcatttgcgcctatctctcgatggtgggtatcctggaatcaaaatctgacgataacctctggatattgaagcggaagctccggtgaagtttagtccgctcaagtctttaaatacagctcgtatgccccctccagcacctttagtttccgttaatcccctagtggcatcgtactgctcagcggtgcatcatgcgggcacgcgtcggtctaggttt

SEQ ID NO: 102385 - DNA, 309 bp, Triticum aestivum
  Clone ID: PAT_TA_102385
agtagcagcactatacgcaatcgttcggcgggatcaactaagtcccgtacgaacgacgcggaacctatctctctacgtaactcgtcacccgccgattcaagtgccaggctctcgaaacagcttctgctaggcggtccaacagactacgcgacaatcaaatcaatagtgcgggagagtcttgtcgatcgctcttggcggaaggcaagggtttgtcgaagaccgttaaaggtaaaaaaccagtgaatttcctgacaattagctactaaacgtcttgagtatttacataaaggcgaaaatccaaagaagtcc

SEQ ID NO: 102386 - DNA, 1583 bp, Triticum aestivum
  Clone ID: PAT_TA_102386
caggtacaggccgaacatactgctcggcttgaagacgaatgcagccactggagtcgtcaatgacaaagtaaagctactgactacaagattcctcgaacaaatcgaatcgccggtaagcacctgctgcacgtgatgcccatcttaagtcacagagcgatgagcagacgaccgtaaataggaataatatcggaaaggtaaagattacgaaccggcaagggaccatccaaaaaattggttaggcgatccgcgactggacggtaaaccagacatggtacgcggaacgaggttcgagcccaagtcgtgatcaatgggcacctgttaagtgcggcaaagaacacaaaaggaagggacatgaactctaacttccgccaaaggcaaatcgtctaaagcaaatgggtgcatagcattggaatactcgcaagggaacagaatgggttcacatggcgctctcgaggaaatgtgagtcaagccacataagaataaggacgcacatttgctaattcctggcgaatcgtttacatcaaaagcggttattcactgcggaagggctgactccatctggatgatagaccaaatctaccccgcgagaatctaacatcagggctcaagtcatctgcgacagttaagcgttaatcccggagactcatcacccgcactagtgaaaaaagtcgtgcaaggaaccagaggggcaaatgggtacacgaggaaccccaaatctgcatattgtataggcccaccagcgcgacaaaccaaaatgtctttcccccggaggttagaagggcagaaacgctttgagcaattggtaaacgaggcgggtataagtaaacggacgtgttacaataaccaagatctgtttgactcaatgggagacacggacgagctagggacgaaggcggttaatgctattgggaaacacataacccaccaagaagatagatcaaacgacccaaatgaaagaaccatttgtgcagcgcacacaacgacgcaagcaaagtggtgggctctaaaatgtacccacccatcggctttatcgtcgattttgtgatattccacaaacaccgggaaagtgcctttcccggaccaccccctgatggataaaaaaaccgctaatccaacaagcgtggcaaaagactggctccagaaaacacatctttaatatagcgtcgtcagcggcaactgtaacgaaaaaaacacttgtccccttgtgtatgggtctcgactgaccgggtcacaagctgcagattctcggcgaacaccgcattaagagagcgaaagaaacttggcgaagcaaaaattcggtgggctagtgacaaacattaggagggctatagataaaatctgaaaatttacttgggagccaaaaatcttaccagtcctcattgcaacctagtgcgaaaaaaaataattggctctagaaatgggccgggggactagaggggaggaaccccctcgggcaccgctcaccaggaaaggaacgttacataatgcatgaaaaggcgagcaccaacgagacggacgcaccccggaggcgttaaagggtaccgtatgggggacacaccaaacacactaacccccatgtggaa

SEQ ID NO: 102387 - DNA, 757 bp, Triticum aestivum
  Clone ID: PAT_TA_102387
cccagcggtcgtcactgcgtctctgcttagtctttgcatcagcgtcagcaagatttatatcccatctcctagagtgctctgaacgagcgtaccgtgcacctaccggatacctatctgattccgggatgaatccatgcagacacggttgcgagttcttattaccgataaacattatttgaagcgcttagtacgaggacgtcgagcggcttcccttcactttaggtcttgccttagcgctattcgaagttttctaacatcacgctccgtgcatagccagcgctgtctcagtgcttcctaatccgagtatacctagctacgcctgcattatggttgaggaggggacgatggaacctcgttcaattcctattcaccaacggtaaacggacatgccgaacctgattaggtgaattcagtcgcggagagttgtctgggcttcacattgataagtcactttgcataataattgctgatagttacgtgctctgtctggactttggactgggatcggggcgtatgcatacgaattagtttcggttgttcccctaactgtagtggccgagcagccgggcagtcggattcaacacgtccgattgtgtccagaccggtacttagaactgttttattccgccattccagaaagtatattactggtgtctgtggtatagagcgttgaacatttgtggggtcggatagtgtgggacggttggggtaatttgtttgtctatctagcaactcaacatgagcttatgacctcgcc

SEQ ID NO: 102388 - DNA, 610 bp, Triticum aestivum
  Clone ID: PAT_TA_102388
tttttttgtgttctttttcacaggaagcgtttatttccaataaaaagtcacaagcatgttaaagggtgcaaaattaattgatgtagctcggaaaacagaatatttgctgctgtacctaaccgtgtgtacacgagcacgacgttagggtatctaaacagggaggtatcttggggcgaccgaaccatcaagctggcagacgacgggacccaacagggtcagaaattgaggggccagggagtcattcagcagacgatcgtgcgaggccacctcgagacaagtgaaacagcggagccggcccggatggtacctagggaccgaccccggcaggcgcgactgctaggtgccggaccgttcacccataacaagaccagtggttgtagaatctgtgttctacgccggtattgggtccggtgtgcagtcttgaaggaacggccagtcggacggcggggcaagcgtagggcggatagaagcggccggccagtcagctggggaggcacggttggggagggcgcgccgacagggcgggcactgcctaaaggcggacggcctcgcatggaaggaccgggaagcgttggcagtaccctagatttaggctgggttgccaagcagg

SEQ ID NO: 102389 - DNA, 630 bp, Triticum aestivum
  Clone ID: PAT_TA_102389
ccgttgctggtcgtttgacgcgtgtgcaccaagcagtacatgagcctaatattaaaaacttaaaacctactcgcaatccggatcaagtgccccagaatgcgaagaccagaccccttacacacacgcagcggcagaccgagttattctaccacacgacgtaatccttccgccatgcaagctcgacagtgcacagctcgatcgtgccggatcagagaatcaggctcaccccatagtattctacccgtacggaacgatcccaccactgagtcataatgttcgcggccatcccaccgtccccccgagacccgcaccgggcatatcagctccatgttaccccactcggccgcaccctcgcctctctgcgcagagcttcgcttcctcggccggttcccttcggagtgacgtccgttcacgtacctaccacagccttggcggaccatccccgggatcccgatagttcacgttactcaggtttggccaggttaccctcttcgccaagcgagtccccggcccacgtgccccgagcaaaccatcttctcaacttctaacgcggcgtgtatggcccgcgtgtcagcgggagggcccaagactttcggccaacactcccttccccagacaatatccgggcga

SEQ ID NO: 102390 - DNA, 633 bp, Triticum aestivum
  Clone ID: PAT_TA_102390
tcgcaaatgtcgccccctacccgatgatcgctataagctcacacgacggcttggctcctacatcaatacccctgaaccgtcaataagctttacgacgcgtgaccgaactgctagctcgacacgcctatgatctggctgctagttgcagaacatgcccgtcatcgcacgtcgtgagcgtgtttaggataccgatcctttcggtaccatatcgtacggtaccgcttaagtctgtattgcactctatctgacgcttgggattttactatcattgctcactccgtaccactgaatttacggtcaaaagttaggctaccggaacctgtccggccctttacccccccgtattacgcggtcattgtatcacagtctttgtttactattcatgtcgtccaagaaatcctacgattaatagtaccggatagatggtctaaaaagacgccagtaatcacgtgaggttctaagcggcgagcacttcgcgtttccctataggaactcgataccaggcgtgcgtcatgttgtctgtgaagtatgttgttcacagagttcgcacgcagtttaattggaaaagcctacaactcgtgcattgtgcttatggtcgtctaaaaacaaccttttaacccggtattgggctca

SEQ ID NO: 102391 - DNA, 641 bp, Triticum aestivum
  Clone ID: PAT_TA_102391
tttttttttttttttttttgcatacttatcatgtttgtactttaatcatggatctactacacgtatcaactcattttcaatttagacatattcacactaaaaaaattactacaaatcccctacaatcttaatattctagctgattaccacacatcaagatttcaatcaataacaataaggtatcaattcaaatatacacgaaagcaattttcaccaataattaattaaaataattaaattcccccggcattgcattttactacctataatcattactcaaccaatcccgagaatcttggacaacctttcatacccacttatcttccctcaaccattttcaaaatatttatttttattaattgaccaaaacatccacttttcatcatcaatttgtaacgtattttaaataccctacaattataaaagtttcaattatctccatttatattcttattactcacttcctgcctcctaccaaaatgcttaattcttctcttcattcgaaccctcacattgttttttgcaaatagttttatttccaattttttttaaaattctaaattccactttaatttatataaattcccaatttttggtaaaaaaatataaaccccttaaactatcgagtctctataatcttc

SEQ ID NO: 102392 - DNA, 1570 bp, Triticum aestivum
  Clone ID: PAT_TA_102392
accgccccacggcttcccgcacacctgtccccggatctaagcccgcgcctgccggcaagtagctaccccatcagccccgaggactctccatgtgcctacgccaccccactggccatcgcacgaccatagtcaggtccagcaccgcttcgccttgcgccaacagtctgccacacctctgcgccttacaagccccaccgccccctgacatcccgaccggctgccccactgatcgccccatgccgcgagcccgactatccgccaccgcctaccaacgcgccccacattccgcctcctggtccgaaccaggctatccaccggccctatccggctatcgacacctaccgggcacccgcgccggcacggcaccacggccccttgcatgccaccccaatcctctgcacgcgctgcctctttaccacctcctgccggaacagaccccgatgcacctccagaaccgccacgactcaaaggcgcaagttacccctcgcggaccgccccgatccgtgccccaagcccaactacgacgcgaccggccctcactcgcgaactcacgctatgccgacccccaataccgcttccaccgacagctgctgagcatacagcgtcccccgtgcaagcccccaatcccgtccttaatctcttggcgcacccccccggcccccacctgtccctcctccaccctcacgcacaccaacttaggcccctggctacgcacgttcctgcaccacgccacgactaaaccgaagccctcacccttccgccttcaatccgctcttaacgccccgcctacctcaccatacaggcctcagcctacccgcgtcccacatacccgacgcggcgatccaccagtccgctccaatcggtccccccggatcctgtcgccgccacagcgcccccccgccacccaaccccccgggggttcgccccgcccaaccgcgttccgtcccgccggcttacgccccctctgctaccgcggcacccccctccgtccccacactggcacgtcagcaccaccgccgctcgcatacccgctcggccccccacactttcccccggttttcacccggctcccttacccgtgacacctcccgtgccccgcccttgcgacccgccactctacttttcaaccactggcgccccgcaccatccttacgaccccccagacctatcccgggccttcgcctgcacccgggcccgatccccagaacctttggaacgctctgccagccacacttccccgcttcgtccgcccggcctacacgtgattctcccacctccgctctggccctattacgccccccccccagcaccctgtcccccatcgctgttcaccgatcgcgctcccgccgccagcagctcacgccattcgtaccacatgcgtctccgccccgaggtgcgtgccgacagtcgccccccctctcccggggccatcgactccctgctgtgccacccacaaacccccgccccccacccccgcggccccgtgacccacccccagggcctccggcccgcggcgcaccctccccggcctggtttcgagcgcctagcgagtacgcgcggcccgtcctat

SEQ ID NO: 102393 - DNA, 1251 bp, Triticum aestivum
  Clone ID: PAT_TA_102393
tgagtgctgacttagatcttatttggcatcaagtgtcacgaattcattaagggcagtgcagtgacataacgcagatgaaatttggtctccgcggcaatagcaattgccggttggacctccgacttcccatactgtatagcatagcattcgtggaagacgaattgacgcggcgtggagtagctttcactcggaagttagctagtaggatgatcgtaggcttaggtgtgtggcggagtagtaggcaggatcgttgactatgagggaagttgatgcgccagattactcgtgtttggtcgatgcagaattccgtgtatagagttaggaaccccacaaggttttcggctcttcatggactactggcaagtccggcattatattagattatgaatactccgaaggtggaaaggatatcaggtatcgtgtgctggctgtctgtcgggctagcttctggtgaggatgtgaaagcttggagcgacttctctatcaaagctgtgattcgttaatagactgactgagtccaggaacctttcgatccacttcagacactgaatggttcgcggtaatttagctcaaagcccgtgttcattatgtaccttttgggaacaatacattaacaaggtaatagcttgcgtatatttgaaactgtcccgctgtgtaatttcacagaattgcgtctaaaagggtcggactttcctagttctaagctttctgactatctcgaatttgccgcgtatccctgaaacgagggtggaacgcccggtattaggattaaagtagtccctgcagccctgctcttatattagggaagctatcatgtcattcagaggatcacagtgctcgttttttgtggcacgagtggcggtaatgcaacgtgcggtgtgcgctggggactgcacttaggtgtgccaatatcgtctaacgtaggaagctaggacgcgaccgggtgaaaaattgggatgtatatcgctttgttggaagcaaaaaggttagattctgcactaagcacatggacattgtgcgtgtgacgggtcgggtatcacattccttgtcggagagtagaagacgtagggattctacgctgggactcggaaggtggaagtcaccagtgcaaatccggctcgaaagctctccaagacacggcggagagtgcggagaaatcaatgtgcaagaagggataactagttatgtcaaggtaacactcagtctacgcatagtattaaccagactatctaggatactgtgactcgtata

SEQ ID NO: 102394 - DNA, 1448 bp, Triticum aestivum
  Clone ID: PAT_TA_102394
gcagtcgagctcggctacatgttctcggtcccaaagcgcagtaagattagattccggacaacgactgccctaggccaacgtatcgggttgaacaaaggaagagtagtgtcccctaaatgaatagttacatgcatgatgagcccgaagagattaccgaatgactacgtaaagagtgagtgtacggactacgcgagttcggagtaaactggagaaactgacggataggccctggagcgacataaaacttcaacaggtagcaccctgccaagagactgatgcacgaatcttgaagaacaatcgagccgtatgaccaagatgatctagcccttgtcactgacaaattaccacagggatggaagtaacccgagtagatattacgaaaggcacataacacccgcagctaacgctaatccacgacgccatatgacacacaggatccttcaattccggatcgttgccaccttatccccgaattgccacggtttcacgcacggaccatccaaagccgggactcttcgaggcagtggcggaaaatacgcgaactagacgaagcaatgacgccaaatcgaccctatgcccagggacttcaatagatcgaaccatgttctcgaagtgacgttctaccataccgatgcagtgcaagaagaagaccatggcactcagaatgcaaagagtgtctacctactaagactcataggactacacgagaaagcatcacagcgactgccaccgaaacgacctgacggtgagattaaggagtctgtagacgaccaactagaagcgatataatagagtgcaaaagggttgcgagagaaacggacgctcctaagcacctacgtacatagctccgacacttcacaaagacgagcatctctgattagttctacgctagatgaatccgtcggagtgttcagagcatcggaaaatacacgtgcaaaagagccaactaatcatgtaaacactgcgcgacaagctgggataccaacaaccatcggaaggagatcagccatatgctagctatagcaataaggccgagaaggcaacaggttacgattacgtcttaaggacctgccaagacacttgatattcgccagccgatgcctaaacaaaacacccagtagttctagttggtgcccacactaacgggccgagatcgcccgtagaacaatacgcatcataaggaatacctaaacccctgaggagacaataggatagggttccggctaaagctaacagggacggacatacacagtgtcgagaccgcaggcaacgcgaaaacaacggatgaagcaggtgtcaagaactaccgcgggaactatcaatgcttactagaagcagaagagaccgtctaattgtgagtcaaatgggaaagaacagcgcagagtgtgcacgcaatcagtcgaggacagatatcagaatacacagaacctctcgagtaatgccacacg

SEQ ID NO: 102395 - DNA, 403 bp, Triticum aestivum
  Clone ID: PAT_TA_102395
tagttcgatgggcgagatgcggggaggacgttgttgaataagcatcctaccagcttagctagcgaacgcaagcgtatccacgactacgacacgatccctggacatgcgaacactaccgaggttcggactacaaagatgcgacggggttttgcggcttagaggggataccggaggataatgaactgagatgggccgtatacgcaacgggtatcacctagttcacatatcgcaggccctgcataggctgacgggtaggaacagacggggtagaccccgggggctgagattgtgcacgtgggggtccgcgaattggacgcacactggcatacgaacgagtgaaccgggaacccgggtgaccgatattgcggaatgcctacgaccggcatcgggacctgagggatct

SEQ ID NO: 102396 - DNA, 328 bp, Triticum aestivum
  Clone ID: PAT_TA_102396
cacacgatcgcagccgtgacgcatcttgatacaatgttgctggtcggtgatgctccggggtagtgtgtaatctatgaccttcggatctgctgcacggcgccattgatgttggcttaatattgcgtactgcgtcgctggtttatcttcatgagggttatgcaccaacatggattacgtttaagtgtgccgggaatgcttggtcgacgctttgagtattcctatgattacgggttattacgatttcttgcgtaattatgttcgcctaatgatgagaacatgtttttataatgccagtgagtaactccatcctagtactgatagaggccag

SEQ ID NO: 102397 - DNA, 2266 bp, Triticum aestivum
  Clone ID: PAT_TA_102397
tcgctgggacgttggctcacctatctaggtagtgcaggcatcgaggcaccagggattttgatcgatgacacttggatgagacttgtgccgtcaagggcttattccggccaattcgggatgaacgggaatcctagataactgtccgatcgtgtccgattccgtgggtccaagtggtaagacagggctatcaagggttccgcgaaaatcgtcccaaggacttgtaagtcccccgggacacctgaccctgcaaatagccaagcgcgttttctggtaaaatccccagctcttaaaacctctatctggacgtgtggtcctcggcgatatatggctccagaggccctcgtgagggtttctctggtcaaatctggctgagtccttgggagattacctcggggtacagcttatggggcttttccctcgggagagcttccggcgaaagtgcgtgggacaccgccgatgaccacattaggggactatttaggagagagctattgcggccccatttaccatgggcgaccctttcgcgcttgtagggatgcctatcagcgcagtgtttttacaccggacccggaataggtggcacccaccagaacctttggcgggcccctggagtttttggagactccacctgtttcacacggtcctcatgtgagcccatggtgctaaccagcggggcccgtgtcccggtgggggagatccggctggcctcgcgaatcactcttctagtacggtcctgggtctgagcgggtcaccacccactaagtattgtgccggtgcaacataatgggctctttctcgcaggcttctgccgtttgtggaatgatgcacgctgtggtgtgaaaatacccgattgtgccctccccgcgacgtgagcctaattagtgggtgatgcctcacgtcaagtagtgaccaaatgatgggacgggtgatcgggcgaggcacttttttccgcccagaacaatgaggggtccgtgtatctggcgcggatttgtcctcgggaacccccacacctggggagacttctcggatctcccagccagaggaggctgcattggcccacaggcgagggggcgaccgcctgtagtggcgagcctgccgctgggatgctcttaaattgatagcgaagcgaaaatcttaacgtccgctccctgagctagcaagataatagtttgccacacttaggatacccacgtcgtgagggggtttacctcgatgtgccccgacgtcctcgatagtgttgtcgtcttgacccgagtaaagaagcggtcactagacgtgtaagttgatcagctggaccttgtgtgttagccatgtctggatgtgattacctggagcgccgctgcgggcttagtggtccaagttatgtgtcgggatgtgtacaagtcgccggaaaagacaagctgaactttctgtctcatactaaaaggttctagttcgcccgaacagcctgctttcttccccgaagaaaggttgggcctcctacatttaggaacagctcctatttagtgtcgagctccttcatcaacgatttgtctaataaccagcattattataagtgtacgcacctagtttttggcgaatgttatcaaacgcgtatgcgatagacacagtccgtttttgttcggcacatgagcttgctaacaataatcatgcggtctccccacaaccaaacgccggcgcaggttcccgtaagggcagatcaatttgtatcaaggaggtagcaggacctcacggagggctcgctccgctcagatattctaacatggtcccggcagcgctggtgaacccccagagctgcaacggacaattgcggcaagttaatggtgcgacagaaattgcggttccggggcgctaacaatgttagtcggatagcacctctgaggttttaatcgtaggaggtcgcgtccggatgtgtcgtgccgcccactcgctgaaacggtgtctccgcgaaagcgtaccctacaccccagtgatgtgatgctccgaccctcggtgcctgcattcacgcgcattggatggtgcttgtctaacaaagcgactgaagggtctccattgtgggatgacgcagaccaagaaatatatgatgttcatggccagctgggatctaccacaaaccgacttagctctccatcacccgagataaactcaagctaacgacgtcgctgggccccgagctctaggctgtggatactccgtcataagggtatgcttcgtcactcgacgatgcggtcgggagtcccatttccgagacgaacgcgcagattgt

SEQ ID NO: 102398 - DNA, 311 bp, Triticum aestivum
  Clone ID: PAT_TA_102398
ttttttttcctgttttgacgaacataactcatttattatttctgggagcatagctacggatcaggcgcagtaatgctccgtagtgatcattaggtaattcataagctcggcgaagcgtgatggatcagttggtcaggaaaataatagtctgctaacacccgagtggtcggtcccataatccactggtcaactggaaaatttcagctctgtagagcttagattgagagggatggaacttcaaggttggattttactatttcctgtgccgatctagtcagcagattgacatcactggcgatcacggtgacttc

SEQ ID NO: 102399 - DNA, 376 bp, Triticum aestivum
  Clone ID: PAT_TA_102399
tgtccgaccatattaatcacgagttcgataaaactcggccgagttttggagtttcgtacttccacgtctgccgaattctggcatcccaccttacaaccgccataccctagatttgggggttcttcaaatgcgatctaccctacgcctaacagtgagatccggacgggaatgagcccttacggttgtcgtccagaaggccaacggtacccgctaagcgcgttgcatctatgccctcagcttgacgcaaagacgtaccgtcccaacaagtagtgggcgtgtaaccttccggcggtaagctggcccatttcctcttccattgatgatacattatacgtctttctctaactcccgggataggcgcattgctgagcctccg

SEQ ID NO: 102400 - DNA, 558 bp, Triticum aestivum
  Clone ID: PAT_TA_102400
tcgtcagataatgagctaagtttgatcagcgattcagactggcgttatcccaagatcattacgctgaaattatcacatttatatcacacaaacagaaaactctctccttgtacctgattgcttgacattcgtccacccattctgactcatatagtccatgaatatcgttaacagctttcatattcagccagttttttctttttaggataatatattctcatatttattatgacttgatgattctaaacctatcacatgacgaaatttaatagcaaaaactcatgttcctttaactatccgatattatagttctacgttactcaagattgaaccttgtgaaatattaagatttcaggcacaaatccaacatctctataataatcgcagaccaaattcgtatcccattgtcaacatatactactattatttacaactctttactgataggattttataccaattactatgaatcagaatcacttaaactcactagctaaccccaaaagcacagattagattagtgttcgtatagtcataatgttgtgggatacttacgtt

SEQ ID NO: 102401 - DNA, 1169 bp, Triticum aestivum
  unsure (1)..(1169): unsure at all n locations
  Clone ID: PAT_TA_102401
cccgtaacaaatcgcaccggcccaccgcccgccaacggtccccgcagcccgctcagccaagcacgtccgttgcaccgctgcccgtcccacccgtangccgataacttagccacacaacgctgcggtgccacgctactgacattcgtcccgtacccgagtcacgagcctggcacggcccagtccgaccctgcgtaaccctggcacagacctcagcacgtacacccaagtccgtcaccctgtacactaccgcggcgcctgcgcgaatgtaccctcgcgacaaaccggtcccaggctcaaaattctagggccatggtgcataccccggaggcccgggatactcggtctcatcaccgccccggatccgtctaaagggggctccggtaccccccccacggccagatccctccccggagccattcggcctgcgtcccgcagtcggcgccccggtccccaaccccgggcgcacaagctatgccccctgctatcgcgctctatccgactccgcctcctccgcgcgcccctatccgccggggacctcacgctcaccgggcgcctccccccaacccgcccacacgttcgcccatacccttcccgccgggtcactgcgtacaggtcgcccccccaccgggtccacgagaccgacctctacccagccacacccaacctggcgcctcaaaactcccctcaggggccttccccgccgtcgccaagcgcgcggttcttgacgagggcacaaccttccgggccctcgatagtccgcggcacccctcttgggcggcccctgtctcccacaatccccaacctttgtgcggcaccgcatcagggcgcccccccccctgtcccgactcctgcggacccatgccatcaacaggatgtcggtgcgcggactccactaccgcgggcgccgccttttcacgagtgccctcggtccacgccgcacccacccgatcagccggcccccccgggtcacggcacccgcgacctctctcaactttcccctcccccgcagacaactaccgccctttgccgggcagccgatttcacccgcaatcctcccgcttggtaccacccctctccccaagaaacccacggggcctcctcttcctcccccaccgggcggcccccgtcgtcgcgttcaccttcttgcccccgcagacagcggccagcgc

SEQ ID NO: 102402 - DNA, 201 bp, Triticum aestivum
  Clone ID: PAT_TA_102402
ttgatggggaaaaaactagggattatataggccagacaggtgtcggaggtccgaatagaggctattatagtacacagaggacggattaggttggaagtaaagttatgtgggaggcagtgtcacgttgtaagttgtggtaggtgtatacggtgttgtatacgagtattggcctctggtctgtgtgtggcgctatgacaacga

SEQ ID NO: 102403 - DNA, 1759 bp, Triticum aestivum
  Clone ID: PAT_TA_102403
atcgctgcagtccgtaccgcataatgtacccagatagtgatcgtcgactccaggcatcagctaatggacagtcaactgcgagcagccatcaaagctttgggcctagggacatttgaacagtcatacaatcgtccagttggtgagatctaatcgttaggccttttgcggcttctcagaactaccatgattcacgttttcccacaataacagatctaatcccatgcacgtgtttctagtccacctgggccgaggtgtcacaaggtccggccgttatgttgaaaaagacatcgcaattaatgccagtgaatcataagtgtaaccatgtacccttgaaaatgccttggatcaatgcacaaggacgagaaaatacaggtcccccatgtactcacggcgtccatagttatgcgctaaaggccacggatcatcctctatcacacagtcccgtatacgctgttctcccggacatccattctaaagtacctagaccaaagttctaaccaataaccaaacatttgcttacccgaaaggaaacttagacccaaaccgttaaagccctggagccattcacccctcggtaagtgcacaatgaccaaaatcggactgtgtaaagcgttaaggcctcaaaatcatcaacgaataaactgacacaatgcaccagaagcgcactgggcgtcatgtaccaagcaacaaccgctatgctgacgagcctaataagatgagaacaggcataaaagctactgcaacaagcaacttaaaagatagaagtatagcctacacacctaggaccgccgctataacacagggcacaccccaatattgaaacaatcactttactcgctcactacaaacaattcgcttacaccctattacgcccgatgttcaataacaccccatacacacaaagtacgacttgtgagacaagaactctctggtactgttacttcatagtcttatgacgcacaaggaaattagatttgttttacactataaggccgtagcggagataaatacaaatcattcactacacaagtaagtatcatacacataacgatatgtcgaacacagacgcttgatgacgcagatcccccatccagagagagagcgcatagtccataaaataaaaacgcaatacggaacgttagcctgaccgaaaggacgtgattacagcttgagcaaacatcctataatagtaaaataacattaattttaacacactagcgcgcaaacaattgaacgaacggcggtatattaatctcgctttgcagcgtagaagcttcttgagaagattattctgaggataccatggcttacaacaattgtgtcggaaacacgcaacgacagagaaggttcggctggtagagtagctcctccgaccaagcattagttaaatttaaacgacactaaatgtgagcgccaagataggagcaccacgcacacaaaactaattcttagcctcctgaacgagaacaaatagctcgcgaaggcaagaagctctagaccgtagcgagtgagattacacactgcaaacaataacaccaccatcacagcgcaaatgaacgaattccgtaggcaacgacgcacaacctcaatggtcttagtataaggcgagctacttatgatcatggctagtgtgcaccgaccctcgcattccagatagcgtaaatggctagtaacgtattgacgtggaggtgctacagtaggagacatagagttccctcgttgctgagatatcacatgtacacatccacgtcgacaacaa

SEQ ID NO: 102404 - DNA, 924 bp, Triticum aestivum
  Clone ID: PAT_TA_102404
cagttagctagtcgaagctagtatcgaatgactatggctacgaacccgacgactacgtgcgactaccagcgaccttgctgcgattccgcacctgggtggactacgtccaagcgcgccggtacgaatcggcaagtcgaccaagcgcgcctagacaccgggtatctactccctagcccggactcagagctagtgccaactcactttgacgggtcactataccccgtcacaccagctaaggcttacggctgcagacgagcgtacacaattgccgccactcagcggtacgcttagagtacgcctctacgacgtaggtcccgatccacatcatacacgtccgtgcaggcccatacgggcttccgcagatttaaccgtagtcccttacgaccttcaagcgtactacggtaccggtaagagcaaaagccggcagataacgtgtcaagtttcctacgggacgagggccggcgcgacgcgcgtgtactgttgcttggtacgcaggcttaacacgctatgttgaccggtttcataccctgaccgcgatacctgtgtcgctcaccgtatttaagaaggccctgggaaccgagtaatcgcggctacaagccttcctggctataaccgtcaattcccgtccgttccgagctgtcagggttcggcatattaggtgcgcgtactagcacctcgtgtttcaaaacttctgaagtacctagctagtgtactcagcctcgagcccctcggggatggcggttttgcatgctatcctattgtcccggcttgccggttttaccgcttagcagctccgttcacgcgcttactgactttatctcgacagttgtagccctaaacttgttctcggttcgtctagtccgccattgcatttcctccggctcgaagggtcttcgcggcgggccgctaacgaatgttagaaga

SEQ ID NO: 102405 - DNA, 1101 bp, Triticum aestivum
  Clone ID: PAT_TA_102405
gtccatgttatagccatgttgaccctggatgaccagaccagatggtacctactcaataatgaccatgctgtaacgtgacttagcttaggtgaggcaagtactgtagcgttccaccatcgtttggtcctagtgatcaaccttttgcctgataggtgcttaatagtggctatcggttttcactctagagtggtaagccttgtgaaaagtgttacctaagtaagcgtttacggcaccttttgggagggtcaactgggcgcatcgcggtacatataggaaagcaagagcgttagacactacagggtcctatagttttggatttcggaagacccctcggagtttccaaggtgccgttattgattccctcaacttctcggattgacattctggtatgaggattaacttgcgggtcgggtttattggggtggacattaggaagcccaacggcctggtatgtgtgtacgcgttgggtatttgtcgagtcctctcgtgtgaagttgcgtagggtcacgtgagactgacgaagtcggcccatgtgtggagctttgtaatccggggggccaagtaaacgtggattttatcaacaccagaactggcgaaaaatcctgtgggaccggggctcaataaaaggaatttaccctcggtgagtgtctaagacataaaagtggcacttcgattgcctgctctaggattataggtgatcttctgtaggttggcaaatttggttaaatgcgcagttctttctagggtggtgggtaagttatgagaattagcgagaaggttggcagtccggtgcttgcggttttcgtcttgggatgtatcgacctcctacaagagcctgagtccccttggttcatcatttgtcagttatactgtatggactagaacgttgtgttgcttatccggtactaacgcatcggtaaaagtcctgaatgggtagcatcgatgaaagtatgttaattttggccatagctccgttctagcattgttcgccattgattatttacgagatttagcttgtagtcctcgttcacaatacgaactgtggcacactacaccggaagcgtctagtccggtatatatgcaggaattacaccagtatag

SEQ ID NO: 102406 - DNA, 243 bp, Triticum aestivum
  Clone ID: PAT_TA_102406
actatctcgtttcgttgtggtgatactcatttatggcgccttacaagttgcgaggagtcgcgtgtctgagggcagcgcagcattgcgagttggtctgagctatgtaggatcatctggattgaaattggagatgacgacacagtgatttagattggccggtagatagctgcatgttggcaccgtcgtaaaccaaggtacggggagcgcacctgtaccaaagagtatgctaggctattcacgtac

SEQ ID NO: 102407 - DNA, 627 bp, Triticum aestivum
  Clone ID: PAT_TA_102407
cattgtcaattgatgctatgtacttttgtgtaagtcgtgtcttttactgaacctttcagatatacgttacatcatataatcccctatcgctcactttaacctcgacgccatttactttcctgcccattagctaatcctaccaattcaccaacctactatcgacctctagtcacatcaaaaattaaatgttaagcccaaatttaaattgatactcttcttattgttaaaatttttcataacctactatcattatataaaaattttcgagctatcaccgcgcaaatcttattatgtaccctaaactttgcagtatttaattagtgaaattgatactccataaaatttctatacattcgccatctttatctatcctatgttgcttatttacttacatgttatatccttaaatggcaattatcaattcaagctccgtttattctttaattaatactttcattactgcacaatttaaatgttaactatcccatagattcattcatttctgatttcgtacccctactcgtcattcaattaagtacctcaattattttgttttattagacacaatgacaattacccataagctatggtttactccccaccacttttcatacttccaatgattat

SEQ ID NO: 102408 - DNA, 1099 bp, Triticum aestivum
  Clone ID: PAT_TA_102408
gtccgactcgacccgatgaccgctcgagtaggttgccacgccaatccacgaaagtacgaacgttgatcccccacctgcacaaccgaccacggtagcctgcgtgcagtgactctcctatccggcccggaatctattatcgaggcccgatctgccactgccacggtcaacctctccatgtcacatgcgtcatcgcactgggcacgactccccggctccattgctctcgagcccgcgcgaaccctgtctcccgtgccccctcccgccgcccggcaccctctaccgctccccctcagggccccgcgcaacctcggcctcgagcctattctatgccccacaccagtcccaacggcgtatcctcccgcccccattgctcactctttcgggccttgcgacctccagaaccgacgatcatacacctcgcccttaaggtgccctccctactgaggcctccaagtagccatggcgccctgagaccctcttaacgctggccctgagccctgctaggcccacgccgcttgccacccgctcctctgcgcattgattccaccgcggcacgccgaccgcacaccgcactccgaggaacctattcgctcgcactcgcccacatagacacccgatatccggccactgcccgcgaggcccctggctccctcccgttgcccctttcgcccaccacccttaccggcgcgtgcagggctcttgaccccgtccggtctctgccaccacggtcccctgcccgctcccaggccccgccagcctgaccctggcgactcttagttcccgactcccatcaaacagaggcccacaggcgcccgccgcgcgcttgactgccgtccccctcccgcgcgcacaccgcggcgcccgaccctcgacaccacccccgacccgcgacgcacccaacacaccatcggcgcgcccacgcccccactgaattctaccggtccctccatccaactatcattcccgcatacactcgcggtcccaggtccccgccccgagtcaccctccgccacatacccgcagcccctcatgcgcctggctggcatggccagcgcccctcctcccaccacatggcctaacccgcgcgccgccggccgag

SEQ ID NO: 102409 - DNA, 540 bp, Triticum aestivum
  Clone ID: PAT_TA_102409
gatcatgaggtattaccatcttgaaaaatataggttgagagtgatgatgctttgtatgagagtaaatagcggatgcgggtgttgcgatcgcgcatgcctacgacgtggtagtgtcgtgggcactggtgtcagttagcgttgcgggcgtccgagctgcgtgttgggtggataagactaacacaagggctccccgggcggagactggatgggtaggtggggaagtctgagggcgggttactgtgtagctttcgtggatggagagagtcatgcacataaatgcctagcgttggtcgtgggcccccggagcgtggatgcgcacgggtatgattggtcatggggtgccggtaacaagagaggtttggtggtttactcctgttgcttgtattcggtattgagaaggtgagcttgggcaattggtggttctatacgctctgggagtgatggagtcggggtagtcagtttaacaaacggcgtgggagtggggtatgattgacgggtgggaatgggtcttgggatgtgccactgtagtttggcggcggg

SEQ ID NO: 102410 - DNA, 360 bp, Triticum aestivum
  Clone ID: PAT_TA_102410
tcggaacggtagtaagcaccgggcaacttgtgttcgtgagaggttgttggaggcttcacacacgcagaagactgggatccatccgtccacctaagatgtttgaagattgaaacatcgagacaaagtaacagctctagcaagttatcaagcaaaccttggattattccactacgatcataaaggttccctactgagaacaaggtgataatcgcagagtcaagtcaagccactccgataagatctaaaactgaagggtgaacgatttattccgaggttgcgaggcccatggggcaaaaggtgtaaagaaactttgcgacaagttaaggactaggcagcgggcttgagtgtgggctacaagtc

SEQ ID NO: 102411 - DNA, 388 bp, Triticum aestivum
  Clone ID: PAT_TA_102411
tcttccgacaatggaggagcacacacaagactgtcgacacacctcacaactgggagttctgtaacacgacgtaagtactgagcatttacaagtcaaggaaggagaaacaatctatcaagggagaactccgagcgtgcggattgccggtttaactagtgccgcctccgaaacaccaaaggaccatccgcgaagaaataacgctacggtttagtttccccgggtttcaagccttttattgggtaaggcgggagggggcgatgggccgggcttttgagtggaccctggccgtcctttggttttgaaagcgggggaaattccgcctccctggtattggaattttcccctttggttggggtatagggaccgggccccggcgccaaaggggccc

SEQ ID NO: 102412 - DNA, 622 bp, Triticum aestivum
  Clone ID: PAT_TA_102412
ggtctttccgccgtagcctcgtactcatctcgcctgccgactgactgcgatacgcctacatgagcatcagcttcaccccatacatcaggcacgcttgcccgccgtatgtatttaccttcgtcccttccacctgccccggccccgcccgccgtaacgaatccaacggccgtggccattagaggaccgggtcaggcattcagggccagttagctggggtaagcggcggcgggccaggataaaccgagggagtagtggctcattgtgtcggggctattgggacaagggcggaagtcttaagttaaaagggttcggccaagtctaagtcggtacggttaagtggggtggctcaattaggtatgggtttcgttctttgtgggcagaaggggtagcctcggggtaggtactgcccgtcagatctgggacttgttgggagtttttggtggtaaggcgacgatagcttgggggttttccggtggaagctagagggtgttgtcaattcagctaacgctgagccgcggcgcgagtctacaaggcgtttttattgcactttcactccggaattgagcggtccagcgggtaaggccttacctctacattttgctgtcgaggatctatcttcttg

SEQ ID NO: 102413 - DNA, 297 bp, Triticum aestivum
  Clone ID: PAT_TA_102413
tcattacaactgtagctgtttcctagctagctaggctacggggcctgcaacgtaataaagtaaatcttattagtaccactgcgatggactcatgcggcccttatgccactcgtttattcacgggttacaagtcaatagggtaccccgaccccccgtgtacatgctgatgggagtaaacccgggactctactaatgacgtggctggcaaatggaaaaaaaaacaaataaccctaaccatgccccgttgcgattttatcactggaatggctcgagaacagggtggaaacgtaataaaag

SEQ ID NO: 102414 - DNA, 474 bp, Triticum aestivum
  Clone ID: PAT_TA_102414
ggtcttctcacgcgctgcgctcgatctcccctacgccctcccactgctgcggactcgctagcactcagccatagcctgtacccatacgatagccgacagcctgccagcgtcccgcttctctccctccgcccctgccgccctgccccgcccgccgcccgccgaacggacccaccgcgcccgtgccatcacgcgacccggcccagggactccgggccaagtggcttgcgcctcagggccgcccgggtcaggaactacccgcagaaggtgcggcctaatgttgttgggcctttggggccaacggccgtgcgctttcaagccaaaagcggtctcgcccagccaaagcgcttcccgtttcggtcgggcggccccattgcgcactagctccgcttccccgcgatgacaacgcaaggccccgcgggcggccccggccggctgcgggccgggccggactgggtgagtgcggccgtccgaggc

SEQ ID NO: 102415 - DNA, 368 bp, Triticum aestivum
  Clone ID: PAT_TA_102415
cttcattacaacgtgtactgtttcctagctagctaggctagcgggcatgcaatgtaataatgtaagacttcatatacccatgagatggtctctggttggcgctatggccatggttttatcaagggttaccagttcatacggctaccccgaaccctggtgtaatgcttgttgagatgagacccggaatttacctcacgaaaggggctggaagagggaaacaagaagaatttaccctaccataatccgccgtcgcagcttaccaatgtgctgttgggagggcggttggactggagaaaaaggagagtggaggaaccgattatatccagattgaaatcgtgcgttttgattggtagcttctgttacatccc

SEQ ID NO: 102416 - DNA, 270 bp, Triticum aestivum
  Clone ID: PAT_TA_102416
gaacacattgtgagctcaactcagcccccgtacgtcacatcaccgcgcacggaagggagatgtgcgaaggctggaacggtgttcgggacgcggtggccaaatccgtggatttggcagtccggtggaaccaactttcccttaaggcaatgacaaatgttggggaaattccgtatcgcgggaactacgggccaagaacggcaggaaagggtagtccccaaaggttgcataaaaagtacccgccgagggaagattgcaaaccccagacggccg

SEQ ID NO: 102417 - DNA, 154 bp, Triticum aestivum
  Clone ID: PAT_TA_102417
agtcttttcctttttcctctttttctttcattgattttagtttcattcaaagtcaacgaaacattttacagtcgtacattgagagtttagcaagttgccccaagcaataggtctgctgtgtctcggctttgccctttatgccggtctggtgcag

SEQ ID NO: 102418 - DNA, 599 bp, Triticum aestivum
  Clone ID: PAT_TA_102418
caccaatatttcattaccaaaataattcgatggtgtaagtctttgctactagttatttagcagttcacagcaggaaactaaagctgacacaccccctccctgtgacatctcaacctgaacagagtaaacactacaaccaccacaaggacatcctggcattcgtgccgctaagccaatcgatgaaatgaaattggaatctgaacttgacgaaattgcatccaccgacgacttgctgacgatggctcagccattgagggatttctccaacgaccctgaatagctttccttaaacagactgaaaaaagtaaaccggggcagaagtttgggaggccccttggctggggcggcagtgccgccctatcctgccgaggaactgaccttttgcactattggcaaacaagatggttccacttcagattggttttttcttgggggcttggggcggaactgcccctttggtttagcatcatgctgggggcccagatccatcccctcgatagcccgttttccgtttttttttgggaacggttgacggattatctgggaacaatggcaatgtttggcaagccccttttttgttatgccagctgtcgtttcta

SEQ ID NO: 102419 - DNA, 615 bp, Triticum aestivum
  Clone ID: PAT_TA_102419
ccgcagctccgaccccgacccctttcagtactaccatatcgccttgctcgaaaccctccgtcccatgggggcaccgcgaatagcggaagatcgggctccattgcggggcgaatcgtcccgggcccgccgaacggggcatagcggaggggaccggccctcaagcggcgcctacccggacggaacggttctatatccgggcaatccctaccttccagtgctgcccggctgcaagcagtcctaaacggcccgcattcgggaactaagcggttccgttggttccccggcctgcttcggcgcacagggccttcctagggagcggcgttccttgccacaggaaacttccttctatgccgttcaaccccgggccggtatgtccgggagccctaatccacgcctggcaatttaacttccccccaggcatgtagtacggcaccaggccacagctgcaagaactgtcgtcctcgggcttttgcattcgaaaggggggccgcataaatggattggccatgttaccggggattggaaactaatcatattccggcggtttgcccccacagcactatccgcttgaggtctgctgtttggattgcctaaccacaaatatagaactaagca

SEQ ID NO: 102420 - DNA, 689 bp, Triticum aestivum
  Clone ID: PAT_TA_102420
tctagcccccgctccggcttccagaagccttctcgagcggcgcacatgcgtccgggcctatcatcgcccggccctcgctcctccctttctccgccggccgccgggcctacccccgggcggcccgcacctccttacttcggcacgggctcggacaggctcgctctcaggcttcaagctctcaaacaaatctttcaacggaatcggaggtttgaaaccggcgtaaacgggagtgtgggctagcctgggtgggacgtgtcctgttggccggccgttgacattgcggggccaacgtggtaaaactacggcctgaactggtccgaatgtttgggagaagaaaagggggtcggtgaggggtgataccccttcaaatggggtgtggatcccgctgaccaatgggtcagcactgggcatccctgaagcgactggcgcggaaaccaaccgcaatgaaaatcgtgaggtactccggtcgtaaaggacgtctaaagttggcgcaaagaagcgaggcgggcaatctgcgccgtagagcctcatctaacacccgcaggtgcgtactgtccttcggtcatcctgttaattgcgaataacggtaaatgcttcgaaactccaaaccccagatcggatcgttacagtgaaaccgaaacggccgaatacaaggcaaacaggcttttaattggctataatccggccgc

SEQ ID NO: 102421 - DNA, 568 bp, Triticum aestivum
  Clone ID: PAT_TA_102421
caaagacaccccccacccctaccattcgcacagtcacgagcttgtcgttttcctccgcacaattacattaacatcagacagcaagaaaaatccgttccatcaaacgtgtccgctgtcccaaaattcgttcatggtttaacattcaggaaaccaaagtagaaagcaatctaagttgattcctgcgtaaatcggcttatgggtcgggtgttctgacgataatcacctaacgtaccgtcggctttgggggtcggatgcaagcgtggtctggggcacaatggtacgacctcccatcagatgccgggataaaacttcacgtttctcgcccgtcgggaagtggaccattccttctcaggaccccacgtagggcgttcacacaaataacccgtcacccgggtccgtccgcattcctgcgcaagcggggaaggttccccgcccatggtttccatggaagtgataagggggttttgaccccacgaattttcgcttggccacgtcagtgccgctcaggccccctgctatatttcaaccaaatagaacagtttcggagttgaggtcatttgcttagggt

SEQ ID NO: 102422 - DNA, 488 bp, Triticum aestivum
  Clone ID: PAT_TA_102422
catcctctcctacgccgacttctaccagctcgctggagtcgtcgccgtcgaggtgaccgggcgggacctgaggtccccttccaacccgggggagacagggacaatgcccgaatcacttcctccaggaacggccggtctttcctggatggctaccccaagggcatcctggaacaaccttcgagggcaagggtggtttatctcacgtccaggattgggggttttggagttggacccagcggacgaagttgcgtggccatctttttctggggtgggttcagcacccccatggaggaaaggaatgcccaaccaaaggggaaggatggggtcccggggccttgtgaggagtgggtgtggccttggggacactggctcaaaaacccccctttttgggatttctattctggaacaaaaacttcctttatcgtttgatgctggatgggctttcctcttttatgggtggggggggagggaaaagggggaaggggacc

SEQ ID NO: 102423 - DNA, 432 bp, Triticum aestivum
  unsure (1)..(432): unsure at all n locations
  Clone ID: PAT_TA_102423
cgnacgtacccgacacaatgacgaccgcctncagcctcaagcctatcgatcggtggcaagtcagtacctcgtgcgaccttggcttctacaggccatagcgactaccaaggctccctggtcctggatcctcatactccctcctcctcgcgctccctgttcctcctcatccgtactactgcccatcgctactcctcgctagtcctccgtccatcgctgctccctccctccttgtctctcaggctgctcgcggcactgcatctctccgttccgtcatgcctcgcctcccctgcctcgcgttgcctacctcccttccgctcagatctcgggccgcggtacctcgcgttcctgaccgtcctacctcacccatatttggcagtggtagcctccttacactcgcttgctgccctggcctccgcgcctacactgtcatgg

SEQ ID NO: 102424 - DNA, 412 bp, Triticum aestivum
  Clone ID: PAT_TA_102424
ccagctcttctgtcgcgctcgaagaaggctggcgcctggctccagcgatctcgggcctgagggaccgaggatggtgccgggcgatggcaccatggacctcgggcacggtcgggggttgcggcctaacggtgctaccgccacgaccggatcggacggtatccacggacctgaggtccgggttgcgcgggggctttccatggcctccaggggttcggacagccagaaaccccggcggtccggatgcctgggcccggggggccgggcccggaaccaggcccaaagggtgcgtagatcctaaagttcgaaagacccggtgaggctaacggctaaaacgaaaggaaaaatttctcagtttaacgatcgaagtcgccctcttttgcctggtttttctgtcccaggccgattcacttaa

SEQ ID NO: 102425 - DNA, 370 bp, Triticum aestivum
  Clone ID: PAT_TA_102425
acaagcagcacgcagacgtagtcgagcaataccgagctcacaactaacatagttatcgtatcgcggaagaggcgaacgatgattcgagtgatgcagtcctgcctgggtgcctcggctcctggttgagtcgcagggccgcagtgatgcctacgtcctgtaaccccgcagacgccaaccggaacgacctggacgatgtagcagggataagaaacgacggacttaatataaagattgggccatcttcgaagcattcaccccacccttgccggtttcagacctttatggacaaaacaaatccccgaagttctggccaccgcgatcccaagacatgagttgcctttacatactagtccggaattgccaactacac

SEQ ID NO: 102426 - DNA, 575 bp, Triticum aestivum
  Clone ID: PAT_TA_102426
ttccgcggtagaagtaatgtatactatatcggaataaagtgaattacacattaacaccaaagtgacatgggctcataaatcagtaactgcaaatacctattacaggaaccaggagcacggaggtagtaacatccacaatgcgaaggggcaagactttagcactaaaatccaaccttgtaaaatccacggataaagaggtgggaaaaccagacaaacaattatggttaagtaagggcacccgcggaagccgacgcataaaccacggaccttaacgagggaaaaggcaaaggtaccaaaaccagccggaaccgcccatgggcgatcctaaaggttgaatctgaagcaggactaggggacggggtgggtccggaatgggggtgggggttgaggccacccgagtgaggagctggggttggtagccattaggcgctaactggaggtgtgactcgggaccacttggcacgaaggggaaaaaagacagaaggagtgcaaagaccctaagtcgcacgccggcggttcaggacacacgaaccaaagatctaactgtgtagagcgaaaacggcatttgcaaagcc

SEQ ID NO: 102427 - DNA, 622 bp, Triticum aestivum
  Clone ID: PAT_TA_102427
cgcctccgtcgcctccctcgacggacagttcgtcctgacgctctacgacgtgcgcggtactacctggcgcccgggcggcctgagggcgtgtaggtcactgcggcgcagcgcagcgtgactgcctaacatctgcgcccttcctccttgcgacggcctttcggccttgccctcctgcctcgggctacgactgaagtcatgcaggccccaagccacgctagccggttggggggggccgcatctacattcgttattcggggcaaatgccgtccgggtcctgaactcgcgatatacttaagatcttgcagactaaatggtgcaaagcaagtcctattattcggactttcgagtcgacccttccaacgtgcggtatgtacgtgtcgaacgtcgtgacgttgaccttaactaaacgtccctacgggtccccctagaatcatccgcgcgtaaccgccagacgacgaatccgacgctaatgaaggccctgaagttgtgcataggatgcttgccgggggcgcgcctcggcctaatgccaattaaggcgtcggttaaaacacttatggggttgatgcgtgtttaattgggacctggggttcctgatccatcggatcagccgacatttatccta

SEQ ID NO: 102428 - DNA, 428 bp, Triticum aestivum
  Clone ID: PAT_TA_102428
ccgttgctgtcggcttgtgctgctgcttctgctggacactgcgtggtcgtcgtcctccttcgagcttattcggccgcctgcagcgagcggggcccttactaacgttgctctaaccggactgcaagcggccccagggatcagcgatcctctctcttttcgcgtcgtcaggaacggttcgaacctgtgtcctccgtcgcaacaaccaggctctacggttgctgaaaccgatctccattccaggccgtcacgccgaccagccgttctaagaagcgcccaagtgattaccgcctaggtccacgttgtctatggacagagtctttgtcaggtttggccggctcggccaagatgtcctgcccatctgcaggccgttgtcaattcgagatcattgtcttggctgtgtcccgttgtgtcttttcgacaactaaggg

SEQ ID NO: 102429 - DNA, 440 bp, Triticum aestivum
  Clone ID: PAT_TA_102429
agtacaggaatttccatccacaaagaattgacaatgaagtctcaccaaagaaatgaagtgaaccccatggccgcttgcagtgatttccatttccacagcagccagcagcagttccccgataatcgtgaaaccgcatctgcatgtgctgcagcaatacaagaggtgatagagtataaagacatggcggccccgacatgtccacccagagtaactccgggagcactcagggatttcctttggctggggttcggcgaaagacaggtgtgtgtcacaggatgctgcggggtggtatccgcgttaatggcaatggtttagcctggatctgtattatatatactgacgcttagggtatatatgcgtttcttctcgaccgtttccctatgtgaacacgggcttgttcgcaaatagcgtacagctgttgtgcctatattacggtctat

SEQ ID NO: 102430 - DNA, 804 bp, Triticum aestivum
  Clone ID: PAT_TA_102430
cggaactgcactgctacagcagaaagactagtcgctagtaaaagtctaatacaagaacgacctaatacaacaagcaatacatcgaacggatagaaatagcaagaaagaatcatgtcgacctaccgtatctgtgtgtaactccgacctcagaatcaggcaacagcaacgaccgggatacaacagccttagtggcacgctccggtactgtacccagacatcggttagaggggcgtctaaacgcgaagtacagcccaaacactccgagtgacacaatctatgtgagcaatgacaggatacatgcgcacgttcgaccatatgcccgcaactgagggggaatggggatagatctcgcgtacagattggagaggatgcagaattggggaactataccctgaacgacacatttgagacccgaaagttgcgcgaggctactgggccccgtgggcttgaacgtatgcgactttcagaggaaataacacgaggcccaagcacacggattatcgctaagctcggtaaatacgcaatatttgaccggggtatcaacacactttccacgatactcggaggtcaacaagaagccgattttagcgaccaactaacaaagaagcgagccatattaactaagtaatcccagcagatagctgaagcactatgagagaccaaaaagcagaagccttcaatacccggagaatgtgcacgggtccctcggagctaatattttaactgacaaatatgggctacactacatatgcacactgaactggactaccaacaatgagcttcaagagaccacatttggaaagt

SEQ ID NO: 102431 - DNA, 219 bp, Triticum aestivum
  Clone ID: PAT_TA_102431
ttgagtgtcggggaagcgcatagagtataggacgagagaggggcggatgggagggcgacagtagtgagggagctggacggcgttgggcgcccgagaccaggttactcgcgtagtaagcgatcccagagcggggccaccgtcgcgtgccaaagggtttgcaggtccactaggacgacggggacctgacttccggtactccaacagcccgcccgcggtccg

SEQ ID NO: 102432 - DNA, 101 bp, Triticum aestivum
  Clone ID: PAT_TA_102432
taaactttagatcctccagaaatgaagagcacaacacgaactgttcacattactccacagttgggagtccgtaaacataaggttaagttctttgaattgaa

SEQ ID NO: 102433 - DNA, 173 bp, Triticum aestivum
  Clone ID: PAT_TA_102433
gttactggtgcggtctgttctttacagtttcccactttacgacgttaaaatgtcggtaacctaggacatccgcaacttaatgaacaaccacattctaaacagcatctcggggccccatgacgcgatagaaaatcatagtgacaaacgcagaaaacgaagtccggcgtaagcgg

SEQ ID NO: 102434 - DNA, 99 bp, Triticum aestivum
  Clone ID: PAT_TA_102434
ccatcagcagccacagcaaaggggaccagctaagcgtttccagctcaaaggaccgctcaacgtctaacttcttgtgtctggcaagctaactgcctaccg

SEQ ID NO: 102435 - DNA, 269 bp, Triticum aestivum
  Clone ID: PAT_TA_102435
ccatgatgacctagtccccgggcgcgttggcctatcgctacctggcccggcaccacccggatcctcctgtccgccggtgagcgccatcttgatcgactgaccgaggcccatggcccgtcccggtccctaccccttaagactgcgatttgctgagccccggtgtccgtacaaggcccaccttgtcaccactttgaagtcagggtgtactttccctacgttcaagaaggaggctcttttgccgcttattccgccatattgccgacgcggaa

SEQ ID NO: 102436 - DNA, 160 bp, Triticum aestivum
  Clone ID: PAT_TA_102436
cctgcttgcatcgtccgcgcctcgctagcgacgaaagcaaggggtgccccctaacccaagagtcgaaagccctcacttccgaacgattcaggccaaacccacgcccccggcacctttgcttccccttgcccaaccagtcatacaccctaagacccgcgcc

SEQ ID NO: 102437 - DNA, 327 bp, Triticum aestivum
  Clone ID: PAT_TA_102437
tcattctacaatgtagtagcacatcacaactgatcacagcactgcacactggcagtcttcaacgacacggtaggtgctggcattccagtccagtgcaaatagacattccttcaagggaaaaatccgtaacaggcggtaaggccggttatttagagcgcctccggaacccaaaccacaattcaacgaaaggtaaggcgcggttgaaatgcccggaattcaatcttatgtgggtttgacgggaatgtcgaagtgtgcgggcccattaagggaaacttgactccccttgtctgtaaaagaggggtaatcgtctccgctgtgtatgattcc

SEQ ID NO: 102438 - DNA, 811 bp, Triticum aestivum
  Clone ID: PAT_TA_102438
catagctgtttgcctgtgtgaagattgtctatccgctcacaagtcccacacaaacaatacgagccgggaagcagtacaggtggtagaggccttggcggttgcctaagtggaggttgaggctaaacttcccaatttaacttaggccgtttgcggctcaactggcccccgctgttcccagttcctgaggaaaacccttggtcggttgaccaagcctggcattgcgaattgaactccggtgccagccgcctgcagggggacggaagggcggggttttgcgattagtttggggcccggctccctttcccaggctctagccttacgcatccaacttagccttccggggatggaggtatccggagctcggtttccgtggcctagcctgggtggaagcccggcgtaagtctcaagccttccgcccgtgcattaatgggtcccgggtaaacttacccctggtttaatgtcccaccgttgaagaatgctaacctagggcgctaaacacagtgtatggaaacaaccggtaccaagcgggcggggggccgattacaaaggggcccagagtccgcattcaaatggtgcccatagatgcaaacatcttgtgaaataaacacatcgcgttcctgcaaggatcccccccatcggcgccctgtagcgtttaccgaagcaactcgcgacgagcagagcatgcgaccccctttctgtccgtcagtcgcaaagccggggtccaagaaccagccccacgggttttgccgcgtaaaggggctctatgcaacgcggctctgtgccggaaaaaaccggttcaagcacacatcag

SEQ ID NO: 102439 - DNA, 325 bp, Triticum aestivum
  Clone ID: PAT_TA_102439
caacgtcgtgacgtgggaaatacgctggcgttcacccaacttaatcgccttgcagcaccatccccccgttcgcccatcctggccgtaagtacgcgacagagggccccgcacccgaatcgccccttccgcaaccaggtttgtcgccacgcttgacattggcagaaatcggccgccgttgaatgaccggtaatttctctcccgttaacgtcagtcctggttgccgtgtaattgttcagtacctgcgtataatctgcctgcaacctcctgccagctagagaactcctggcatccttaaatggaccggcaattatagtcagaagagcta

SEQ ID NO: 102440 - DNA, 610 bp, Triticum aestivum
  Clone ID: PAT_TA_102440
ttttttttttgttttttttttttttttatggccatcatggaccgaaggaatgctgcaacgggcggaaccatttttataaatcaaacggataccatacattttggtatcggacgggggggaatttcaaagttcaagcaaagtaacccatggcgggacaatacaatggaagttgattcaaataacttgcgttcaagcccaactgattaacattgattaggatggggcataaggggaagggaaacataaagtgagcgaacctccccgggccaacggccgacaaaccgcccaaacaaaacccaaagggaccaaaataattttggaccgcttttgacggacgggaggaagtttggccccgggggttaggtttggaggcaattcgcagtcgccaaaaaaaggaagtcctttgatatagccctaatcttgaaagttcatgcctacggcgaagctccggaggaaactacttagcaaggttgttcctggaaaagccgcacgctaacggccgacaaaggaagaaatacgacgatgtcgtaagcgggaaaaaataaaacgcgcgccacacgcttataaaggatacgcacaaacacagagcgtggacgccacccaacggcgg

SEQ ID NO: 102441 - DNA, 293 bp, Triticum aestivum
  Clone ID: PAT_TA_102441
cgccttccgctcttgcgatggcttccagctccgtgcttaagatggccgccgttttcaatgctgtccctatatcgcttggccatggcgctgatcggctactgccgggcggacggaagaaagggactagggtaagctcgggcaaaaagctttttgggaggaatgtattgaattgagaacgcaaattgttcggcggattaacagccacaatggcaataatttgtaatggctatctaacccaaagttttctttccaacgtttctcggcattccatctttacatggccctcggttagc

SEQ ID NO: 102442 - DNA, 1389 bp, Triticum aestivum
  Clone ID: PAT_TA_102442
cccgcaacagacgcggctcagcccctcgcaccgttcgtggcatgcaccacctcctgccgctgtcatactcgacccgttcgcctcccccgcatacgagctacccatcctgcttgaccgcttcttgctaccctgtcgcttcctacccagcccgaccgttccaatacccttccagctgttccaccacctcgatcatccgctccttcgcttgaacttcgaccgtcgcctcgggcccatcccccccccaagttccaccgcgtatacccctcccgaacctccaaggtgcaccgtgtggcacccagttatttcccgctagggcccctgaaatttgccgaagcccctctgtccccgagatcctcaccacgtttcactttcgggaatcccgcaaaccccgctctctctggccagcaatctataccccaaatggcctagcccaaaggggccgccttaacgggcccctttgcggctgaaatcctaatggcgcttaaggcccgcaaccatcctccctaccccacaacctgcacatctgccacgggctccaacagggcgccccacaaggcctccaaaaggcggaaccatccgccccaaaaacccgcgcggtcataccctcgcgctacccaacaaggccccacctcttaaaaccccaagagtgcttctataccagctcggcctctatgggttgaccaaccaagtccagaacaggcgcggcctacgggaccacaatcgggcacactctgctcggccccctctaccacctccgaaaattaccccacaattgcccgcataagcctcccccctttttccccccccgaactgcgtgccccgggcccccgcgagggcccttccgctcgccataagccagacgggcgttctccgaaagggtcccccccccgaaatgctttccggaccctcacattcccggaccacttttttcccccggcacgccgcgattttcgcccacacgccgcccgtaccccccagtccccgggcacctccccgccgtggcgggcacccccgtcccccaactcaaccccctgttaccccgcgcccccacccccggggcgtttccccgccctcggccccttttaggggtgccgcccccttctcgcgcttccggattagaggccccccaaacttcccccctcgcccacccaagcggcgcggcacacacccaccccggccctaaaccccctgccggaacggcccaaatccccgcgccttaccaccccggcggcgcgggcggccccattatccgctggccgggcctttgcaccctaggggggctggcttcgcaccggcctttccctaacacggcaccgccccgggacgccccgcccgcggccctcctttccacgcgcctcaccggatcgacgggccgctcccccacgccgg

SEQ ID NO: 102443 - DNA, 423 bp, Triticum aestivum
  Clone ID: PAT_TA_102443
ccagtggcgtccagagcggatcctcagaggatgctcaaaggaccctgcagatgggatccccccatcctccctggcaggcgccgagtcactgtggtcggaaagaatactagttccaactgagcaatgccgaacgactcaataggggtccagtcccggaaaaggcccaatagtagccttggttgggttgtaatttttttggatttaactagattcaactgtccgcctccgaagaaccaaagcccattgtccaaggcccaaatgcaatgcgatttgggacttttaaaaaagcaaaaagggtgtgttccccaaaccctaaaataagtcacatgcttgcaaattggggcaaagcaagttctagctcccttgaatttagcgctttgcggatataatgtccaagccgggtgccacccctgggcagttgtg

SEQ ID NO: 102444 - DNA, 572 bp, Triticum aestivum
  Clone ID: PAT_TA_102444
agtggctggaaattaaatgcttagctgcttgctttgtgtgtgccttgattctctctctctctctctctctctgcgacagcaacgggcattcgtaaatcatgggtcatagctgtttccgttgtgtgagcaattgttcatccagctccaaaattcccacaagacaatacggaggccggaagccgttatagtgttaaaggccttggggtggcctaatggagcttgcacctaaactccaccatttaaattgccgtttgcgcctccacctgaccccggctttttcaagtccgggggaaaaccctggtcgggtagctccgacctgcccaattaaatggcacatcgggggcctaacggccgcggggggaaggagggcggggttttcgtcgattgaattcggggcggccttccttcccgtcttttgcctccggcttcccaatggcacgtccgcccgtccggcctccgggggccgggtttcggggccgtggggggcggaggcggggggttaccccaggctcccaacttgcaactgcgctctgggctaaactctggagccgtctgctaaccgcccgactacc

SEQ ID NO: 102445 - DNA, 125 bp, Triticum aestivum
  Clone ID: PAT_TA_102445
gcctgccacagcctcccccagattctagaactaaacttcccggccctagcttcttgacctacggtccccgcgacgtcgcacagagctaacactatacagacaccacggcacaccaccgagccgcg

SEQ ID NO: 102446 - DNA, 388 bp, Triticum aestivum
  Clone ID: PAT_TA_102446
gccgcagcctgctgcaagactcaggtggtgggatggcagcaagtacgcagctagccgatgaacacgactcgcatgcaccaccaatcgagctgaagagcagcatcttatcgatttctgacttgaaggccgtgcggcatgacgttctgtaatcttccatgttcaaccactggatcgttcgggctcagcctgaggtaagcgtagttctttctagttaccttgaaacaatccatggatgcgatagttgcctactccggcgccaatcggaaatgtcagtcgcgtgtcgtaaccactgagatttgtttgctgagttttgtggggactgtatttttaaggttcaaagattctgaattgaccgacagccagagtaccccgatgagggcttcggagt

SEQ ID NO: 102447 - DNA, 668 bp, Triticum aestivum
  Clone ID: PAT_TA_102447
ccgttgctgtcgctctcttagaagttcgagatgtggtcatgggtggattaagctgtataagttgcaggggtgcggttctcaaactatgatggtattgcactggggctttgggttgggcggttgtcacggggccagcggcagttcccgagtttgcaaacccagaatttaccttggccagtacctttgcttgagagtcatgtggggggtctggatctaggcttacccaatttgccgggatggtgggggtggtatttctgaaccatgaattgtaggcattacgccgattgcaaaaaaggatagaattgaaacaaaattgacggcaaggtgtagctacggttgccatttggatgtttttaattcaacgcaatgaattttataaagctgtgaaggaatttggcaggaaggaaattttcggcgctctttaccaaggttcatggggagagtttccatcgttaaggggttttgacttggttggtattctactcgaggtttccagcggcacctttccatagaaatggttttggcgttttcggggagtttccttgcggctttggtttgtttgggcctttcaggggagatccgcggaaatcctgtatcgcccagttttgggaaagcccttggttccaacgggcctgcgtctccccttctggcctcggctgcacctccct

SEQ ID NO: 102448 - DNA, 661 bp, Triticum aestivum
  Clone ID: PAT_TA_102448
cacatactcctacaacgaatttcgtctgtgctagtttcggagtctccgtccgcgagccaactcacgccaccacacaagcgttgtattaccagattctccggtgggaagttaatattcaaaatgacaaattttgtcaacgtgctgtggccaccaaaacctgtggaggcttaacgggggcagatcattaaaagttcaatatggttttgcatgagtaacttcatccctgtattcagcagaaacgcttgaagaccctcaagttaacattgcttggatcctaatttaggcgtcttcaaacttagggatttgtttcacttgttgttaaggagaattcactctggcattcaattggctacaaaaacccatcatgtaaaagccagcctttcaaattctatcccgataaacggaaaaacctttaaaaccgtttactaatgcactgaaagattttgggggacggctaaaggttaaatcgaccgaggtaaagggaaaattgcaagttgtgaatgagctccaaggaaaataacaactagcaactcattggcgacccggcttgaaaaccacacgccccccaggttttcattaagggttttaaaaccgtccccaaagtttaggcaaacgcagtgttattcaagagttcgctggttaggggttgttgaggccggct

SEQ ID NO: 102449 - DNA, 737 bp, Triticum aestivum
  Clone ID: PAT_TA_102449
gtttcttttttgttttttttttttttttcagaggtccaacagcttttataaagggcagggacacgatggctatggcaaactgagtttttatcctgtcgatctactaattttacaaacttggggacaacgagaataggaagactccgggtaacctaagtttttgcatttgaccgcccgcggcgtggacccacggaaagtaatgtgaatgaaaagggaaagcaagcaaataacctgcccctggtccgaataccaaagaccctgtaaagaaggaaagaatggacaatcccaaatggaaccagggcccggctcactacccacgaaccccgcctcggggatggaatcgacttcggaaattggtcccggccatggttacccgtagggccagcacgtaaggcctaacggccagacctaagattgagcatcagcttcccaaatcggaatcacgtatcaacctcgtatatgtaggaagccctcggcgggttgaactgcggttaaaactgcacgggcctaagtgtgatcctgaatgcaccgaagggccaaaatccacgacccaaaaacgaaagtgtccgacaccatacccgaaatgtaaccccgacaagaaaatctagagaccaaggccctacgtaaccgccccacacctccatattgcccctaaggccgaacccgaagacgcaggccactaaaatcggggcgagccctctcggtcgaaccggacaaccccggtggcctggacacgc

SEQ ID NO: 102450 - DNA, 281 bp, Triticum aestivum
  Clone ID: PAT_TA_102450
cgtagcatctgtaaattatgctattcagcatggctactagcggtgctatgtaggcgagacagttgatagcactggattttatttcaacggagacgaattttaccaccacggctataagcgccctgtattgtttcgaatgtggctaacaactccgcctcttgggtccctgacaagaatacggggcccctctgggaaaagggtccaactctagcggaacgggcagggggtcggaataaataaattccgggcggggaaaaaaggttaaatccgggggggaaagg

SEQ ID NO: 102451 - DNA, 933 bp, Triticum aestivum
  Clone ID: PAT_TA_102451
tcagccagaatgcacccttcatagctatcttgatcaatagacatagcaaaccagttaaattacaacactgaatgcatcactgaaccactaagacgtgccaaagaccctctagatgcagacgatttaaggcaaccatattgaggagaaccagtgcagcagaataagtccgataagggattccactagcaaaacggaaaagcccatacgggaaacagaacagattcccacggccacttaaacatttacactactggactactatcgaaagtaaaagaccgacgcaaaccaaagacaatacccttgaaaaacgtcccgcaaagatggttcaacgcctagctcaccgcagtgcaatcacagggaacataacagtctaacactaagatacacgaagatattgaggttttagaagggaacaaggcgcccaaacgcaaagcacctattgggcacagttcggaaacacttcaaaaccaacccattcagaagcggcacaacggataccaaaggacttattgcatcgcccgaaagacgcccaatagaggatccgagtccgcagaaaaacgttaaaacgaaccaccggtggagcgaatcaaacagagcccaaaattcgcagcggttaattcctaaaccgcagggcgaggaacttgaaagatcatgccctcatctggccacgcgcggacaagagataggcacaaggcagacaccaggatataaccgagtagctgagagggagggaaccacaatttaagcgtaacacattacagaccacagagtcagcgacccaacatatggaagccacgtggcccagtacggcatctggaggccttactggcaacacaggaaaaaaatcactaaaaacaaaattcaaagtccgtaagaagctccaaaggtacgtgtcaacgacagtgtgaatattaagcgtccgtatggagcaag

SEQ ID NO: 102452 - DNA, 707 bp, Triticum aestivum
  Clone ID: PAT_TA_102452
attctaacatgagtttaggatgaataacactaaaggcgatgtgtgaacttaacaacaaatctactgcgttggcaccatcaaggcaatatgagatctacaataatatcgcatggaataaactaggcatggatcttcttctacaaagaatcggagtcgcgaaggtgtatccaattgcaggatgttatggctcaaagacatcttatgttcatggatcgaatttatactttgccaccgccgactactctagcgtcagagagatgtgaaccggcgacctgttgtcgtatgttttcgtgagatccagcattggacaattctttagagggcctggtcagtaggggtcgcagcggtctagattggattcgcttgcctgcttcctcccttcatgttgcaggtgcgacataagcccctttccacctgagggtgtgtcgtccatatgtcgattgaggcgagtcccgcgacatggtcatgccctttttatatggtttacacaggcgcactgagttgaggtgatattttcgtacgtaccctttcgttagctcttaatatgaattcgagtttttcggacgacagggaagttcgtggaaattgagcttccagtcaaccaagatcttcgatagcagcgcgggatagtcactgtggtgccaagtcacgatgatacgtgcgctatggtaatggtgcatatgtcgcgcttattgtaatcttgtata

SEQ ID NO: 102453 - DNA, 723 bp, Triticum aestivum
  Clone ID: PAT_TA_102453
agaacggagtggtgacaagttttcacagtggtacccccaggagttcttcacgcgcagttacttccatcgtcacaaagacacgtaatccgtgacatgttcgttgtaaagaacgttaagtacagtagttccgaccatagtatgcgtacaagcatcgacataatcagctttcggtgtacggtgattacagagttcttcaggaaaactgcatgctctgcagtccgaagagcagtgcatcatcgaagacaataatcgatcgaccataattggagttggtgcatattcaatgaggaatcgcatcggtttttcagctgaaatgaaagatacccgaaggtttttcaagccggtgtcgctgcttcctcaatgcaggttttaacagtctcgggtcagtatccattagcaaaaccataaacaatccagccgatgcccccccaactggccctcgttttccaagagatctcccggcccccttccagcttttcccccccaagcccattaatatccaatactcaaacactgggtttaatccccttgggaccccacacctcgggcctatagccacgctcagagtgcagcgttttgcctatgtgaagttgattccctatatcgtaatgggccccaagcacaagagcttttgtggttcataaaacgttgggcggggcggttggaggcttgacgacgccttaaatttgctcttgacaatgtttggacggaaggcgcgtctga

SEQ ID NO: 102454 - DNA, 582 bp, Triticum aestivum
  Clone ID: PAT_TA_102454
ttttttttttttttaattagagttcattttaggttgtcaactcttattcagagttttctgaggaggtgacatcgctcatacaaaggttgtgaggcgggtgtccgccaataattgtcttttgacacaaatcaacaagattgagactgaatgacttccttcaacacctagaaaggttggtgttgacgtgactgcgaatctgccattgaggtgcaccttctatagctactttctagcttccatctgttcgttttatccttgatgcgaacttgcgattgtctcattccacctgtcttcattggttgtcgtccctttcgtgcatttcgcgcgctaattccaaagagaatgttacgatgaaactgcgtcggaaggctcgtgtaagcggatcacgggctttggtggtacacttcgcggccataccggatgcgcatgggcgagcttccaccgagtctttaggcctggttcgtggggctgttacctgttattcggactaaaacaattatcttccgatccaggcagccgggcatgagtggtcgtagtgactttttgcccgcggggccaactgggggcactcctgtgtaggtt

SEQ ID NO: 102455 - DNA, 606 bp, Triticum aestivum
  Clone ID: PAT_TA_102455
caactgctatcagcgctgttaaatacaccatcactgaacaaccacgtgatgactgatcgacaaacctcaacgaatggatctacaaaactttcttaaatgtatgttcgatcaaagaaccgaaatcaagttcgcttgtaccgtcggtgcgtgctagtaactacttagctcaatcctcgtgcttgcttcagcaatcaatgcctaagtgtcgtaatttggtttgaatacgctttcggactaaatgagtttttagccaataacttttgtaccctcggataaacctgtaattttcgaatcgaatttcattttgggtttaatgaaatttttattccttttaccgggcgatccacttctccaaaccccaatgaactcttgacttatcctaggtccctttggaaatttaaacggttacggtttcaagattttattccggttcttggccttcgggacctatgcatatggttctaggagtttcatatattcctcaacttccatcgggtagagccgagttcagcaaataactctacggttttcatattttggaacaccgccactttctctcaaaatttgaggctttttcctgatcatcaatccaaacagtaaacgaaa

SEQ ID NO: 102456 - DNA, 183 bp, Triticum aestivum
  Clone ID: PAT_TA_102456
tttttttcctcttcttttttttttttttttttaaagcaaacaaatatttcctttatatttccgggcaaaaccatgacggaacgatacactaaccaagcaacaacactcatcaacacaaccagcattggcaccctttctgatcagttacaaaatactgaagtacaccgacccttttacaccttg

SEQ ID NO: 102457 - DNA, 385 bp, Triticum aestivum
  Clone ID: PAT_TA_102457
accatcgatcagtcagagaagaacgtacacattattacgtcttgtcagtagaatgaagtactgaatgtagaagaacctagagtacacgttcatgatctgagcgtcgtgacgatcatccaagaagcacaaatacggaagggagttagctcctgtcaaaaatgccctaagcccgctgagaagaccgaacaatcccaataatcaaggaacgaaggctaatacctcgatttcttgaacggtatcccaacaaacagaggacccaccccgggaagcaaccaagccccccaaaggtcaaggggcaccccggacattaacaaaccaacctcaaagggcaccaaaccggaagggccttatattccgccccgccaccccccgtttggacccttcg

SEQ ID NO: 102458 - DNA, 627 bp, Triticum aestivum
  Clone ID: PAT_TA_102458
tggttctcgcgagagagaagaaagcagcagcggctcgtagtgacgaggttgagatcgccggggcagtacgttcgggcgctgtttatcccggactccgaccgatcggcctcgacgacttgagaccggttggcgcgaggggatagactggttcccgggtgtcggtacggctgccgagacggactgcggccggaagggactgccgggatgccggtcggcgcggccgatggcggacttgcgggacctgcgcgtagtgtaggccgacggccccgaagtcggctcgggcggcgcgttagcggcgaccccgacgggttgggtttgggctgggggaccgtcggcggcctgcgaaacttttgcgttgcgatacgggccccggtacccccgcgggggcggggcgtgaactgtcgaacggttcgcggcggcgttctacttggcggttgccggtgtgggtggggcggggcggttgttggtccgggggggttcctcggggggtgggggcgggggcgctggcattgggtagcgcgctccggtgaagggtccgttgtgctgacgcagctacatcgggcggcccggccaccaaacgccgtttgtgctgggccgccgcggacgcgcggggtccgtcgggtcggc

SEQ ID NO: 102459 - DNA, 407 bp, Triticum aestivum
  Clone ID: PAT_TA_102459
cttccttggtgtaggtacaaacattgttggctcgggacttggcacaaaagtagacatcaagagttggactccattacatgaaaccgcttgttgacaaccccctaccagggattccatagtggttgacttgcgtaagctcgacctctcgcttactgattgaaatgccggcatttcgccaggaacaccgccttggaagctttgcacgcgaccttccttcgctgggagccgtggttactggccggccggggtgaaagtaagtgccgccctcggcgtccaaagccagaatgcgcaccggtgggtattgttgctagccagaggttgggggccggtgccggttcagccgcgttggggatacgtggttgtggatgggatgaaaacgtgacctggtggacgcgccgccgttggcg

SEQ ID NO: 102460 - DNA, 455 bp, Triticum aestivum
  Clone ID: PAT_TA_102460
ttttacaacgtcgtgactgggaaaaccctggcgttacccaacttaatcgccttgcagcacatccccctttcgccagctggcgtaaatagcgaacgaggcccagcacctgaatcggccgcttcccaacacgttgcgcaagcctgaacttggacgactggccgccctgactgccggtaatttttcctcccttacagcaatcctgatgcaggaagtttccacaacccgcactaatagggtgcacttcctcaagtatcaaagtccttgcctccttaattgcctggcaaaaaggttaaaagccaagccccctgaccacccccgggcaaaccacccccggcctcgaacaggcggcccctttaaccggggcctttggtcctaggcctcccctggggaaattcccggcattaaccgaagcccaaaagccttggttaaccccgggaccgcccgggggaaggacc

SEQ ID NO: 102461 - DNA, 218 bp, Triticum aestivum
  Clone ID: PAT_TA_102461
cgacagaacggtttttcatgtcttttcaccttacttatgaaataaaatcttaaatgcaatactttttatttagatagacatacggtctaaacatatattactttttactgagatcaagatggtttcctaggactaacctaatataaaggagattgtaaataatttagctttgagtgtaaataataataatagggttcaaatagttaagggtaagtttc

SEQ ID NO: 102462 - DNA, 421 bp, Triticum aestivum
  Clone ID: PAT_TA_102462
ggaagaagcgagcagagattttggacgcacggaggcaggcagcgaccacccagctgaggctcaaggaatagctttttcacgtgccattaatatgttcgtggagtaagaaccaacactcggcactagatgcacaaacccatgacgatgaatgatgcccggtaaggtggacaaggatcaagccctccataagaccggtccatgaacgaccgaagccccgggggatggggcaagcggttaggaacgaaaatgggcctaaaacccttcggtagcccccggaacgaaaagctctcgaagggttgcaaaggaaggccaggaaaaaaggttctcatgtgttgggccaccggggaccccatgccccctgaatccaatacctgggtctttccattcggtggggcaatgtagcctcaaccttttcgggccg

SEQ ID NO: 102463 - DNA, 674 bp, Triticum aestivum
  Clone ID: PAT_TA_102463
gccgactcttccactctctcgtcgatcgcaatcgcacgtcggtacgcagtcgaattgagcgatgccactggcttcctttgcgaggtaagtcctatgataacaaattcattatcctactccttatgaggaacctgacatgatacaacaggtcggcaacgaatgcaacgcagcaagacaagcctgcgtgtattcgagaagaacgtctgcgtattggttattaatttgggataacgtccgggtaaattaagaattcgagctcagtaatgacagagatcttcttgaatccaggtaagggtacctgtccgcctgagggcggtgacatatgcaaatcgagttcggtatgggtcggaggtcagtctcgctagaaccttcgaccctaacgaatgtgaagcagcagtggacgcacgagtaagccaccgcgggaccgcgtcctgtggagctactaaaaccccccagcagccctgcggctctacgccgaagagtgcgagcaccgagtaaagataaatgcaacttttctcaagccctcgtgaaggtaccctgcgatcttttggaccgcctgccggattaaaggtgtcactcgtgcgcggagaagcacggcgttgatcaaaattgacatcgaggggacgcgtgaggataccaattgtagattaagaaaaccagccaaaggtagtcgg

SEQ ID NO: 102464 - DNA, 666 bp, Triticum aestivum
  Clone ID: PAT_TA_102464
ccgttgctgtcgccgttgctgtcgtttttttttttttttttcaagggagtgtaattagagttatcgttcttctattaagggcaaaccacaatgtaactgcgacttgagcgaattaatagtattcattcaccaaaaccaccaaccaaagaaaagagttacgttgagttatgcaagcctccacttacatgaatacatatgtatgactgctggcaaatcaagaacgggtaagcttcaatgttccaatccgaaccaaatgaaaccacaggccggcctattcgtgggcgtgcagcaacgtcccatcaattttagtttcccttccgcaacatagattaaaacttcaggggccgaactacccgcccttgaaccaaagggtagtgccagggagagagaaacactcccatacttgaaacctgtgcaacccgtgtccagtccaatgtggcccaaattaattgggcgttgcatggtatacggtttggatcaaagacccctgggcgtttgccctgaacaaaatgaccccggggtacccggtgtgtctcaagttacgttcttcgtcttgagacagtgaagataatgagaccttaattgcttacgagtttgccaggaacgggatacctacccaggggaatctataatccgttctggagggctgttgagacccgtgcccgc

SEQ ID NO: 102465 - DNA, 447 bp, Triticum aestivum
  Clone ID: PAT_TA_102465
tgggcaagattaagatcggaatcaacggtttcggaaggatcgggaggctcgtcgccagggtagccctccagagcgacgatgtcgagctcgtcgccgtcaaacgaccccattcatcacccaccggagtacagtgacctaacaatgttcaacgtaacgtcacccgtttcaccggccatctgggaaagcaacaggtgaccatcaatagctcaaagggacggacaatgacctcttgcttcctttcgggcgacaatgcgctcggttacccggtccttttggggaggtaagggagaccccctagatgtaaagaatttgcccgtaggtggtcaagggagttgagttggccggttttagccgttttgggtgagacgtgcaatgtccggggtgttcttttcttgcttggcccacggggtgcggtccgggccagccctggcgtccggccttttggag

SEQ ID NO: 102466 - DNA, 332 bp, Triticum aestivum
  Clone ID: PAT_TA_102466
ctttcacaactgtacgatttacatacaaaattcataatttctattattctaaatttattacaattgtagttttcttataattctatctacacatttctatagtttaatacccattaatagtaaattaaaaattttgctctaactctccgtttcaccaaattcataatcaaaatttctaataacttaactatgacctacatcttcattgtcgctaacatacttttttttatctttttaatataccattttagctagcttcgctccttatataacaatacctcattagcttacaataatcaatttatttctaaaactcttatagctcttcaatc

SEQ ID NO: 102467 - DNA, 395 bp, Triticum aestivum
  Clone ID: PAT_TA_102467
tgaagccgtggcatcaattgtagcagtggcactggcgcttcgagacgttattgcctgccttcccgtagctcaccctccctacctactttcaagattcgccttcaggccttgaagcctgggtggataaaattaacagaaggtcgaagaatcaagaaatgcttgaccgccagatattgagccaagaagcctaatgtagtttgcctaatcgtttccgcgtacccagtgtaattcgtctgttgtctcatgacaaataaataagcgggtaatagaaaccaaagcctatcccgttctgccttgaataataagaattgtagcagcatgggcgcctaacttaagccaataagttccattggtggtgaaatggccaaattaccaccaaagggcctacccccctt

SEQ ID NO: 102468 - DNA, 201 bp, Triticum aestivum
  Clone ID: PAT_TA_102468
acgggttcgaagaggaggcggagacgcgactgggacgagcctcgcgcccgtcgatcgattgctgcaagcctgtgatggtgagggctgcgcatgcttcggcgtgttggtccggctggcatgacgacaggtcgcctactcactattgaagccgcccgacgcgacctgccggcaacgaaccagccagcacaccatcagagtact

SEQ ID NO: 102469 - DNA, 460 bp, Triticum aestivum
  Clone ID: PAT_TA_102469
tctttcacacagtcgtcgagtgtataacgattatagatgtacacgtgaacatcatgcgagtaccgtacgaaagcgtaattgcgactagacctgttgtcttacctccacaacaatacctgagaaggaaccggccgaagtctcatgcaacgtaagagcaaagagaaagaacgccaagaaagtaagcctccgagttcaccgaattgacagtactagatccgcatgacctaatcgtccacgtaatcgatgagtcataacgcaaaagcgtgtgtcctttgcgttccgcctgtgggaagcgaatctaagaccagcaagcgccaccggtccatggcggcgccttcccatctaatgagagtcgctaacgtcaggccttggcataccatcgaagggggttgggccttggaagaaggccatcccttccccacataccctttttccgttgggataacctttagagtctatg

SEQ ID NO: 102470 - DNA, 274 bp, Triticum aestivum
  Clone ID: PAT_TA_102470
gcgggagtggcggcgacctactttatgaggctgtctccatgttatcctgtggatggtagatgccgctccgtaattggcgggaatcttgccaattgagcaatgtaaaggagcgccctcgaatcccgctgagatcgaccaggcaatcatgcccatacaacgttgctatcttgtcatttgcaagaatgaacatactgcggtacaggataaaaggccttgatgaagcgcaccggggaaaactgtcatagcaatttcttaaatcacagtcgtaccggcg

SEQ ID NO: 102471 - DNA, 199 bp, Triticum aestivum
  Clone ID: PAT_TA_102471
tcactgctaaacattccaacaacaacaacaataatacataccatgtcgcttacaacagttggcccatattcatcctagggggttctgccaacgataccgggtgactatccttgccaccatccttgatccgggcaatagctcaccacttcaatctcacccaccataccactcctcccgcagggggcacttccgtccacgc

SEQ ID NO: 102472 - DNA, 254 bp, Triticum aestivum
  Clone ID: PAT_TA_102472
gcgcgatcacacaacagagcggtaacagtttcccgggcatgttccgcccccggccgggcgtcattgggacttcgtctttcgtggaggaaggctcgtcggggggccctcctggtggcccgtaggtggggcggcaatccgttggtgttcaaagaatcctgggggccgcaaagcctgaaggcttggctgccggccccacctataccccggattccccagtcctttcggggcacacttcggctgcaacgttctgagca

SEQ ID NO: 102473 - DNA, 285 bp, Triticum aestivum
  Clone ID: PAT_TA_102473
ccgttgctgtcgactactagatgagttcgtgctgctggtggtggcgtaaataatcgggacctgcatttgtactgtgtgccattcagtgcagagttgtgcattagttgcgtgtggactgtttatgtcacgttgtatgtatgatcgcatcactggccatctcccattctgtcgtgggatcttgatcccactgttcttcgatagctactccgtacaatcgagaaagaagaaaaaaaaagaaataaaaaaaaccaaatagacaaaaataataaaaaagaagaaaaacac

SEQ ID NO: 102474 - DNA, 632 bp, Triticum aestivum
  Clone ID: PAT_TA_102474
tatcgaaatctctttctctttagtgctacacacagaaactaggatagcatgccgatcattctcgaagcaccgatgcggctacgcgcactacggcacgtgccgatgtaggtccattgcctaagagcgaaagtcctcgggctgccctgcgtaggccctgcctggggcgagcgactcaggtcggtgcccatctcggaggcgcctctgttgacgctgaagccactgatcgactcaaagcgctggttaacgggaccgagatgccctggggggaccttaccccccccgttgcctgtgggttgaagctgccaatacttggctagcagggcatgtaacgttttcccgacatgacggaacgtgcttctactgccgtgtccgcggaacttcgcgaaatgaccgggtgcacctggggctttctacaagaccggagccggagtcggagcctcgggatcttagcgacagcacgttaagcccaccaggactaaccggttaatgttgagtcggctctgagtagggacgaagtgccggaggggttgatgcggcttgcgcagaccggacaatgaaacgggtaaatgggcggacggatgaggaaaccgagtcacagcgcgcggacgtggttatatgcggtaggcggtagc

SEQ ID NO: 102475 - DNA, 622 bp, Triticum aestivum
  Clone ID: PAT_TA_102475
caatctccctagcaagctcaagaagcttcatcggctagatcagcgcataacattcttggcctctcccattcctcatgcctctctctctctaactcgggctagctaccaggattcctcgggaaaccaagaagaagcggcagatgggcaaagcaagaattccggctgaagccttccttgtcgacggaatgggcccggccggcggaacgggccaaccgggcgaggaagcttcgttcccttaccttccgatcgggggttggaatgggccggtaccggacagtttgaaaccacccattttccaaccccggcatgggatccaaagctcggcgggggcggcgggttgacttttcaaggattttggaggtcctcgtgagcggaacggacgccccgaccgcttcatcacgacctggggaggccctttgacgtgtcggaaggggacggttagggaggccatactggctcaccacccctcatggaacgggcaggttcccaacttcattgggcatctctgtgttgggattggggatcggcatattccagcaagaggctaacaattgagctgcgaagtgcagaccagctggcgtttttgtcgctacggcaatgaacacaacacagcagtggctct

SEQ ID NO: 102476 - DNA, 583 bp, Triticum aestivum
  Clone ID: PAT_TA_102476
ctcgcaacgatgaggtctctcggccgcacttcgttgtgcgtttcagcctggcgcctgacttctccatccattgcacgtgagtcaggtgcagactgaagtcctaggccatcggcccgactgcgatacggaggcctcattccgatccctcaaggcctttaccaccaataaaacccacttctcaaaaatcctgacctcgccctcaacgtcccaagcctcctatatatatggcctggctcccacgatatcgccccgaacccccaaacaccgccagaactccgcaacacggcctccagcctatattccgttgccctatctagaccggggccagcccccaactccccccaacgtatgcgctggggactcgacagcctttcgtcacctcgacccacgacatccgaaagccaggttcaacgattggtcgggctcccccccgccttttcggaccgcgcgtgaggggtgagaagggggtactattacaccaaaatgcccctaatgaactgccgccagttgccccgcgcgtcgtcggggctcgccgggcgagcgatcgctcgggccctcggggcctgggttatcatcaattacc

SEQ ID NO: 102477 - DNA, 178 bp, Triticum aestivum
  Clone ID: PAT_TA_102477
tatttttttcgttactattaagaggcaagatcgcacgacgctttcaatttgatttcactgaaatcaacattatctacaactgcagcattcggaaggaagagtcgacatgcatagttgcattgattgctatggatccacggacgccactgaaaccctaccccaataaaagcaaaaagcc

SEQ ID NO: 102478 - DNA, 583 bp, Triticum aestivum
  Clone ID: PAT_TA_102478
cgctcgccgtaaaggggcatgagctacgactaccctcccctgaggaaccgctcggtccaacgagcgaccctccatcactcgcagttcaaaccccagtggtaaaaggaaagggtccccgttccatcatttcaacaaacagaaaaggcccaggtcattgcgaaggtcgcatggcatcagtccatggtagttacagtccgatcgatcgtcacgttcgggtctttttgccatatccaaaatggcaaaggtttacatttcccgtcccccctacaagtaaccacccttacaaggataggcgaccctattagttgtcagggaatttttaggagaaccgactcataactggctgaaacataaacataaatcacttgtaatcccacagttttggaattggcaatcctaggtggtattttcataacaaaacgttactaaaccgtaatattcctactacactctctatgcgattcaaggtccctagtgactaagtatagttttggatccagtaatgctatccaccctttaactttccggaaggctctatcataaaaatttaaaccatatttacggacattcaattggctccggt

SEQ ID NO: 102479 - DNA, 1985 bp, Triticum aestivum
  unsure (1)..(1985): unsure at all n locations
  Clone ID: PAT_TA_102479
gttaatccacgcacgcccacccggtacgaatgaccacgctatgcacgctgcatgccagcacatggcctcgtctacgtnacgcatccgaatcttaccatgccaactatgcgcttaccctccagtcaactgacccgctcagcacctcacgctgtgcgtccagctgactctcgacacacccagcccgcatgtcagccgcgcaactgccctcccctctgcccgccaagaccaaacggggcgccaggcccgatttgccatgtcctccactcgcgcacacggtcccaactcatgccggccaccgaagtggcccgacaacgcgcgggctaccgcgcaccagtaaccggccaactgcacccgggccggggaccgcgggatacgaacgacaagcgccagtggccccgctccgctaagccacaacctaccatcgcctacccggacgccccgtccgggctcctttctaccaccgcccccagactttccacccaatttacccgaagactgccgacaaacctactcctcgcgccctcacacattcccattaacacgccaacaatacgggaccccacccgcccccatccccgttaccgcgctatcgctcaaacccttacactgtgctccataacatggcttcctaccaccgtgacatcaactcctcccccattatacccaggctaacactctcgaggaccccccatacccccacaatacccaagtcccctctaggcgcgccgaacccatttctgcgccactccgccccggtccactacctgcggagaacacccagtaacccctcaaccgttcccagcgccgcgccgctctacacatttctctgccccccccccacttctcgccaaggtcggctgccaacaccgcttaacaccccctaatctcaccgccacagaccccgagggaccatgtggtgaccccgggcgctcctgcacgtctgacgcatcccgtgctgtcagtggttacctgcgccaagctcggtacccccttgtgactctgggccctcccccgggtctccgcaaacaccccgagcggcactcccacacacctgcgcttctcatagggtggccctagcacaccccttaggcgccaccgcttggcatatcaaccgagttccccgtcgagaggcccacccaaaacagtgccctcatccccgttatcccctttcccccgcccgtcatcgcccccctcaccatatcccccccagaacccctcacgtcctacgctctaaaccccaccggaggccccgtcctcacgggacacaccaccaccgcccgcggatccctccccccacaacacgagtccccgcgaaaccgcgcaccgccttaccgcccctccctcaccactgcccacatagcaacacccaccccccgggaccagcacctcctttcgatcccccggacctcgcccctacacgcccacccctcatcctccttactccacccgcccgcgcatcgaaccgcactgctctcgcgcttgcctacacatcacggccggcgaaccgggggctagccaaccaaacctcccccccaactgactccgcttccacggtcttcgggcacctggcctccagaccccctcagcacccagccccgcgcaccacctagtaaacgctccccgaccgcccccgcactctcgcgctgagaccagcaactcaccccgccgcccccgtcaccaccccccctgtagccccgtccgcccccgccgcacgttgcgcgccaccgcaatagtcacagcagcgcccctggtgacctcccccctccccccctcatatccccccagtctccatacccccaccgcccgaatccagcgcgcgtggtcccatcctccctcgtcctcttccctcccgtacccgactcatacccctaccgccccccggactcaggctatcccgtccaactggtgcttctcccctggcccccacactgcccggatgcccatcttctcgtaagccgtccgcgacgggccaactctgcatcctc

SEQ ID NO: 102480 - DNA, 1172 bp, Triticum aestivum
  Clone ID: PAT_TA_102480
tacaacgacagcgcgcgtaatctacatagagcatcatctatagtccagagcagataaactataatcactgcacgaagcagaactatgaagacagctctacagaccacgtctacgcacatttgagcacgaggtggccgatagatcagcactgcatctacgccttatactcgatgctgacgatcccatctaaataacaatcacgagacgagtccacttcctatacgtcgttagttgcagacctttatgctagtacgacgaaaacctcgtatagcctcgtatcatgcagcatagacaaaatgcgactaatcggcatcaggactccaccagatcaaggctactatacacggcaaatgcgcactcttgagcggggaggaaatcgttctgctgaagactgaggatatcatggcgattgcaagactgactacataaattgcgacttgagcatgccgagttgctaccacgtgaatatgatctcgcatggcgcatcagctaatccagggcagagtcacaaattactttatccagtactcattcccgacataacaaacctcttcccgaaggtctctgcctgaacatcatcaagtcaaagcccttaatgactcgtaagaacaaggcggctaatgggcgccatgtacagcacgaggaatgcatcatcactctgcaggactgtctgccagcaagatgccttgatgactactcagaaagacaattcttatgcttacgtataagtgcagtatgagagcacctactttccagttgcagttcatatgttacgtcagtcgactcattaaaatacaaagcaacgtacttcgtgcggtaactcatagcgaaagagcgcgccgtagctagcgcgagccagtatggtttgagcgcgccactggcaaaaacggtggcgtctgtccacgagcagacccgctcctcatcggagtcctcgatgtaacgcgcctgcgccaacatttagatggcattatatattgagcgcaacctcaagacccgacaagccgataaatttatcaatacctagtgatatgaggatgaaacgaagtctgcgacaattaaatagacatacaccacgcgcgtgaacgcaggaatgatggcacctactatcccctcgcgtcgcttaaaggtagcccttctagttctggccctcaccgctcggtagtgacgtttta

SEQ ID NO: 102481 - DNA, 1109 bp, Triticum aestivum
  Clone ID: PAT_TA_102481
atcgctgactctcgtcttagtatctgtctatctctagctctagcttcgctagctctgtctgtttcttgcacgtagtccctctaatgcctctactggatatatgctcgcgtctacatcgacaatatcctcctaactagtagtctatcccatggcccctgtgtcccctaacgacacagtatactcattgtaatctagacacttggatagaatctccctggcacccgggaacgcataacattagttgtccagtggttcatagcgcttcgacgccagctattgaattcaccaatccgtactacttggggacttccgatcaaaggcttcttaaacgtcctagtgtttccaaacctccaggatggactcataattgagtaccaccaatactactcctttcgcctaagcatttcaatgacccttaggtgtattgcctttatgcttattactcgaactttggcgggaattggccgtttactgggggagaagttcctcaaattttcatggtcataacctgaaggatgccgtcaatcgaatcgtcgtacataattcggacctcaagttcttactcactacggaattaaccaaaatcctcatggaaaaactggcctcagaattggccaaaatcttccagatcaagcccaatgtggagcctcttgcctcgattataatgagcacccctttgcagattcctaccgaacttttcctctaagtaggttgatcgtagccagtgagtttaaaaagaccttacgttcttctacgcgagtagcccttcctaacatataatccctccatgcaccaaccttcttataagatttcagaaacatatttcattcgtactatattatcccgataggatatataaacaatcttgagggtcctactatttctctcttacctctatatgtaggtggattctacagtctaaaaataccattctgttatgcgtagaacatatcatactgaatcaactgtttgctattcaattctgctactaatcaaacattttgtttttcctcagaaaactaatctatccagccatagactctcgtcgttgcatgtgtcaccttttattctatctcttctgtctgccacaattattttcgtgtactcac

SEQ ID NO: 102482 - DNA, 447 bp, Triticum aestivum
  Clone ID: PAT_TA_102482
ggatcacagatgttgggctcacaaggctggtccggactggcgccgaggggataggtggagaatacaatgccccgttccacaagtggtgactttggggagtttgggactgttgccccagacgattgctagcagtcacgttggaccactgacgggccagcacagtctgcgtttggggtcgacgatctgacgctcgtgtgcagggatgacggccgcatgtgtgtcaggtgctgtgggtgatgacttaatggggcatttggtggcttgggatatccacccagagtcgtgtggcagatcagcagctgctgtagatgcgaccttagacgcccaagctacagaggttcgagcgttcctaacgggtgccgttattgtagatttgtggctccaactagagtagttataatgaacccgcctcccaacgctttatgaggctaaggctgggtgcgtgga

SEQ ID NO: 102483 - DNA, 651 bp, Triticum aestivum
  Clone ID: PAT_TA_102483
tagctgtttcctgtgtgaaagatgttatcctgctcacaattccatcacaagcagtacgacgcctggaagctataataggtgtaaatgctctggggttgccttagatgatgtgacgcctagacatcaccatttaactatgcgtgttgctgcttcgacctgcctcgccttgtcacagctcaggtggataagcccatgttccggttgctcacgctggccattttaaacaggaaaagtccgcgctcaaactgctgcaggtgtggaggcatgagacggggttttggccggtcattattgggtggctgcattccttttcgcgggctctgctcctaccggcatttcatgcttccgagcgtgcctgccttgggcaggcattctggaggcttccaggtgaacctgaggccttcgtctaattctgtggaaggcccgctaataactttggactcctgttgcaggttgttctaaagaatccactcaggagctataacttaaggccgaggaatgtaagtgcgccagacataccggatgtgtgcaggagggagggaaaccaacggacgtggcaaatgtggacgtcttgttacactatagcttccgatcgtcgagtcgcagaatgaattgggtccgccacctagcagctcagggaccccacaccag

SEQ ID NO: 102484 - DNA, 720 bp, Triticum aestivum
  Clone ID: PAT_TA_102484
cacagctgtcctcctggtagtgaacattagttactccgctacacgaattcacacgacatacactactgagccaggcaacgcataagacgtgtaagaagccatggcggtagcccgtaatcgacgtagcagcatacactccgaccatctacgattcgacgttcgcagcctctatcttgcacgctgctcttgccgagcttcgagcggaagacacctgctcagtcgacccatgtcttagccatctcacactcgacagtaccgggccgaccaccgaccggccgcgcgtgtaggcacgcggccgcggtctctcgcccgcttcaatttcggtgcgaccgacctccgtccttccccggtcctctccacctgtcaggccattccccagcctcggcaccctctccggcctcggtcctaccctgcgggggctcccgtattcttcccgccgcccttcgccccgctgcccgaagctccggccggtcacccccccaacgcgcctgacccacgctttgtccactcaatggagacccgccgcactacagccgcaagccggcaaccaccgaatcgccccgaagcccaatcgaccctcgtcccaagggccgccgtgccacctaaacaaccgcggccaaccgtcccaacccacccccacccactgccaatctcgcccccccaaccggcaacaaagaggttccccccgcaggcaacaaggccacccaaccctccccccac

SEQ ID NO: 102485 - DNA, 433 bp, Triticum aestivum
  unsure (1)..(433): unsure at all n locations
  Clone ID: PAT_TA_102485
aacgtctccatcctaatgaatgaaagtaagtcncagngcgtgcacgaactaacagtaacanctacgcatagcactccntacagtagatgaccaatcaanaggcataaagtcaagcaccggtgtaacgaacctacgcgtaagaatctaacatcagtcttgaataaagaatcaaaatacggagatcaacgacggaactagcctggtccgtacataaactacatagctacctgactcaatcaactcacgcgatacgtacctcaataacgtacatgcctgacctagctccgtaaaatcgtgtatgtaagtgcgtgccgtgactaagtaagtcacatcaatacattgaataactaaataggtgactgagctaacatacataacataaatatccaactcgcgtacctcaactgcataaataacctaagcttcgtacggt

SEQ ID NO: 102486 - DNA, 589 bp, Triticum aestivum
  Clone ID: PAT_TA_102486
gtggtccaacaataccaacctgaacctcaagtcttttacaagatcgttgatattatcacgtgaataccaaatgaggaacatttcctcccttgcttctccacgtgtctcagactacaaatatcggttccaagaggatttaatgattgacttacactgtggactactaactgtgtcgttgctagtcagctgcatgcttgtcatcaacggacgcgtactccacgtagtctgatgctctgaagttctctgcatttgaactcaagtctatacaggataagtttggatctgatccaaaccatttcgctggtttccttctccaaatggctggaagctcaaaaacgccgtggccatttcttgaagttgaactctgcccctcttgtaccgagttaaaactggtgattccctctagctataggatacacattctcccttctcaaggcccataaccgtaggctctgctcgcttctcctagacgcgatctgagttccagtgatctacgaatgcaatgcgctcaagagcgatggtcaatggtcgtgtgcaccggcgtgacgagtcgcccgcgagactgtttactatcgttgatcgttttcca

SEQ ID NO: 102487 - DNA, 631 bp, Triticum aestivum
  Clone ID: PAT_TA_102487
caacgtctgagtgatgagagtgcagttcactttgatacaatctcttgatgggcctagagttcgttagtctatctgcatgtgcatggtagtttagctaatcttaatggaaaaacgatggcatcgctagtcgcagcttacgtagtcacctaagccagacctagtatgcggcactattggcagcatgcagctccatcatcatagcagaacgtgccatccctagggcatgtgcacctaactgaatacgatcccgagaggaaagacctacggggttaaaaaggatcgagatagagacttagaaaacttttaggtgaccaaaagttcccaaaaagagacaacccgggaacgaacctattagataggctgggtaagagggttattccattaccctagattcccacaattcggtaactttggaagtcctttagaaaataattacctagactaggaccgaattccttatacctgacaaggaaagtgcccataatcggagacgccactgagctacggtaagagatgcagaaaaggaaaaggggtaaccaaccgaccggcgaaaccgccaagaatctaacgcagacacattggatgaaataaggcctccccggattttaaggaaaagattaataaggagata

SEQ ID NO: 102488 - DNA, 237 bp, Triticum aestivum
  Clone ID: PAT_TA_102488
tttcaaacttaaaaccacaatccaaagccaaactcctccaacaaaatatcactccctagcaagaagaaaaaaaaattaaattaataaaaaaatacaaagattaaaaaaaaacaatgtaatataaaatataattctaacataaagtgtaaactatggaggaacttccacctaaccaatagtaaaagaaatctgaaatcaaacttctctggcacctatatagcattactatttataatt

SEQ ID NO: 102489 - DNA, 660 bp, Triticum aestivum
  Clone ID: PAT_TA_102489
atagctgtttcctgtgtgaaaattgcttatcggctctacagattctagaacagcatagccgagaccggtaaagcataagagctgtggcagcactggagggtgtgctaaattgatgtcgaggctagatctcagcagttacagttgccgatatgctgcctccacaagaccacgctttatcacatgatcagctgaacatcaatgcactgatgtccaggccttgccagtttatgatgtaaactccggacccatatctgcggcaaggcgagatggaggcgcccgcgcttttcggccggctacggtttgcgggtccggccgtgcttaccaccggccttccggacggacggtcagttcgaggccctgaaccttccagtccatgaatggccctacggcgggatcatggatggaaggtgactgtctgcaggggggggggagggtcaggtggttatatggtcatggtactgcgcctgcgggtcatatatatggggtcaggagcagaagaagttatccggattgatcggaatagcgactgtcaaccggattggctaaaatggcgggagatcgagacttctacgggagaattagggaaaattagggtaaaacgtgaggtccattgatgttatgataaagagaaacggggccgtccgaaggcgagacaccaac

SEQ ID NO: 102490 - DNA, 130 bp, Triticum aestivum
  Clone ID: PAT_TA_102490
agctgtttcgctggtctgacacttgattggccgcgtcagcaacttcgacacaaccactacgagcctggacagcatttaaagctgctaaagcctgtggggatgccataatatgatgctgatgcctaacaat

SEQ ID NO: 102491 - DNA, 342 bp, Triticum aestivum
  Clone ID: PAT_TA_102491
attgcacctggcgctgctttagaaccgctgctacatgggaacaggcatggcgcgacccaacgtatagctgcgatcagcacagctcccattttgccagcatgcggtacatgccgacgcggccctcaccggcctgccaatctcaacatgcttgacaccactgacagtctaagcggcgcccacctgcggcataatcttctcgtactcatgcgtgatctggatcgtcacaccctcgcattttgttagctctcatcgatacagcttgtctgtagctgctcgaattgtatgccgtcgccccagaatcccagcgtcaacccacgttgccccagccattaccgagcctat

SEQ ID NO: 102492 - DNA, 388 bp, Triticum aestivum
  Clone ID: PAT_TA_102492
ttggaaaaggagggtttacccccggcctctgcatcaagatgatgcacacaaccagttaacacgaagatgttatactataactcataattcctctaaagcagggcacgattaatagtcgacattgaaatggtaggaaagtttactggaagcataggtagcacgttcggttgaacccagtagtttgccaaaacaatacgtgactgtgaagtcggcgcactttgccatactggctgtgagcactcgctgctcacactttctgggggtccagagggtgctgctccttgaacggcagctgcgtgcgcctttgggcggtggtatccgagggtggaaacgctccataaacagtggctggtaggtcctgcagcgagtcttgcgacgtaccgaacac

SEQ ID NO: 102493 - DNA, 408 bp, Triticum aestivum
  Clone ID: PAT_TA_102493
tttatctaatatattatttgattttgacaaaccgtttcagttagtgatcgagttggaatcataacaagcacataccattcactaataaataaacacaactctagttttacaaaacgagcagaagggtacaaaggaaaaagagctccaggacggggaaattgtggtggtggtggtccgatgtggagtgggggaggggggaaagaacaaaccaggatcagatttctggcagccgtaacaccatcagccacgcatcgtagcggtctccttggagtcgatcatgccaacctacacgacgacgtcattagcacgaacacggcagacacaacaaaggaagcaacgaatgtcacgcggacaatgcccaggtgacatccaactgatgcatctggtggggcccgagagagcaagagc

SEQ ID NO: 102494 - DNA, 104 bp, Triticum aestivum
  Clone ID: PAT_TA_102494
tacaagccaggcagtcatataattcaattaacaatgtctgcgtctgccataaaataccagaaggtgcaagcaataattacctaacgtccagtaagccaaggtca

SEQ ID NO: 102495 - DNA, 617 bp, Triticum aestivum
  Clone ID: PAT_TA_102495
cggccgcacactgctttaagtcccactccctcctcgctccaccaccacgccgccgtgctcaggtcgcctctagatctccagctcccccccattcagtcggtcgggctgcgcgcgcagtttcctcagccggcactggcagacggacgagctgactccgggctggggtgtgggtaggatgcaggcagcgtgactgggatgacgtgtctgagtgggctgggagcatgcgtgttgcaggtgaaagaattagggcgcccgggatctgggtgggccgtaagccagtgggcggcttcccatgactgctgcaggggggctgcgtggcggcccgattgcgtagcgtcgggtggactgggcttgcatccattgccttgcgctctggcatatcggggaaccacgccaatcatttatgggcctttaattgagtttaccagcctgggaaatttgcacagaggatgggccagagttacttcaggccaaatcagcagaatttggccgacttcactgttacttggtttctcactggagaacggtgccgtttgacgtaggggcttgagcgcggaacagtgcgtatcaatcgctcgagcggagagagttggttaggatgccgtgtagaccgccac

SEQ ID NO: 102496 - DNA, 367 bp, Triticum aestivum
  Clone ID: PAT_TA_102496
gatatacgcatagatgcgaagaatgctcagtctgctcgctccgaacatcgcagattagacctcactcgatactagacgataacatgttaggacagaggcgacatcaatgcatcatggagaaaagacaacatgagaagcgcctgcacagaatgatacacctcaatcctgtacaggctaacgctaaatcaaatagatatgccggaatcacagaaagtaataagcaaaatagcaccatgttgcagtatacagggtcaacaatgagagacatctcgacatcacggtgagagacacaagacgacaagaaatacgaaaagagacaataatcctatcagatcagagcgctagaagtactagaatagacaaagga

SEQ ID NO: 102497 - DNA, 1063 bp, Triticum aestivum
  Clone ID: PAT_TA_102497
tctagatacggcgactcaagttaatgtcacctgatgctatatccagtataagtactctgcgctggattgtatgaagttcatggaagcgttgagggcaggtacgtgctttatgatgatgtactcttgagatcgagaactactccatcgtgctcggtacagcgatgctattctacgttcgaagcgatagcgtatgaatggaggtcgatgtggacgaactaagctagttacttctatggaaaggatcgccgtattagtgtggtagttaggccgggacttgaatgcatggtctattttgcatcgagtcacttgaagtagtttgaggctacgctcgaaccacgacgctgaatgttctaggtagagtggatctggttggaaggaattggaaatctcaggaatcaagacattaacggtgattagtggagaggaaggagcgattgtgtagtaagtcaaggtgaactatgtaggtaggaagtggcaattctggcgacgggctgtgacaccttctgctaccgttttcataagtggagagattgtccggatagctagctgaaagttatgtcaaatcgtttccataatgatagtgggtgagttcgcgatacaagggtgctattctagcgagagtagcttcttttgtcaggcagacaagctagcgacagacctaggaagtctctcatgatttagtgatgagcctttctttatagtaatgtctattgggagtatcttaaaaactcggcaccgctggaattcgcaagtgcagagtgtcgtctggggggagcccgacaattcattaggatggcgaaacggaaaggtcgctatttacgtgcagtaaggcaaggagtatgttgggacttgctttgcggcgtaaggtggtgatagcggcacttcgtccagaaagagtcttgccgtgacgtggaatggtatgcgattgactggacgtgtccgcacgcatcttacgagggatatacaggcttgtggctgaaagaaaatcaaggttggaggtgagtaggtgatgtttcgtacttgatagaccttcgtggagacgccatgtctgctgacagaatct

SEQ ID NO: 102498 - DNA, 209 bp, Triticum aestivum
  Clone ID: PAT_TA_102498
gttaaatatatatatagcgacagacaaggaacatatttatttgagtattgatggatgactttataataaatattactaaaaaaaaccagaaggcacccttcaagttttaaacagtagtagttatcctctaatttagaacttttccaacgctttttgcacattgttgaacaaaatcctcgatatcctaaggtccacggagaggtctaatt

SEQ ID NO: 102499 - DNA, 473 bp, Triticum aestivum
  Clone ID: PAT_TA_102499
cgctcctgaaagaacttgtcaaacgagctcaagaatcatcaagaatacgaaaatcccacctcgttaagagcatagagtttcggcccgacgccgaccgagctggccaagtaaccgctcctatttccggtagtgtcggcgtccccgtcaactctcctccattgagcccaaaatgacctggtgcaactttcggccaaagacgatgatctcgttgcggacacccaccacacatgccttcgaaactcgccttggctgctgctagaacacggtaaagtgacggtatggccttctcctagtggttgcgctggccactaactggcattcgtccgaaaacgatcccttggcggtttagtggaaccacgttcatctgcttcggattgatgtctacggaaggcacccaaaaggattatactggcgacaaaatcagtcaaaccaaaggacaccggctacttgaacaccccgttttgattagaata

SEQ ID NO: 102500 - DNA, 1030 bp, Triticum aestivum
  Clone ID: PAT_TA_102500
atagtgcactagaatcgtagggaagttggctgctaggttgtctgctgagagcaggtgagcatcatctgactagcagtagtatgaggctcgtatacgatttagaatacaccctggggattagcagtaagacaaggatacgatggtgcgacttggaaaatgttgaaacgactgaattcacagtaccctggtagtagcattaggcgggttaacgacagtgattggaagaacgtatacgggattcacatcatgttatgtcatataggttgctacaccaaacagggaagatgcctttgcatacacaagacagatgaggtgctgaatattataatggccgtaaaggtcgatgttgaaacctggggcacgacggaggatctctttctggttatcacactgggcgagtagtcatagatgggccaaggccacgcgcatggatgtcctaaggtcgcgtgcgcgattgcgcagttcctaaacgcagtatggagtacacgttgcgctgatcattatggccactgatgttagttccgagacactgcgcaggaatagaggtacttaagtatgaaacggtgcatcagtcattcacctatcccgagtcaccgcagttgtggtccgtactgggagtattatatagccagaggtggagcgcgcaatctctttgtccgataggtcgctcagctgcgttgtacgcctgtagaccatatagcagctactgatacgatttccaaggcttagatccggcaacatatggggagaagggacatttctagcggccttagtataaccttgtctggaaccaaagcagtacgtatagcacgcaaatacgccaagctagacgtggaaccattgaacagagccgattacattcgctctctcggactctgaggccaggaacctcgtaattagcagtcatccaccaacatgatacttcaagtagggcgcacatgacgcgtaacgccttggtcgcgccgttacaagggtggaccaaggttaggagcacagcgacctagccttatggcgataaagactatggtgc

SEQ ID NO: 102501 - DNA, 440 bp, Triticum aestivum
  Clone ID: PAT_TA_102501
ttggactactacccactagacccagagcagctgtcacggcgcgattgagcaaagcgaggaacggaccaaagcggcccccgccgcggcgcgctcagatcgcgaccacaaggagagggcaccggccaccgggcttcacggcacccatcttgtcctgggaaacaggcgtattgcgcttcatggcctctgcagatctacgtcaacgatggcatagtggcgtaatttgatgacagtcagggtcagaatcaggatcgacctgcaaagttcactctgtggtagcaatatctaggaaagcaatccctgttcgttcattctcttgttctctgtttcacacgcaggttatcgatctaaccttctttgtcatatccgggacgactaaaacgatgaggtgccgtgcaaaattggggcagacaacctgagattttatcttggctcctgcgtgc

SEQ ID NO: 102502 - DNA, 489 bp, Triticum aestivum
  Clone ID: PAT_TA_102502
aaataatcgcgaacagcaccctcccgtcagtcgtccgtcctcctccatctcgtcccgtccaggcctcacacaggcgctttcggttcttgggcctctccccttccaccacctggctcccgccggccggacgttgcaccgcgccggctgcgtctccttgcgatccccgggctcggccctggcgtactgcacggccgcactcccggcagtgggctttctcacgcgtgagcctgtccctctgccccccgtgcaagccataacgacgctctccccgccttcccaggcgtcccatgccctctcccctgttctgacgcgcgtccggccccatggccacgcccctaatcccggcgatggtccccccctcaccgacaccgccaaaacgccccccagctcgcaccctccccaggcccgcctgacacagcccccgcccacccgccccacgccgcggacttcccttcgcccagggatcacaccgtacacctagccgcgtcc

SEQ ID NO: 102503 - DNA, 764 bp, Triticum aestivum
  Clone ID: PAT_TA_102503
gctgcgtgacataaacctagcagatcgaagcaaaggatactagataacatgcccatcgccattgctcttcactctcattcataaatccaccttcaggaggtcttcccatcattcctggggctattgatttggtcgggcatggcaagcatatcacgaggccgaagaattcagtaagcgatccataactcgtcatcgttcgtcttcgtcatagtaacagtcaagaataagcacaaaagcaataaaaacactaaacgtaaatgacagaatcaaaatttgttgtgacaggaacattagcgaaggcccctgaaatctcgggctgatttttgtaccacattgggtttcaggcataggcacgggaccggcgagcagtggccgggctgcggactaatgtgcataacagggagtcgggacgtgactgcttcggagtcggagaacaatacctgctattcctggtttctgttcgttgctagatgcctatccgtctggagtgcgccaaccgggcaaagattcgacccccgctttgtttcctgcccgtcccgcgtcacgatgtctgtgcctatggtacgacctggggctatgataactggtggtaacttgactggggtgacgtatcgtaagggaggggggattaggaaactattgtcttgggtttgtttattcgggggcatggtcctttccacgcgtacaaggttccccagatgtgaagtgggaactgtcccaggtgcggttgatagggtgtgttagacctggatggccggagtcct

SEQ ID NO: 102504 - DNA, 141 bp, Triticum aestivum
  Clone ID: PAT_TA_102504
cggataattaaaaccaataaatttctcagatgttcatatcgatcacaagacaggaaatgcaaggtccaaaactaggttacatgcaagcatacgcgatccattaaaaataggacaaaagaccgtccatcatcaacactcgat

SEQ ID NO: 102505 - DNA, 281 bp, Triticum aestivum
  Clone ID: PAT_TA_102505
agcactggcgcggcgtaggaggtatgcgacttagctgattacggtttgagtatccgccatctccgatcacgatggagacacttgattcaaacgagaaagccatacagatctatactttcacatcttttcagagattaggtgacctttttgcatcgtctctactcagtacagtgtcataaaaacgaccctatagttgatcacatttgctatgtaaactcgtaatgagagcatgtcggactagtgactagagtatcttatttaagtgttcatctttgattccg

SEQ ID NO: 102506 - DNA, 442 bp, Triticum aestivum
  Clone ID: PAT_TA_102506
ttgttatgcagctaaaattgcacataacatactagacggacgcctaaagtgtaaagccgtgggtggctaatgagtgagctaacttacattaagtgcgttgctgtcactcctcgctttatcactggggaaacctgtagtggcagtctgcactaatgagtccggcaacgcgcggggagaggcgagttctcctaatgggccgatggtgcgcgatcctcgatcagtttcgtcgctctccccgggcggactggggaggtgggagaggctatcaggctgaacgaaaagcggtggtaagtgtagcgacagactcatctgtacacccgattgttaagatcaagctctcccactgcggacgcgaactatattccaatccagagacaggcggaggtgaaggcctttttacattgagtacgactggtgcccagccacactaaggaatactcct

SEQ ID NO: 102507 - DNA, 596 bp, Triticum aestivum
  Clone ID: PAT_TA_102507
acgtcgtgactgggaaaaccctggcgattacccaacttaatcggccttgcagcacatctcccttttcgccatgctgccataattacgcgcagacggcccgcacctgatcgcccatgtcccaacaggttgcagtcagcctgcaattgggcgaatctggcgccctgaatgcgggttattttcatctcttagcgcattctgctgcgggttatttcaacacccgtattaatgggatgcaacgtctcaagtgaccaaatcatgccttctgcattacccgtcagtacgcttacaagcgcagtcctccgatcgacccggtccacgagaccccggcattgatcggacgcaccttgaaccgaggcccttggggcttgcatcccccgtgcatcttccgcctttaacacgaatcccatgaccttaatcgatctcggtcgcttccgggtccggtcctggcattgttagatcaagaacacggtttttcccgcccgttccggaccacccggcgataactgggcgtccggcggatactgtacaagtgggcccccacctgtcgagtgtatctcgtccaaatttatttctgatataaggatatatagtttagc

SEQ ID NO: 102508 - DNA, 451 bp, Triticum aestivum
  Clone ID: PAT_TA_102508
tgaaattgttatccgctcacaattccacacaacatacgagccggaagcataaagtgtaaagtctggggtgcctaatgaatgagctaactcacattaatttcgttgcgctcactgcccgctttccagtcgggaaacctgtcgttccaactgcattaatgaatcggacaacgcgcggggagaggccgtttgcgtattgggccctcctccgcatcctacgctcactaagcctatgcactacgacgttcggatacggcgtaccgtaatcactcactcgaatgcttgtagatccgttatcccaataatccttatataaacccggaacataactttcaataaaaatgaccatcaacacgtccgaaaccgtataaaatctggttttgcaggctttttcccaatggcacctccacactatacagtaaaaaatcaaatctacctcagctcaaagtcgata

SEQ ID NO: 102509 - DNA, 389 bp, Triticum aestivum
  Clone ID: PAT_TA_102509
tttttttttaggatgtaaaacaataaatagaaaaacggcatataacacaagtctacgcagataattcatctttacatcagacaactccattcttattatcagctcgaagacagtgttatgggaactggattgttttttcttataaaagccatgctctaaaagaggggggaaacaagatgcatcccaaagctggaagcaaggactacgcctagcagaaaccatgaatcggagagagttttcgcccccggtgagtgtaggtttcggctgcaagggtttttatatttgattcaatgcacctcgcaatcagggaccaccttgatgcgagaacatctgttcctaaagcagccgcccttcaagcttgtaaggcccgacttctgttctatgagaat

SEQ ID NO: 102510 - DNA, 384 bp, Triticum aestivum
  Clone ID: PAT_TA_102510
gctgtttctgtgtgaaattgttatcgctcacaatttcacacaacagtacgagccggaagcattaatgtgtaaccttagggctgccctactgagtagccaacctacagttacttgcgtgcgcccacatcacgcctttcaagtgggaaaccctgtgatccagcgtcaattaatgagtggccatcgcgcggggacgaggcgggtttgcggtattgggcgcgtgttccgcttcgtcgcatcaatacatcgctgcgctcgggtcgttcggcctcggcgagcggaaataggctctagcaaaaggcgggtaatacgggtagtcacagaaatccgggggtaaccggaggaaagaacagttgaagcaaatggccaccaaaggcccaggaaccg

SEQ ID NO: 102511 - DNA, 630 bp, Triticum aestivum
  Clone ID: PAT_TA_102511
attaacaaacattgccgttattagccttacaactcacactcaacagattatcaaaacataacacaaagggaaaaagcgagagaagggaaactaagcgctaaacaggaacaacacccacacatactcggaccatggacgtttcagatcagcacacacatcagtttatgtacagggcccatgacaacacttgaagacagctaattctggatacaccacagtgttagttcatcttgatagttctttgatccagcgcggaggcacggcaagcactaccaatcttttaaagggctaacgaggaaaccaacaaccggcccatgttcccaccgttcttcaagaaaacctgtttatggcaagcctgagggcccaggcctttggcctcctatcgacacccggaagccagggtattcacccttttgggccgttcctgaagggcccccccccgagaaaaccggacgaaagaattttccctgggaacccttggattcctccaaaacctacctgttccctcccgggccctttgggaaagagttcctccaaacgaaaaattgcccacaccctgtgctttggggcctttatcttgttccgttcccgttccggttccttctcataggggggggggcgccgttccgg

SEQ ID NO: 102512 - DNA, 555 bp, Triticum aestivum
  Clone ID: PAT_TA_102512
ttgaacaaactctcgcataagcatctctgtaaacatccaacagcaacaaacgacggacatgtatatcttaagcgtatctgcacacgtctgtacagcaaactaagcatcatttggcacagtaaaaccagttcctggaactttctggatggttgcccaaagattcaggccttagacccgtttaattagtttacccagaaaaaggcgaaaaggctttcaatgttccaggaccttccgactttcctttgggcccctttcgtttggggtggccggcccggctgggcctggtagcccggggcagctggccagtccgggctgggttgggctgggggtggccattggattcttctctgcgggggccccctgcagacccaattgcccccatccttcccccctgcgctggggccagtacctttgccttgccgccccctggaattttggggccctttggcctactttgggggccggcgccccctttgggccctgggccgaaagttgggttccccaggaaaatgaaggtttcctttccccgcccccgtgggctcttcccgctcccga

SEQ ID NO: 102513 - DNA, 608 bp, Triticum aestivum
  Clone ID: PAT_TA_102513
ttaacaaacttcgtgcattaagcatcctcgtgaaacagtccaatcagaacaacacacagattatgattactttaacggatccgtgacacggcttgactacaaaacaaagactacttgcaccaatgaaagacaagtttcatgaacccttcctgacctgttctcaagaagttacggcccaagccccattaagttaagataccatggacaagcagtaaaagcctgtcaatggtcaagaacccttcaaccttcctcttggcccttccgttttgggtggcctgcttgcctgcccatgaagcagggcgaacggtgcaacgcccgagctggggttgcctaggggttccactttactcgtccctctgtggcccactttgatgcccaaaatccatcgtcccctccccccttcccttgggcaaaaattcgttcccgtcctgccccttggccttttggccatttgggttcctttcgggggggccggcctttggggccctcccgggaacttcgggggtctaaggataaaatgggggccctttcctcctgctttttggccttttcccttcaaaggccctttggggaacccccggggggcgggaaaaacccctcccccccaa

SEQ ID NO: 102514 - DNA, 342 bp, Triticum aestivum
  Clone ID: PAT_TA_102514
aatttagtgaagtaaaaggtgttgatgaagccagagccgaactcgaggaaatagcgcactaccttcgagatccaaagcgttttacactgtctggggggagaacgtgcataatgatgtgctgcttgagggatctgaaggcacatggcataaccgtgatcagcgaaggctattcgctggagcaaccattgatcctatcgttaaacgaagcagaggagagtgagtccggaggagatagttagaggcttcggaattaacaagactaaaccgaatattttgcaccaagtatacagatgaagcacgtataatcagcgatactcagcgaaatgcagcagaatcggggag

SEQ ID NO: 102515 - DNA, 1747 bp, Triticum aestivum
  Clone ID: PAT_TA_102515
gcattcgcgcactcgcgacccaaggactgcgcgccatccaagactagttgatatctacttgccggtatccgtttcaacatgacgccactgcgctaagtaggcttccttcggccgtacgtgtcactatttgaaccgtaatacaacgctgactcgccgctgtcatagacactgattacctggattgcttgtcgaaacgtccatgtcgtattaccgcgtggcatgtagttcgctgatgccgcccgagccttggggctatgaacggcatactatgcaaccatggcatcgatgacccccacctatgctatgttatccttaggcgtcaatccccaagttcaacttatcccaagtccccctaaggcaagccatcgaatgcagctcgaaggtaatcttggcggatccccaactcaccggaaaggacaatgtccggcggaactaattctaaaccggtcttcagtttgactgcgtgcgcagtccgcaattacgaaacggcctgctcaaatcggtccgccggttcagacatgccaatttagacccatctcctttacgaaccctccgaataccccgggacttccaggcaacccgaataacgcccaaggctacccaggtccccagccactggcccacctccttatgcccgaaaccgggtattccgcctggagcgtgtcgcaacgaaagcgcgtaacgcttgacgacttgaggacggaatcaaacgaatattggagtgcattattaatgcccgaaatagtccgcgttttaccactcgggaatgacctcggccgcaacgcccggaatgacctacagctgaacctccggatagcctcttggtatcgcttcacactgtcgcaatgttcctaccgctaccagggtaaccattaactgcaagctagtccggtccccgctgccattgtcctgaatgacccaaaagctcaagaaactcgctcgtaacgggcccacacgtgcacgtcacccaccgcaaatcgcctggtcaaggcacctttacatggctgtcgtacatctcgcgccaacgtacctcgccatcgcgcatcgaaaacatgcgctgatgaccgttcctgttctccatctacgtagccctgaaactcgccgcctgtttacacccactctcaagattcatatcccccctcacaccccctggattctacctcaactatgcgacccagtagcgcaaaggggcgtcccgcgccaaacgccactgatttttataatctgcaacccaaacgtacacaaccccagaactctgccacctactaacgccctccataacttgtccatcttgccaaccattcgcggtcgtcgcgaacatttgaagcggcccaccttgcagcacgtcaacctcgaactacttcaccgcttcgcgcatcggcctcaactgtgtatgtgtaagcgcggctaggcatcctagcactgcttattaaaacactacgcgacccgtgcacgcactccgggtgggtgttacttaacggcgatctcgtgctgtccccggcgttccccgcctaccgacgccttcacacgtatcgccctctcttgtggcgccgcaacccctggggtgtgcaacgggcgtcctcgaagcccaccgacgttataacgtgtggagtcgcctccttgcgctgttcaaccagcgacctccaataagctctgaacttccgggcgtccgtcctccttgcccagctgcctagattcccatacccccggaattacgccgctcagtacttcggaccctcttccactc

SEQ ID NO: 102516 - DNA, 517 bp, Triticum aestivum
  Clone ID: PAT_TA_102516
cgacacatccaggaattcgtcatcatgtcatagctgtttcctgtgtgaaactgattatccgctcacaattccacacaacatacgagccggaagcaaaaagtcgtaaagcctgggagtgcctaatgagtgagctaactcacattaattgcgttgcgctcactgcccgctttccagtcggggaaacctgtcgtgccagctgcattaatgaatcggccaacgcgcggggtataggcggttttgcgtcatgggcgctcttccgcttcctacgtgcactgcacttcgctgcgctcggtacggtcggctgacgtccagcggtccatcactccactcgcaggcggtctacacgtttgagccatagaagcacagggataaggcaggcagcgactcagccaccataaggccataacaggccaggaaccggaaaaaagtcggcttgtcaagcttcttccataagctccgcccccgcagcgataccaccaaagcccagttccatgcccgacgccggaaacccacagac

SEQ ID NO: 102517 - DNA, 395 bp, Triticum aestivum
  Clone ID: PAT_TA_102517
ggcctctagacgctacgacgactcatcggagatgttgctcgtgttgaaggcgcagcatggtacgactaacagctcggctgcttacgcgataagtcacgtgcgttctcggcagcacgagcgtggtcgtcggatcgcactcggacgctcgtacttggcagatcgtggttgagattccgtctgggtgtcacttattatacgtttccattcggttcgaatgatccgagctcaactaagccgctttaagatgcatggggtacgttagtactaggacgtctcctaggcctagatcaagcttgttgagggggtggttcacagaaattcttccgctccgaatctttagttagactccgatagtgaggaactatgtagttcctgagcgattggaaacgtaaaag

SEQ ID NO: 102518 - DNA, 424 bp, Triticum aestivum
  Clone ID: PAT_TA_102518
aagtgctattgatggcaggactactgaatttcagcttccaagtgctacgacagcaacggaattcgtaatcagtgtcatagctgtttcctgtgtgaaacttgttctccgctcacgaattcacacaacagtacgagcacggagcagacgagtgtaaagcctggggtgccgaactgacgtgaagctacgcacagtaagttgcgttgcgctctactgcccgctttcacgtcgggaaaccatgtcgtgccaagctgagtaactgactcgagcagcgcagcggggatggggcgtgtttgcgtcttgggcgcctctctcggatcctccactactacgtcggtcacttcgggtgatcgcgtcggcatgcggaagctacgtacgccaaaggcggaataacggcattcacaaaagtctgggggattccaatgaa

SEQ ID NO: 102519 - DNA, 503 bp, Triticum aestivum
  Clone ID: PAT_TA_102519
ttggtttaattttcgtgcaatagtatatagatttgtatggtatagtgaaatgcatggcatactaatgagcaaattactaaggggactcaaataactgtatataaatcttgtgttcatacttttcgtaaaagtaacatcggaacgacaagtgagcgagatccttgcaaattcttccttgaaaccccctttcaagctatggagactggggccaaagatactctttagccaaatattaattaagttacttcgtcttgtgatcggccggggggtgagttaagtgtattactattggcttttcgggaccaacggaaccgcaggaaaactctctccaccggccctggctaaaccaaaagcccgcgtggcttcaccttgttcgttgcaccagtaccagcctttgtcctttattagcccccttcccttgggcctcccagggccaatggttcccttccccttcctccccttttacccttcttttgggtccttccccttatattcggtcctcc

SEQ ID NO: 102520 - DNA, 577 bp, Triticum aestivum
  Clone ID: PAT_TA_102520
cgacacaacggaattcgtaatcatgtcatagctgtttcctgtgtgaaattgttatccgctcacaattccacacaacatacgagccggtaagcataaagtgctaacagcctggggtagcctaatggagttgagctaactacacatttaattcgcgttgtcgctacactcgcccggcttctccagtgcgaggcaaaccttgtcgttgcccagctgacatttaatgtaattcggcccaaacgcgcgggggtagtatgccggttttggcgtcatttgggggcgctacttacccgacttggcttcgatgccattggcactcccgtagaccgataccctccgagttgccgggactgcatgtgaggaggtgggaaagccagctaaggctttccaacagccacgggttacagtgtctgttttgatccccaccagcaaattccaagggaggggaaggaacggccaaggcaacaaggaaaacaatggtcggaggccatagaaggggcctaagcaaaatgaaggggccaagtcgaaaccactcatgaataaaggtcctgcggttaacgttgggcccgtgtaatcaccc

SEQ ID NO: 102521 - DNA, 508 bp, Triticum aestivum
  Clone ID: PAT_TA_102521
tgtttcctgtgtgacattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatcgaatcggccaacgcgcgggcgagaggcggtttgcgtattgggcgctcttccgcttgcctcgtctcactgactcggctgccgctcggtcgattcgggctgcggcggaggccggtaatccagcttcacttcatcggggcggataattacggtttcatcccacaagaatccaggggggataacggcaaggaaaagaaacattgtagactcaaccagggcccaggcaatcagcgccccaggaaaccgttaaaaaaaggggcccgccggtttgcctgggccggttctttttccataacccttctcgccccccccctgaaccacccatttctcacaaaaacccgc

SEQ ID NO: 102522 - DNA, 432 bp, Triticum aestivum
  Clone ID: PAT_TA_102522
attcgtaatcatgtcatagctgtttctgtgtgaaattgttatcgctcacaattccacacaacatacgagccgcaagcacgaagtgtaaagcatggggtgcctaatgagtgagcgaacatacattaattgctgttgcgctcactcgcgcgtttcgagtcggtaaaccatgtctatgcagcatgagttagtgctctgctaacgcgcgggacatcgccggtttgcgacttggctcgtgtctcggttcgtgcgacgtacgctcgtcggactggctgactagcttccggaccgggatatgcgcatcactattgctgactagcaggatgtagctagtatttgaggatcaccaagtaccacactgtgtccaggcaactacaaaatgacaacgccagtacaagcgtgagatcttgagctttcacttagacttcttcctgt

SEQ ID NO: 102523 - DNA, 1530 bp, Triticum aestivum
  Clone ID: PAT_TA_102523
tacaccacacgctgactacgcaacatccctccgcgtgcacgcgactacagcctcacctctacatggtcgacactctcaggtcgcatcaccaagcccgacacgtcacgactacatgcaccgctcgcacccactgcgtagcactgtcttacctccaggatcccatgccattacgtgctgcactagcctgctaccgtcggctaccaccacgtccacggaccgccatcacacgtcctcctccgcccaggatcgcctaccagtgcgggctggaacgccccccggccttgtcgccgtccagcggctccgcccatctggacccaccagcgggtcccacgtcccacgtcatactacgactacccgtccacgtactgccagcgaccactgcgactcctcggaccaccgcccagcaccaccaccgcctagcccatcgcccatgcactactcagctcaactgcccgtactagcagtgactatcgcccactaccgtcagtccacctgagcacggtccaggtcccaggtcacgtacccctcgcacctgcccagcgttacctagcttcgaccaggacggacgagcccgtgcgtgcttggccgacccaatgctcaggaccgcctcagtcgcagctccggcctacgtacgcatacccagtactcactggcaagtccggcatagccgaccataacggccttccgcccacatcaggacccaatcactgctcatttctccgtagctccgaacaaccattgccggccgctcagcccctacatccgaccgccttgggagcgatgagattcctcccaccaagcaccgacccagggccctgcagccccctgcccacccatttcgttccctccttccccccggactaccttagcccttcggggctcaaggctcggccctccccttgcacccccctctaacccccggccccaaccgacgactttgccgttcaacctgacccccccttctaaattccttagttccttctaaactcgcccgctctagctcacggtggccccgcttcgggccggcgcaccacccctgttcccccccaagccacccaccctatcccgtcccatcctcagcgcctaaccttccctcggccgacccgcctattcccaaaaacgactttatacgccgaccgctaccagccgtttccaccgtcttgcaatcctccctttccgcttcacgagtccggctttcgtcccattctctctcacgggcccaccgcactgagcagggcggcccgggcgttccgactcgctgctcagctgccagtccttgcgacctccccccgcccctccccaccttcccccagctccttgatttatttcagcggacagcgcactctctctacgctgaccctccccactttcgccccggccaaccaagtgctcgccggcctctgccaccgcgcgcctagacgccccccgggcccacatcatggccccttcccgctgacgccgagggacctacgtcgccgccacactcccctccccaccccgctctctcagtcaccccgcccccccctcccc

SEQ ID NO: 102524 - DNA, 420 bp, Triticum aestivum
  Clone ID: PAT_TA_102524
ggggagatcgtcggcaccttcgtgctcgtctacaccgtcttctccgccaccgaccccaagcgcaccccgcgactcccacgtccccgtgctcgccccgctccccatcggcttcgcgtcttcatggtgcacctcgccaccatccccatcaccggcaccggcatcaaccccgccaggagcctcggcgccgccgtcatctacaacaagaaggccgcatggggacaaccactgggatcttctggcgtcggcccggtttcgttggggagcggctggcgggcggccgggcggtaaccacctaagtacaatccctcccggcgcgtggcgggcccaattccgagtgcggcatcgagcgtcccgctccaggcagtcagctgacgcgaaaacgagcaacccgcctattgcagggacccgggacccagatcg

SEQ ID NO: 102525 - DNA, 376 bp, Triticum aestivum
  Clone ID: PAT_TA_102525
ctagcatatcagtcatactggaacgtttttcatcttgacgactcttgcgtcggtggtcattgttcggatacttgtattccattccattgatctacaatggcatctttccttgcaatcccttacgggtctccaacccctcaccattaaggctgccgttcttagctgcttgtcctccttcgtcgactctccctcgtccaccctccctgctcgttgtgccctcccaaagcacacctccctcgaacaccccggagtgcgtctcctgacgtcccatggcccctaagccatggccaccgtccagactccggtatcgcgagagcccccgcctcctcggcccgtctaacctctctccgaccatcactctttgacctatttcacc

SEQ ID NO: 102526 - DNA, 312 bp, Triticum aestivum
  Clone ID: PAT_TA_102526
ttggtttctgcaaatctatgatctaatgtggtggttttttgcaattcagtccataagaacatatggtacaagagaagacattagtaatcacaagtgcacagttaaggcaacagattccaaggaacccgaagtagagatgacgactgaatgttccacgacgaacactagtagataaaggtaagcagcaaaaaggatacataagagatactagccaaaacgaatgaaagatgttaaccgtatgataataagaaaacgaagggatacatgcagacgcgatatatgtgtactaagagaaacccgatgcgattcgga

SEQ ID NO: 102527 - DNA, 421 bp, Triticum aestivum
  Clone ID: PAT_TA_102527
cctgttgctgtcggagggcgggctccgccgggccttcgtgctcatcgacgacggctggcagtccatctgccacgacgactgacgaccctcgccgacgggcacgagggcatgaagcggcacggccgccggcgagcagatgccgatgcgcatcactcaagttccaggagaagcaacgagttcagggaccacaacgggccgccaccggcatttgcggctttcgtgcgcgagactgaaggcatggtgtttcggactggcgcaacactgctttccgtgattatagcaacacattgggcttacctgacgcgaagtatgggctggtcatgccaagacgatcccgcggaccaatgggctaggagaaccacagtctggtgctccagtgctaagaggaccaccggttgaaactgcaagtggcatgggctgg

SEQ ID NO: 102528 - DNA, 381 bp, Triticum aestivum
  Clone ID: PAT_TA_102528
cgacacaacggttttttttttttttttttttgtagctaactatgcaactgtatacaaacatttactgaattatgtgacaggattccaatttgcgacgacctgcaaggaattaaataccagaaccctgatattcatgaatcaaaaaaaaccatccctaaaaattacctactagctgcgaaaagtacacgacccaatgacattcatcacatgtacgggcagaaatacacaaacttacttcctacccccaagtagtcttcggtaacctaccgcaggcggcgtgccccgccgcacgggcggacagccttcatgcgggactaaccggcacagctgacggcggacctcgcccgcagagtagcagcgggaactgcgctgagcaggctt

SEQ ID NO: 102529 - DNA, 210 bp, Triticum aestivum
  Clone ID: PAT_TA_102529
acgtcggcttgaacgtcaagaatgttgccgtgaaggatctgaagcgtgggttcgttgcatccaattccaaggatgacactgccaaggaggcagccaacttcacctcccaggtcatcatcatgaaccaccctgttcagattggcaacggctatgcaccagtgccggactgccacacttcgcacatttgagtcaagtttcgctgagctggtc

SEQ ID NO: 102530 - DNA, 459 bp, Triticum aestivum
  Clone ID: PAT_TA_102530
cccttcatcaccacctcgacgaggatgcaggcatcatctgcagcccaggatcgacaccgccgcccccttctacggccgcaggaccgctcgatactcagactgaacgcagtccgtggtccgaatcgacctggggcacgtcggagccgtacacgatggtacggtcgagctgcttgtaccgatctcaccaggttatgaggcagacgttattagggatgttaacgggattgacgagcaagcgaacgtgcctattgatagattcctcgggcccggtacctatgggattcgcctggtttccgtctagaccactcatcggactgcgtatgacgtcttcgcgtggttaagtgtttacgtcgtcgacgttatctcgtcgagacggactgaggctgtggccgacctgcgtgaccgagcccggttaaccaagtcctctcctgtttccaaggtctctgggggaagtgggtt

SEQ ID NO: 102531 - DNA, 1408 bp, Triticum aestivum
  Clone ID: PAT_TA_102531
ttcacttgcacggttccgtcgctgtttatgaatcatggcacaagactccttagttccataagtatacttgtctgcctgcaataattactcagctcctgatactatcgaacttccaataacggctaatgcccgtcgtataagtagcatgtgactcctatccgtagttcatcatacaaccggggttctccaattgctaccaattcgaccgccttctaaagtcagagcgttcgatggtaatcgtaaagcttacgggtaactcagtattctgcttacatctacagattaattcacaaattttttatcctactcaattccttaaaccacctaagtccctccatagttactaggtacatggagatttaatatccctcctgacttaatagagtcacaaattatgagcaattactctagtgttcagcaagtatcattagtactaccttcgcgagtcctcattcagtaaaaaaacaatttaattttcctcacctctgtacaagctgccactagcgctgtttctatatgggtaacttaatacataagttcgcacggattagcttcagggtattcatttcttaagtatcatgatagttgtctgtataaccgtacgctataacctaacaattctgctaacatttccttaaaaacttcccactagttctaaaagttccttgttatgcttattgttacaggaatactgtacgagttgcttgattctagtttattcttaatattcgtgatatctgctagtgtatagtcgcgtatcttgcagccctgatatccgagtatttcccccatggttcttaaaccaaacattcgaccttcttaacttagtcacttagatcatagtcagcaaccctctcatgatacattgagccgcacttttctttgatatatgccttgccaaaactttggatatcacgctgatatattcttaatccacttgatgctgtagttcactctatagtaattcggtaccattctgtgccattttacctttatttggaatctaaaagctttcgtaaattttcgtctgctaatccaagaagaattttaccttcgatatcttgactacatttctttttattatttcctaacattccctacttatcttcctaaatagtttgctatatctaggattataaaatattttctaccgccgaacgtccaatggcataaatatattaaacaacacttaatacaagttcttacaaccatacagcaattcgctatatgatcaataaaaaatagcctcatcgattggaaccgatagacactgtttttcccacacttactcaaatacttaattcacaaatctaatttttcgattttctaaatacaagtttacttgtaatgtataactattaataaaaccttttgaccacattatagtaaaaacttagaaaactgtttc

SEQ ID NO: 102532 - DNA, 333 bp, Triticum aestivum
  Clone ID: PAT_TA_102532
cgccccaccctctgccctgtagggccggccgctccgaataagaccagagcactgcgcactacctgtctaaggcatagctcgaacaccagatcgcctcacgccaaagccacccctacgtgtcccccctccccggcccctcgctccccagatactccatcccagcccctttcacaaatggccctggcctgcacaccatccgctcgcatagtgtcccgcatgctcccctcccgtaacctccctgaacgtaccacactcagccgtaccttcgctggcctcagcttccccgccctccccgcccccaccgacccgtttgctcgcctaccgcacggtccc

SEQ ID NO: 102533 - DNA, 749 bp, Triticum aestivum
  Clone ID: PAT_TA_102533
ggggtcctactcgtggagaggtcgaggctgataacgtacagagcacgggcctccggtgaacaaagagacaaaggagcggcaagaataatcgacgtaatgaacctgagacccagactaccaagcggtagtctgataagtgcgaacttacagcttcacgagaattcctacggccttgctaagcgtgcgcgcagcggtggacgggcggacggatcaagcccccccatggacagtctctagcagcttgagtacctgtaggtcgcagatcacatggtggtctggcagctcactgcgtaagggcgctttcatggaccttgatagataaagtatcgcatggccctgagtcttcccgtaatatcattgtagctaacgcggatcacttttttgcgcgccgccttccagatctcctagcatcaaggtgccacgtcgccaggctgaaagtgtgccgcacgtgtccggagcgtggctgggtcgaagagcttccccggtccctcggcgaagttagctcccaacgtctgttacagacatccacgcaaaacgcgagacccgcggtcctcccgacgtctccgcgcccattcgcggaacactacgagtggagtgatccattcgactcgaggccacctaggaattcatgtatatgcgtctgaatatcagaagcgacccgtgactattgttaggtctagttggtcttctggcagcgtaccttcggtagcatagcacgcatgcgtggcatagtagacgttacaaagcat

SEQ ID NO: 102534 - DNA, 456 bp, Triticum aestivum
  Clone ID: PAT_TA_102534
agctcccgaagccactactagctagtagcacactagcttagctgacatacaactctgccccttctctgtctcttcctcttccgtcgggacaggccccagcccagctgctgccctaagtattaaagcaggcaaagacggagaattcattagattaaacgaagaacgcctggcgtcggaccggcccggcgtggagatctgctctttctcccccgggaaatttcctccctgcttcacgacgattcagtccccataccggtctccggaggagcgccccagaaatccggtcctccttcgtccacccgggccaaaacgaccaaggccaatccgcagcaaaaacgagatgggtttattcaagccgtggacttgcagggtaatgaagggtaagaaccgggggcgggagtaaagaaccccgccatggcgacaaaaaacaaacagagaggataccggggacctgag

SEQ ID NO: 102535 - DNA, 628 bp, Triticum aestivum
  Clone ID: PAT_TA_102535
ttggtcgctcaggctgcctgttctggtggtgcgggcaaatcaatcacccgctccttccggctgtgcccttgcggcggtacatgtgctgcctccccatgccgtccattcggtctctcccacgcaggcacggctcgttactatccttttcccgtcatagcgcgcttccgccgacgccggggcggggcctatttcccctagtgcacagacaattcccttctagctggcccattgagccccgtccaatgccgttccacaccctgttgctggtaaatcgcgctatgtggtctgtgcgtgctagattgaaccgaagtgtaggctctaacggacaacgcctgtgtcccaggcctttcctcatggtgattgggaaagcagccatgtggtgtgcccagtccggctttaaagccgcgatcgccttgatccgtggttaaccccacccgcactgacacaataattcgtgattgtgtcgtggctcaagcttggcaaggccatccgctaaattaccctagcgcttgctggcctgaagacactttctccctggccactcgatagtccctctttggtttgaaacctccgcagttgattccgccagagggctagccgatccaggcgccgcgcctatccgcacggc

SEQ ID NO: 102536 - DNA, 1165 bp, Triticum aestivum
  unsure (1)..(1165): unsure at all n locations
  Clone ID: PAT_TA_102536
tggtacgagcctatgaaccaaggattcattaactgactgatcctgcttgtcngtgcggcctatccgcctccaagctaagtacagtatcgcgggaggttaagcgggagccaggctaggaaatcgtccacgctcggaatccttgcatgtctcgacgctcgaacaaatgcctcgcgtcccagccctaaccgccctacctcaccgccctagtccttgtcacggcctacccgcatcgcgttggcgcacatgcacttgtacgtccgcgacctctagacgctactggcctcgcatgtgccacaggactcactgatccacagtaagcctggtcgggtacgtgctcgacctccccgaccttacacaactccatgtacccctcccaaacgactactagaatacgagtatcccagacctctccagacgctcgacccacacgcttaggcgctaaccccgctaaacggccgcgcttcactcaaccggcctacttgttgcccggctacccctcgaatcgcctcaatcagctcccctgcacgagctgaccttgagtcagcccacttccccgttccctctgctcaccgcggtcagaccccgctggcctcccgtcatggcgcgtatggcacccgagtttttgcgctgaacgtaacggcgttcattcgcgcagctcctgacagtgggcctccccgactgtcccagaatggatgccccttgccgtggccgctctctggatcgcgcccgacacgcgccccgcctcttaagcagcccggcctccacggacgtgatagcccacccgcgtggcaacagagggccgtgtccaatgccaccgcgagctctcccccgacgccacgttcacctcaccttgtacccgccgactcctcagcgacagctctcgtcatcgcggacgcgctcttactttgcaacgcacttctcgaccgacatcgaccctgttaccgcgacgtttaagtgcagccgccatcgtggtgtcatatcacgcccccgttgcacacccagtctccgcgtctcgctcgcgagtgctcctcgcatcctccgcgggcgcgcgtccactacctagttccacctccccgccgacgctctcaagaacaccccccgcgcctgaaactcgctatccccgttccgcgtccttcggaaagcgccaaggtctaggcaactctaa

SEQ ID NO: 102537 - DNA, 653 bp, Triticum aestivum
  Clone ID: PAT_TA_102537
tttttttttttttgcttgtgttcttgacacatttctgaacacgggagggaatgctacaaggaaaggcaaatcactagctaccaagcagtgggccttgcaggtttagttttcagcgcttcattttttctatgctccgacattcaaacggaatttcagtaattcaatggtcagtaggcatggtatcactggatgcgaatattggatactccgggttcgacaaattcgcataacggacaatagcgaggcccgggaatgccataaaatggtagtaacaggccatgggcggatttccggaaatcgatgacggatgtcaaatccggcattaacgaaatttggtcagccggtttctgccaaccctactccctttccgtcttcccaaggatcctgtttatttgaccctaagttagataggacctagtgaggccatgccagctgcagacgtgccagggggagactgcttcggtcagcgagtcattaagcgcccgatgcccactggcctgaaagtgtatgtggctcttcttacacggcgccgagcgaattcaccgtccacatttaatccgctcacttgtttctccggtagctcgcaaggcgcaaccacaaacgcgcacaagtggtagtgggattggcagcgaagggggacgatcgctccccac

SEQ ID NO: 102538 - DNA, 733 bp, Triticum aestivum
  Clone ID: PAT_TA_102538
gcgcgtgcacgaagctccacagatctccaaaccagctctacgctcgcccaatcagacccatagggctacgttcgacctccctcctgcttccctaccagccatcaggcactgcatgttgccttatgcacgaccgaccgcccacagccgccctactggacccacgcgatccccttcccaccgctaggatgccccgtccttggcccgcaacccgcgatccaagccgtgactccaggccccgtcggtccccaccggcaccctcagtaacgctgaaaccacccccatcacgccgagcccgaggccgctctggtccgccgtcacgtatccccgcccagggccaatccgccacgctgtcccacccgcccacccgtccacccgaatccccccctcccgcgccgccccactaccactccccgttcaccatccgaccgtgccatccgtgcccaccgcacctgccccaccacggctcagctcctcgcaggccccgtgcttgccaaagacctccaccgaaacgccccccacggccaggacatcagccattccccatctccgcaaccgcttcacccctacgccatcaccccccatttcgcctgcccgcccattccgccacccggtgcccgcccctcccgtcccccccccgccacccctccccgcccccatgccccccccgcacccgaaccccccgccacaccgccactcccctctgttcggctcacccctactcacggcccccctc

SEQ ID NO: 102539 - DNA, 325 bp, Triticum aestivum
  Clone ID: PAT_TA_102539
tttttatttttttgtaaatagaaacaagattttaagatctgttcacatagataatgaggccaacgaaacatatccaatcactacataggattttaaggatctagttctcaagtagaaacgttaactggcgtaaacaaaaaattcgtaaaatatgtgatgccgtgactatcacccacgacatggaaattggactcacgagcatgcctacccattcaaaaattttaaatgagactgaattagagaaaattaggaatcaaaaaggaaaaacccaaaatgtacaaaaataaaaaaacgaatacaaaaatagaagtaaaaaaaaaaaatt

SEQ ID NO: 102540 - DNA, 174 bp, Triticum aestivum
  Clone ID: PAT_TA_102540
tttttttttttttttttttagaaagaagtcgaattcataatttggatagtattgaacttgttccaaacgggaccagacatagcaatcacctttcgcctgtggaaaagattggatcgccactagtgctcgaaaggggagtcgaactaacgaccgcaggcaacgaggagtgtttta

SEQ ID NO: 102541 - DNA, 684 bp, Triticum aestivum
  Clone ID: PAT_TA_102541
atatcatgttctggaggcataaggcctggtttgaggagtgaaggaccattgaaagccacagattcttcccattggatcctttttaaggtcgaacattgagggcacctttgatagaagcctccagtggttatatggacaaatattaccgttcttgcgcagcaactaagtaagttgtagtacagctcttctttggcatggcggtgagtcacttccaccctcgtccttattgacggcatctattcggccatcgcaactcatgtttaccgaccaaggcattacgggtgaatgaggcatacccgatcatgcgctcgccctggttacggaattcaatatggttccaaattacgtcatcccctgtaagttagatggatccgggtgggaagctcttgcttaatactatgaaactacaacaaattatttgacggaagataaatcacaaatgaggcgtaactgtgcagacgttaccgaatgttcctcgttgcttagacctcaggtggtggagtccccttcgtaacgaattgtcccgagtaaaagtgccgaatcgtcctatcgtctgatgtccgttttttgagcgtcgcggagggggtactggtgccggccttgttagcggcagagccgaatccgggattgcgcctcgggtcggcagcatcgtcccccgtgagggccaaatcggtgggctctgtt

SEQ ID NO: 102542 - DNA, 285 bp, Triticum aestivum
  Clone ID: PAT_TA_102542
accgtcggcgggaacgtgatcatggcgcacggcctgcagttagcatctgacatcgccaccggttcttctcgagcgccggctccacctgtcaccatccagatcggcttccaaaagtgctggtgcttgactgcatggaggcaatttactggacggagacctcccgtgtgatgcgcaatgaccaataactggctacacgagtaccttggtcccctgaacttgcgagttcaagacaacttgttactcttttcgaccaatgtccccggcgcaaacatccccatggaacca

SEQ ID NO: 102543 - DNA, 637 bp, Triticum aestivum
  Clone ID: PAT_TA_102543
ttcttgttttcttttccacagaatcgccagtgcagtgtcttgcaccagtggaacggctagcggactcagtcgaactcaggctaactcaggttacgtgcaagtaggacaaagctaaatgcaccatggccagtcaagagccacttacactgcacggagcctacccgcactagcaggacgttaggtggtatgaacgacagccgacaaccgaggattgctatctcccggctcccaaagtaagaatgatcctttgattcgacataacgccccgggtgcctgtttcaaacgtcaaacccgattggttagcagggcagccccgtagcaaccctccaggctaagatccctggagaccgaggatgcaacattacggcccaaggccgactgatgtccctacaagcggtagttcactgcgtgcccatgcccaataaggaaacttcacgacgaactcaatggagtcgcggtcaaactaaaccccccaagctgcttgtgtccaaccttagcccgccaaactaaagccgacattgaaggcatagagacgtgcttcggtccgagcatatccacgggatcatgtataccgtgcgctgcatcggctagcgttttcgaataggcgttccgcggtgctctaccccccggaacgccc

SEQ ID NO: 102544 - DNA, 242 bp, Triticum aestivum
  Clone ID: PAT_TA_102544
gcggcgtaccgtcgctgcgcgtcaacatgccccccgggctcggttcatcaccgccggactcctcgcagtccgttgctctccctcgaatgcgcgcaagcttctaactttggctccgtcggacgaacgccaaatcctcggactaagaacagtttagctcctccgatcggggagcgtttcattgtgctttcccttacgcgtcttgcatctcgaagggccaataggacccgccttgctgcatttcc

SEQ ID NO: 102545 - DNA, 1504 bp, Triticum aestivum
  Clone ID: PAT_TA_102545
cgaactgcgccgacatggaattgagtcgagtccaaggtaatgaagagcatgcatcatagagctcagtcgatcaaactcgcacctgacaagtgcatcggtaactaataacgtgatcgaagttaattcaaagtaaacttcgtaaactccgagtcaaggcgtaatcgagagagtaacagtttcacccggtgcttacaggggaccccgagccgcaagtgccgagttacagcggtcccaagtcggttgtaacggggcacggttcgggacataaagacgtgaaagccgtagatgaaagtcagagtacaccgtttagcgccctactatactgcataacttacaaagtgacgccgtttagttacatgacatatctaaataaagttagcgaacattacgcccttagatatcgagcatacgattaccaagtgaggctacaaatgctgcagaaagagaacaacactgacaagaagtatggagccaagcgtgcctcagaggtgcggcacctacggcgactatggggtgcctgccactactttgaagaagctaaaaattaattgctttgaccaaagcacaagtgcgttcgaaaaagacacaggcataataatcagtaggtggctataactcagcggccaatatagggtgacgcacaattgtcgtaaacgcatatgcaaagtcaaataacgctggcgttcaactagtccacgcgtcaagatgcgtggaacaaaacgctgaggaacacgccagtgacgagaacattactttgccggcaagagttcaacacgaaggaggaggatacaccctagtagcctgctataggaacagtagctgacggttgaaggagcgatccgagtctaaacttcaactcaacgaacttagcgataacaacgttaaatagctccaattcgaatccctaagatgcacaccacgagggaccatgcaaccagttcctcacaataacggcaccccacctttgagttcccacaatggcagatctagaagcttaaaaacccctagcaaggaacgactaagagtccactagcatggaaagcttagcagaagaaggctaaccagataaaaaacaaacgcccagcgagatcaaacacggctgcaataccagaggaatccttgacgtcaaggaccaccggcggaatgagttatacgtatagacgtcaaaacgacccacattcagcatagtatatagcacacgaaacatcaagaatggaatcaacgatactatgaatacagtgtctcacgcttcaccttcaaaaagttaccctgagtctgcactaaatacgacccgtactttctgaagctattctgcgaaaagactggcagaatcattgccataaaaatacaacacctgccgtgtatgtgcttgtaactaacaatacgagaatacccaacatataaggtggaaaaaaacgactccagaggaggctaggaatgacagttagctgataggatgaatcctcccatcttaacgtacaaaatactcccaaaaaaggacaga

SEQ ID NO: 102546 - DNA, 243 bp, Triticum aestivum
  Clone ID: PAT_TA_102546
gacgtattcatatcacactgcacacagaaacaatgaaggtaaatatgccaagccagattctaagccggcataattgtaccactgactaaaatcagcaccactccagaagtaaataggataggggtatcgtgacattacaatcggtttcacgcctgcatttgtgctcagcgaagcgaagcatccaggacgattagccccgaacaatgcgctaaccttggcgtattcaacgcttgaccaccgggt

SEQ ID NO: 102547 - DNA, 1557 bp, Triticum aestivum
  Clone ID: PAT_TA_102547
tcgccgacttcgcccgggcccaggccgcatccgaccaccgccccgcgactcctccgcctaatccctctccactgccacccccccgtcgaaccccacgccatccccattaaggacttcctcgcgacgctccgatagcccccagtgccattacgaccagttcacccacagccgcagcgaaccctgccaacgtgtccgacggcctcctaacctccaccgcgaccccaccctaacaccggcttccaccgccacctgaactacaccgtccaaccgcccctcccattctccacctaccaacgtcacatcctttacgatgccgaggcagcctcacctcgcccttagtcgatagcgcccgcccacccgaccgagatcccgcccatccgattcacctccccaggctctggctaccacagcgaccgaccacttaccctaccgcgccacccgccgccttccccgctcgcaccaccgatccaacccgcccagcaacaccggctccaccactcggaacccacccgctttactgcgcagcctctgccaccgcagtcggacccaatcgcccgaccgtgacaagttcccggcctctcacccacccgccatgacccctcacaaacccaggacggctccatcagggccagtctcacaaccggcctaccccccgggaactccgacctgatcctttggcgtccctccccgccccttcccggcaaacacaattacttgccggcccgcgtctgctcggcccctgacgccccccacaccgttgctatcccgactccaccccgcccattctgccgtggccccgatacggccgctccggctaccacccccccctcaccgcccactccttcgcatcgacctccctccacaccctccacgaggctccaagccgcccacccacctcggctcctcagacaccgcctcgacaccactgccgcatgctcctcacttacctggcgcagactcctcgcaccccataccaagcgtagcagcgctcagcccgccaccgctacctaccacgcccactccctatgccagtcccgccccacactttgcggcgcgcccctcaagacgaccgaccccctcccagacgcggctcgcagcatctgcccccgcccctccagcatgctgtccgctcaccctttccttagatctaccccgtatctaccccccgcgcccactcaccctcttcgatcccagctaacgccctcccccctctcgtatccactgggcgccctcgcttccacccccgccactcgctaccgctcctcccctattgcctacgtatcccggccggatcccgtcacgcacacccgcccccctgccctgctcaagcactctgttctaacgcaccctcctcggcccactccacacccctccccgtcgccctccccgcgactccggcgccctcggctgccccgctcatccccactccgagcgctctgcgcatccccctaccttcagaaccaccacctccccgccacctccctccgcgaacctccatacccagccgcctacgccccctaaactggaaccttgcgcacactcccctcggcctaccgc

SEQ ID NO: 102548 - DNA, 2420 bp, Triticum aestivum
  Clone ID: PAT_TA_102548
cacatcgtcagaccttcgatatgtcagcaagttcagaccacacttggtcatctagctagctaattacctagaacatacatgcgttgatgcttaatcgctcgatacgtcagtcattcgtacattaagtcacacgtgctccactagcggacgcttgcatcgacccattgcttaaagctcatacgcgtgaaggcggccgtgcaaaaaggcttgagcagataacgtacggcacgtaacttaggcctggaaggaaggctccacggcatctgtccgtacagtcgtagaatcgctctatactgcaattccagtactactgttagactagagattgaagaccgaaattaaggagaaaccgtttccgcaaatcctcgaaaaaactcagggaacatatgcgggctctccatcaaatagcgaaaaatgaaactcaagggcccgatatacagagcgtagaaacaaatggccagaaccttcagaggcagaacaaaagagtggacagaacgccatgacaagacttagaaaactgcactcgagtcacctcgcacgactcctgattacaataactgccaaaggcataaccagagagttacgcgagatatatgtttgcatcacgtaacattagcacgcaacgtatacaccagagtaaagccagtcaagatccatacgatgaaaagccgcacataattccctacaaagcccgccagtaaacgtcaacatactagcaacgtaaacaggaagttagacgttccccgaatatctcgttagagacggcttgcagaacgggcataaggaaagtgaactatgaccgacctgtagcgttaaagaaagtgacgcatagcgtctcaaccgttgaccaccgacatgcaagacaccgcaaatacgcgatacgagaatcctattagagcgtgcaaacacacattaaagatcagtttagcgtataaaacacgagtcaatttgacagtccgattaacaatgcccacccccgacagagtcgatgagacatacaaacagtaaaatgccgccaaggtattacgaaagatggagtttgcaactcccgggaccgtccaagatccggtccacattaccgcacagcaaaaggccccgttaagattcctgtcaaataccatgtgcattacatggcactcaacagaaccgaggtatgcaacttacaataacagagaaaactcgaacaggaggcccgttacaacatttggtattaggcacgctacgtttactctatgcgtagagagaataggatcacatattgtttaagattaccctgacacgatacaggaaatatcgtgaaacgtcgaaacaagatgccagcggattgacagtagagttcacaagtcgggtcaagatagcccgcgtacgcttttcacagaaacaggttctcatcacgggatttcaccagaaacagaacgtcggaaaagtcacgacatataagatcaaataaagagctcgctcacaacactatagcaccaaatagctgccaaggacaaaatcaagtccaagctaagcccatgacggaaaacacaaagatacaagcacaccgcgcatcgttaagtatagtatcgaccataataggcaacagaacaagaagattaaacgttaagggagcgacagatttcaagactgagtaacgtattgtcaaaagagcatatataactgtacggcttaagcatagcactggataatcacttacgatagcgcgtgcctgtgcaatacacacaagcctagatatcctaaatgtcacatagatcccaagcatgaaatacggggtgatcatggcagagcaacaacagcgaccactacggaagcaatagtagcggagaggacctgcgaggccccagaagctaaatgaaaaatttcctcctagccaggcatagcgacaggaaaagagttttacatacgcgccagcgccagatggcagcggcacaagacaaaccaaacacatagcgctcactccttgacggcaagataaacacggtcagcacttgacccagacagcagctaaggaagattctgtcatcccggagaactatacagtcaatcggacacgaagagtcagcagtggaccgacagaatagacgaccgtcaccggctcgactactcatagtttcagaaggtacgaagagaacacgtcaagttacagaccctagacacggaaagatgtaagagtgcgataccacatcccgaaacacaagtagattggtactgacgagtgacaagctgagcgtcaactgcgcaaagtgacaaacctgtggtccacgacctcaggaaatcgacagtacataaccccaatgtaacccccagcaactacgctaggaacctatgaagcgcatcacatgcgctacctacggtagacgatctaaggatagataccacagagccggcgtggaacggcacacgcctctcgcagaaac

SEQ ID NO: 102549 - DNA, 595 bp, Triticum aestivum
  Clone ID: PAT_TA_102549
cgacacaacggtttttttttttttttttttgtccaaatgcgtctattaacaggttcgcactactccaattcactcctcgtttccaggtttcagaaaagtggaccggcaggaaatcgtgcacttagctacctactcacagaaacattgctcctcagttacgaaccttacagagtggcatcatacgcatgtacaactacggactaccaacacttacaaacctgatcattagtacatcaggatcaaatgagtcgctaacaagcgccggggacgtactagcacgcgccaccgcgatttgacccgacacgagtcacgaagttaatgtgcctgcacccttcgcatttcgcacctacagtgacctggcagttcttaacggagcctgagcaatggtcgactacgccatgggtattagtggccctaagatgagcatgcggctaaaggcgatgaatacatcctgacccgtgtgacgggagacctcgcgatcctctatcaagcataaacacagtgcgcgcactcagattttatgctcgggtgtggcaagagccgacagtgctccgtaggggcagggcggtaaattcgtacggagtcaactatcgtc

SEQ ID NO: 102550 - DNA, 1574 bp, Triticum aestivum
  Clone ID: PAT_TA_102550
acctcgatgtcgaagaggcaaccagctactaggtggagacagagatatttcaagctccagacttacggatgccttcaagaaaccatcaagcaactaattgaaacaacatcgctgtacaagctcggcccacaatacaagtcaataatcgggatgcaatctatatttaccaagctgtctgcagcacaccacatgatcaattgcgcgaaagtgtgacaagacctaagccacggacatattgcggtccctaggcccccaacctatatcacatttagaatcaaaagtaacgtcaccagttacgatgccagaacgaaagctgccgactctagccagaaacatatgcgatctggtctactgtagaagcagggtacatcgcggtagctaatggataccgctttggaagataaggactaactacgccagggatacgcccggagaaaacaaggtcgcgccaggcttatctaatagactaggacccacaaatgataccaagccagggcactaaacagcgtcaccaaatgattgactaaccgcgagccaagttgaaacgactggaataaataaactaaattggggcgacaaccttacggaatcagctacgcgcactagacggaagatactgacgtacacatgaaactgaagaaaatgaagtgaggttggatcagtaaataagcaggatcactggcgaactcttgagtctacacccaccaggatcatttacagacacggggccgaaacatactgagcactattgtgctccgaatatatacctgcgcacaaactcttttactgacatgagaccacagtaagctgttctaatacaaactgacccgacgtatgaagttagggcgaagtgtatcccctagagcaatgagaagcgctagaacggtcatgacacagccaaacgactgcgcgcacctgtgtgcacaggtgaatacattagacactcgaccccactctaccttacactaccttggcggataatggttaagtgacaactactgtggcgcagataactaaccagggaaaaccaaataggacagcaacgattgtagatagccaagacgcagcgtagatgaccgaataataccgtattaacttgactggcggtcgtgatgcaacacaatgcaacagttttgaaagcgtatctaatgacgagcttagaacccgagtcgatatcaacacctacgagcaattgtgctcagatgtgtcggagcactccgaagaagcacagagtaacacaatggacgattctcatccgatccccgcgttatccggaaacgccatttcgatgtagacttattccatggccagatggctatgaactagaaaggcgcaatctaattcgaacatgcttaaatgcaccatactatcaggaaattctgcttgctcaatccgaacacttcaccgagtcgtaaggtgcgacacgccattatcgcagagacctagacatgcatatcgagaggatccgcgacaagcgtagagggagactcccaatatcataggttaagaattacccatatgacagcgcaaattactgtctgagggcgaagcctaaatgcagactcctgaactgc

SEQ ID NO: 102551 - DNA, 529 bp, Triticum aestivum
  Clone ID: PAT_TA_102551
acgataacgacgatgatgatgatggtgtcagatggatgataatgcatgatggaggcgtacggagtgatgacagacgatggtccgattcgaacgtcgggtcctacgactgatgatgtcggggcatatggacgtgtggatggctgtatgcacgtctgaagcttccaatgtgacaagaatgtatgtatgttctcgtaagtcggccagcatcacgctaatgctagccgcctaaatgcaatgttaacgcgtgttcaggacactatactagtataggctgactatgtacaatataaatcaaatattatcattcggatgactgctttcgactgtccaatggaaactcctgtcagacatttccgttgaccgtcagcgggcgaatgtaatctttccagctaacggggagatttactgctttcaagtagaatgcgcggtcagggtctattagataactcctggattacggttagcatgaccacctttattcaaagagttgattttcttatgcttttcggttcagttgagctttactcgg

SEQ ID NO: 102552 - DNA, 542 bp, Triticum aestivum
  Clone ID: PAT_TA_102552
gtcaatggtgtctgacgacatccacctccagggtgatggtcttgccagtgtagggccttcagagtataactacatagcgctaaggccagtatgagcagcgatgataaatggattgactccgatggtgtatgctgctacgacagaggccgagcttgaagcaattcagaacgtcgtattgctattcttcagtgacgtggtaccgagcttagtcatgcatcacaagtctcttagaagaaggaacggggatccgtaaaagtcagtaaagagctataaaagacatgccgtatgtccgtaaatgaagatgaagcccagtctgcataacagcgagtggcgttagcgtcctcaacctgcccgctgcctttttccagaccgggagaacaactcttaatcagtgaccatattctgtcaacttaaacgatgattaaggcgagactaggtgccgtgggcaagatttgagggaaagatggggggaaataatatgggcatggggatttagatcccaatttagcccgcatagtcttctggaacttgtaggctaagtt

SEQ ID NO: 102553 - DNA, 153 bp, Triticum aestivum
  Clone ID: PAT_TA_102553
tagataagtcactcgttctaaatttagatacaactttgaaaacctatgagaacagttacatccaaactaagtattatataatttttcgatcctaatgatatcatatttaacgtagttacaatatctaagtaattgtatgcttactgatttctt

SEQ ID NO: 102554 - DNA, 751 bp, Triticum aestivum
  Clone ID: PAT_TA_102554
tcagtatggtgaaggcaacgtggctcacaccggcatcgtgataatatctcgaccggactgctagctgcaaatgcaagcttacgctctcccctagacttagagtacagacacgaattatagatcgaccgctggtcacaacgaataatgtctcctgtgactggtgaacgcctgtgccgaatacacatgtgcggacttcttgactcgtacaagtagcacttgtacaggatgtagaactttagcgttccttccccggactccaatcgacggagcatggttctgagcgggtaggccgtcgcaagcgggcgtagttcggacttatccgtcaggactacgaactcgagcggtcgtaggtaactgtgcacaatacatagaaccgtggcctatttcttagcgaacctaaccatgtctgtaagcaaagacaacactttcggcggatccttaatagcgtacttcgaagggttgtagaaggactgcacctataaagcaaactcgtcgaaaagtttataagctccgaatagggggtcattgccatcgggtgtagtttgcgaacgccaagcagattgcgttcatcgaatcgctacttacacttaagcccctaagcccactttgccagctaaagtgcattaagcccatcgtaccgagatcactggtcggcggaaccactccttggcctacaggtatgactgcaatactgtcacgtcgtcaagcctcattatgcatgaaacctgagtgctaaacatacatcgagtct

SEQ ID NO: 102555 - DNA, 1783 bp, Triticum aestivum
  Clone ID: PAT_TA_102555
ttgtatcgtagttagtgtcgtacgatagctaatgtgtcttatactagtggctacctaagtagatactgctatccgatgatggctaacgacttcgtctagtagtgaagaagctgtcatgtagtcatgctgatccttacccatattaattacaagttgatgttacctcagaagctgttgtccattcgatgatgagaggctgttatctgatctagtaatcctaaggtcctaatattctagttggatagactcctttctggatatgtcaataccagttgattcatctcatcatgttaagctgacactgcgcggtatcaatttaatgttttggcatcctagaaacacacatagtcctaatgtagacgtaaattgaacgtatatccgcccgtgctagatgtcttaactcttggaagtctaccgggttacaatgatacttctgattcaacgaataatcttaggtttccagatctggtaagccattggacgatgccattactagaaaccttcacggtttgcggacatccgctacttaagccccttccagtaatccatattgaagagatgtctagtctacagtactttatacctaatgggtccaatccgtaactttccacatcatcctgctgttactacttacccagggctatctcaatgtttcctttttgacgtacaggatttgtatctagacttttaactgtgcctccgtttcctaactgttcaactgttggtgaagcaaccttttgaccattatgcctcctaagggaactttcccctcagtacactgcccaatagttttcccgcttcccgcatagttactttaaatggtttttcttagtccttttgccttaatacgatcacctttatttgttatttaaactttacgcaagtactcacgttaatataatttctggtcttgttttttgtgtccttccgtctttaagggtaatgttttaacgtcctcttcaattcgtttttaaacttcgattcctcttatttcccatatttcccctctcgcatcatctgtttaattgccttttgtgccccgcaaaatctgtttaccatcatttatgtgcatttctatgttgctcctggttgagtattttaaaaatcttttattttgttcccaaaattcttataaactcgtccatgtgttcaccgaaacttgtataatttttttgcgtagtgctgtaatgtgtgttctataaccccttttttcccagttggactaaaaaacgtgttttccaaaattgctcttatcacatgtttcgcctctagacggtgacctatatatccctctgatggtttgaacttctaaggagatctttccctatgtctctcttcatatttaacaagcggtttatttttttacagtaaatcatggcccctcccaatataggtcccccccccatcccgtctggtgtgtaagccttttttactctctaccccgtcgtgtttctacagctatatacttcgtcgtactcttattaaatccgtgctagaaccgattcaactcttattaatagtgtgtttctcgcagtatcgccctcacccctctccgtcgtgtcttatcacccgtgagttggtttcacctccaatttcttaagtactctgttcatccttgtcattgattaatttttgttgcctttctctacccgaagggcttgttccgccctcttataattttcttcctcctactggatttttttatgtttgctcaaaacagtcacaaagaaagtaatactccctactacaataaatgtccctcttctagctttatatagtctga

SEQ ID NO: 102556 - DNA, 252 bp, Triticum aestivum
  Clone ID: PAT_TA_102556
cgctcgccgacacctacgtggtaggattcgaacgcacagttcgcggtggacgtgcgcgggaagttcgctggtgtggccgcgtacggccgacaccgcagtgccggaccggacatcggacggccgctatccagtgtaccttgctcctacgtcccaagcaagaggacgacgctcgctgccgcgacgtcagacggtcgtcgacaaggacggaccgaaccgacagtccgtggttaagtctcatgaacgcacgccatg

SEQ ID NO: 102557 - DNA, 287 bp, Triticum aestivum
  Clone ID: PAT_TA_102557
tttccgtcgaattggaaggcatgcgccatctgcccgcggcatgatggaatcaagctacccaccagtcagtgggcccgcaaagctcacaataacgtcagcccgcgctgtaatgcccgccggccagccctgcccggtctgccagtcagctggtcagcacttgctcgcagacgtaatgtacctcggtaatgtgcccgatagcactgttatcagcggctgagtcaaaacggccgcaatctggtaaggtgagcctatcgggcgccggggatggaccgttaacagctccgaaa

SEQ ID NO: 102558 - DNA, 787 bp, Triticum aestivum
  Clone ID: PAT_TA_102558
gcagctcccgtaagtccactaactgagctagctagtcagcactcagtcttgagtcatgcatcacagactactgaccacttgctgcttactacttacttcttaccttcgagtatcagtccgcaggcgccgagtagctggtccttaggtattgaaggcgaggagaggtacgcagtattctaagaatcgtagcgtaggaccgtctgactacgtcgcgtcaccggctaggtctgccctgctttggccaccttggcttttacttcactgcctgctagcctattctgccctgatcggggcggacgtggcggtggccgactatcgatccgcaccctctcccctcgtccccagaatcaactggacctacgcttgcatcgcaaaagcgctctagatcggccttgatcggtgaccgaacgtaatcccatattactcgttcggtttcttggcaatgggcattggccgcaagcgatagcgtggcacccagggtcgcgtgtaaattactacgccgggcataccaaaaagggctaagctttaatagttgttgggtgttcacaatggggtctccctgattcaataagttgtgtctggggatacgtaatgtgggccgggggttagcttgtcgactgccaaacgccttcgccgacgcgggccggacaactaggcacaaggtacactggggggcgcaattggaccttatcgcgatctcctcaactggaagccggggaaagtgggaaagttggaagcggcttgggggacagcgtctaaaaggtacgtgcgtgagtcagaggtccca

SEQ ID NO: 102559 - DNA, 582 bp, Triticum aestivum
  Clone ID: PAT_TA_102559
ccttgctgctgatgagtccaccggcaccatcggcaagcgcttcgccagcatcaatgttagacaacgttgaggtacaaccgtcgtgccctccgtgcagctcctcttctggcacccctggtgccgctcccagtacctgcagcggtagtgatgcctgtttagagcgagaccctgtcaccagcagcacgcaagggctgggcgaagtcccttgcgttcgtacatccctcgaaaggcggcgccaatgtcccctgccccggtccattcaaaggttgggcaccaaggggccacccatccgcagccttcgacttggtaaaccgaaacgcgtggtagcaccccaaccccacgccactggccctactcgaattcctaccttttgggtccaagggcgggtcggtgccccaaggtcaacttcacggcaggacttggggccggcccgcggccttcccggcccctatcctgcctccccggcacagtcggccccctcctccgaacccggcccccgcctcaccccctcagcccccatttccaaccaacatcggcccacaaatgcccctaccctcgccacacccgccgtttctgcctaca

SEQ ID NO: 102560 - DNA, 1725 bp, Triticum aestivum
  Clone ID: PAT_TA_102560
aacgcatccgtgacaccatgccaggtaaagaatggtattcgctcgttgcggagtatatgaggctcaagtaggggataccattagaccaccgaaggccttagttagcgacgagtccggaaattgcaagggaattgggttgcgtctcaattactccagttagtgtgtcgtcgctcccactctatcaagcgtgatgcataactagattgattactttgttaataaattggggatgttttgattcacatctccaactgcttatgccacgtacggcaagcacaaccgaaggtcattacaaagcttagctgagcccgtgagacatgtcacctaacgaaggagaacgatgaagacggcgttatggcgctaaccggcatcacgtgaatggcttcggtagtatacttatgtagcagagagcattggttgcttcctgcataatacgtgaataacgctccttgctttaagaatcaatggcgtgaatgggagtcgtgactactatgttccagaaacgagccaatacagtaactttagtatggagagtaccatataatgcaagcgattaggcaagctggttcttccagggggagagcgaaagttcaacttaatatcctatcagccaaacggagtccatgaaatagtcattccacactggacattgcacgctagagaggacgccatggcgagcataacacagtagcgtcatgtcgactaagtcatgacgacggacaggcgaggagggaattgagtggttaggtagtaaagtccacagcaccgatttatccgtaaggttttgggaacggaaaggggctagaaatggatattattaaatattcctagcaaaagatgaatctgacgaaggagtgacacgcatgacatcgctagggtcctttcgaatatgaccaagacctcagtgtgcgtacgcaatccggtccaattaagaattgagtagggtcaataaggacaccacgaatcgaccttaggtacccctaggaggttatctacattggggagtaatgcggacctcagtggctacactaacattcggtcattcgaacaaagaaggaagtgacgaactgcattggtcttagggtcacactttggggtgaacgtcgcccacataaccaagctactcataccatgatgaatggtgcacgtaagagagcaagtcggaaggaacgcgaagcaacgatgaatatgtccgtgcatggcggggctatacttgcacagtatagatgagcgtgtgcgagactaactcgagtttataaaagtaagaagaagagttctcgtatagacataagtatcagttgacgtgatactttccatggagtgacgtttgcttgtactcattaagtggtagaaggacatcatacgtgctacactatgacgctctttttaatgattaaagtggaattcggagtctacgattaggtcctatcggtgaattaatttgttctgtaaacggtcgccgcaaaaaactacttgaaaaaatctgttagaggcattagataacattcgtacctgacatacctcgcgaggatttcaccgttatataatgggtacttcctatgggcgtattaattcctgacatgtgaaaatcaaggtcattccgaaacattaatgaacggcggagtctagttatatatgttggcacgagacggcagtaggagacattgatgaccaggctgagctgctctagaatctgaatcctcactcagtacatcggagatgggt

SEQ ID NO: 102561 - DNA, 564 bp, Triticum aestivum
  Clone ID: PAT_TA_102561
ttttttttttttttttgatgatatcaccaagaataatttgctttatttctaacggagttttacacctgagaatttagcatgtccgctgcggagcaacaaagcccctgaagccttgactaaacaatccacccttcggttaatttcattgaccaacgggaaaccgtcttgtcaactcagatgttaacaacaacgtaccatctgctacatccagcgaacaaaccttcgcaaaatcacgactgcctaacggaccgttaaccggaaggggttcttctgactcaaacaaaagccatgggccaatttcgccccccaatgcacccccctgtttcatacagagtacttattgacatcgcacaatccccccgaccaccctctgattaccaccagctgaaaaccaatcgattgtctcgttacttcccatataacccccttgccatgccccaatattttgtcagatgaatcactattggcaactgtgaaatactaaccggcaatcctgaaatccccgcacactagatctaaggccgtccaaactttcatctcacgataccccatatactgcaataa

SEQ ID NO: 102562 - DNA, 861 bp, Triticum aestivum
  Clone ID: PAT_TA_102562
ttgaaagatggctcatggagctggtgtgctggagccgaagtggatcaacgaagtagtcggatgtgtgccgacaggccggtagatcaactgaactgtcggatcggtggcagctgagcgcagctagactgcagccgatcgtgccttgaccataccgcgatgtgacggtgcactgcctgcagcacatcggggcctgaggcccaattgagcccaagaactaaattgacctcgagcacgcttgcccgaacggtctcttggtactcaatggcaagccaaccccatgccccggctcaagctcagtccatgggggcgtccgtggcaatgggggccggactgctggagcaaaagccgaggccattccttgcggaccaggccccaaaccggcgacttgtgccgggggcctgggacccgagacggggccccggggccccgggccccttggggggggggcccccacggctattaatcccaagaagttggggccggggcggcgggcaataacgggggcacaaaaaagggaggaccaaaaaacaggggcgtaggggggctggtgggaggggatcccggggggggcttgggcaaaggggggggggcaaaccccgttgggccgccccggggggccctaggcgttggggggatagcccttcccaatggcacaggaaacaaaggaaccttgggggaaccgcccaaaatcgggggggccaaaataatcccgcccacctccaagaaaagtaaaactccccccagataaaagagggggaacaggggggcccccccccgggcttggggggagtggtcccggggggtgttcccctgcagggaagacgggggaaatacgcctcctgtggggggcgagtggggcgc

SEQ ID NO: 102563 - DNA, 604 bp, Triticum aestivum
  Clone ID: PAT_TA_102563
cgcggcagtacatggtcgtgctctctggcgcccgacacgtatggcgtgtcacgatgctcgtccttcgtctccgaacgcctgcgccgtacccctctgaagtacgaatatggtctttcgccgaacgtagctgacgagtaggctatgccccgtcctgaccctagacccggaccgaacggtgacccctacggtgcaacctgagtacgtggtcggacccccttaacgtcgactgcgtactaacctatcgatggacgagctaagtgccttgggcgcgacgaaggtgctcgtttgcgagttcggcctagtccggccctttgcttgtcgccaagcccggacgtaaggaaccccgacgaggggttacgacgtaacaattggcccaaactattgccaccgggtccaggtgtgggtagggcccaaggtttcccaacgaaagggccccttgggttccaaggcattgggggaagcccatttgggacaggttgacagcaacccggttttacctataggggacgaatgaaattaaggggatggaaacccttgcaatgtgggtccggtctaaccccaaccgtgagaacccaaacccgaaaagccaagccaagttggcaca

SEQ ID NO: 102564 - DNA, 2417 bp, Triticum aestivum
  Clone ID: PAT_TA_102564
tgcctagcaccacatgattctcgtcgacaacgcgagccgtaagttaacgtgggcgagatctggggggaaaacacgcaagtactatttggaagaagagcaattgcgatcggtcccgaataccttagcctctcaaggaatatcgattatagcacgtatggaaatagaaaccgtgccggaagaactgcataaaatggtccgtacgagggcaccctaggctggcgaagccataggcataaacgctgacggaccatcaagcaccgagatcctgccgaactaataacagactcaaaaaggaagatggcacgcataaacaatgcaaattatccaggttaccctagcaagcatccaaccaaacaaggccaatcggagggaccctcctagtcattattagaccggcatcaacaatagacatcccctaaagtgctcctcaaattcgcaccgagaaacacgcgtaaaaccttcacacagcctgcaactcgagaaactagatatgagaaacataattcaagtcggcatgtccgggaataatgagaatggcgaacaaacagcgaaaatcaagtacgcatacgacaaatagaccatatagtacccgaaaataggtcaaggatagcaagagagtggaacccactaaagagaaagaccacttgagctaagatacaccacgctggtcatcacggcgataccaaatgggcgaatcaaaccacgcaatgtacaaaccggcaaggcctttggggctacctaccgaataactgccagtgagaagaccacccctcgagagttgttataaaacatgggagctaaacaaaaaaagagaggcggaccgcataagcaaagtaacaaaccgttaaactatagcccgcgtcgatcataaaccttcggatatactatgctagacacattgaccaaagagacgattgcgcatccagggaaattcaggtagaatgtgccttcaaagtccgaggtcatacctaagggggataggctgcaattaactggggctaacctaacctaaggactatacacacagtcctcactatttaggggaaggccccgagcgtaaatgcgcaaaagccaatatcgtgtacaggcaatgccccgctacattgtgaaaacgtgcacctgtgtctgatacccggttagaacaaagggtgggttgaattaaatatatttgaactccgtattacctactaatgcaccttagagaaatacgcttgagacgcacatgtaatttttgggaagattaggaagtcagacgaacatcttcaaaaactcactactccgcacacgtcactggcgtgatctgggttgcactaaaagccagaaccagggacccaatgttctagctcccaatgatctactcctaaggaaataaccaaccaataaagcacaccatatgcgtattaacctagtccggacgagctgacatggatcgggttcctctatggagtccaagcaagatgcgttatggtacactacaagacgcctcgcaccgctacctcagggaaaggatggaggagtaactacacgcaacgtaacgcataaaacgaagacaaacgcgcctacgcaaaaaccaacgcgaacaatggaggagggtaggggagacagagactgtccgccatagctaaagattacagagtgatctcggcgaagtgcaagcagtacaagctgtgcaactacaagtcatgacgagcactaacagtgagctgtagagcccgaccagaagcacatagaagaccccatcgccaccgactgacatgcatcttacgtgcgccatgctcaagagaccgccgagactgtgagagtaaatgggagccgagcggaagaatatgatggacatcgattataggaatgaggttaatctacgatcatacagtaaagcagctcacatttgaggttaaattaagacagagcatgtcatgaaacggatcgaaagcacacgcatcaaagctgcttgacagcacagatcaccagaagcacctcaagtcccatatcaccatcagtaactgcataaatcgctctggctgtggttgatcgggtagttaagaggtgagattagaggcaaaaacaggaaatatacgtaatcatcctgcctaccaaaaagccacgtgacagactgactatgtcaatgcacgccacaatgtgaagtcgaatccgcctaagtcaagaaaaaaaataaatcaaccagagaattcggcgataaatatagacacggagactagatataaaaccaatacacacaagacaactacaaagagcagaggactgtgagtcagcgccacaccggtccaaagcaacgtatcagaggggctgaggaagcagccacggtcgtctagacacgactagacagatcaagatcagggtaatcgaacactaaattcgaacatatgactgacaagagaacagcatcagaagcacga

SEQ ID NO: 102565 - DNA, 475 bp, Triticum aestivum
  Clone ID: PAT_TA_102565
agacccccagacgaataccggagcccatgaaccgcaaacccgtagcccccaggtgcggacacctgacgcatctggcggcgccgcacgacggtatgctgacccgatgcgtgaatgactctacggctgcatgaccactacctgaccggctgttcatggaacgacagcaatgcaccatgaccagattgcggccggcctgctccccatctgcaatggaaagacgtgccgccaacccacgaagggcttgccgacgtgcctggattgctgacccaactatggatggaaaggcacttgacggggaggggtcgaacagcagcgtctgccggacggcgccaaacccgggcggccctgggtgggagtggaacaggccaaacggccgacccccgctgccgggtggggaaaacggcaaaaccggggctgccaaggttctgcgctgtttgaaagaatatcccactgcttgtacggtttcgttccctaa

SEQ ID NO: 102566 - DNA, 703 bp, Triticum aestivum
  Clone ID: PAT_TA_102566
cctcctctccgctcctgtctccttccttccgagtttcagccattggtgtagaggatgaggacgtcacatgcaagcagtcgtggatcgattgggccagtcgtctgactactggcaacgtgcgatccaaccacttggtccattctagatgctgacaaggcttcggatggtgattcgcacataggcagtgtcgatgcgatgatggttgcgaggaaggtgacagcccgctggatgattgaagcacagtatggtacttttcgaaggtcagcagcctggggagtcggcttaggacaaacgctagtaatggggctcgaggtcgtcgaatgaggtgggggtatgcatcccatctcgaatgaattaggctactcggttgcgaaaagtctgcggaagaacccatcgcacaagttaacttaacctggtcaggccggtatccatttaggacttggtcgccacttggggttcaatcctgtcggaccttggtcaatcccaaatgaaggtcatttcgaagttgaagcgaggagtaaagccctccttcgaatgggccttggagcctaggggggccttgtttggcttgcggtgccaatcgtggatgtttcgatacctaatttcggggttgggctccgatgtggtgtgtagtaggtagacgtgtaggtgaaagaccgtgtgggggccagggagcgtccgtgagacgggacgtcggcctaca

SEQ ID NO: 102567 - DNA, 537 bp, Triticum aestivum
  Clone ID: PAT_TA_102567
cctcctctccgctccttctccttccttcgagtttcagccatgggtaaggagaagactcacatcaacatcgtggtcattggccatgtcgactctggcaagtcgaccaccactggccatctgatctgacaagcttggaggtattagacaagcgtgtgatacgagaggttcgagaaggaagccgctgagatgaacaacgaggtctttgcaagtacgccttgggtagcttggacaagctggacagggccgagcgtcgagaaggggtatgcagcattggattattgcccttgttgggaagtttgcgatgagcacctaagtactaagctcgcacccgtctgtcgacttcctcgcagatttagtcgttcaacgcccatccatggaactatcgcaccaggtggtcgagctaggctcatttctttgtttggtaggtgggaagtgcagtcatggtcgagcaggtatccggccaggttacgttctgtacgatgagatgacccaggagcccaattccagtggtttagtatgtgtgttaagcaaagccgt

SEQ ID NO: 102568 - DNA, 2605 bp, Triticum aestivum
  Clone ID: PAT_TA_102568
agccgacacgcctgccagccatctacgccatctgaaccggtgacatagtctctaccgcctacttgcgagcatcgccttagctacgcgccagctcacgcacgacccagtatctaatcgcacgccccaccgcaccgtgagcttagcgactctaccttctgcgagctgcgctcagtacccagtaacgttcacacatctcaatccggacctgtgcacctatgcacacgtcacgcactaactgcacaatcccataccggcaccagtagcgtaccagattgtctgccacactctgccttcaactgttcagcacatcggccctcccctgacccgattagcacagtttcctcgcggtctccacgatagcgacctacctccagctcgcatcttcatacgcactgtctgaacctatgcactgtggtcctaatggtccctccggcccctggtcaacactccccgagtccgagcttaacggacacagccatagctaacgcttagcctccactaccccgtgctcctatactgacgctacacccacgacacgcgaccgaacgggaccccatgttgccatatctacctcacctagtgcgcccgcccctattactcactcgaacttttacgactagagcccaaccgcactccttctcccctgaccggactcaggccccgagcccctccacccgcgtacggcgatctaccccaactcgcccttttgtcgccacgcggatcttcggagcacgcccctgtgatccgacgcgtggctcccccgccagagagcctcaccccttgcataccccaagaccccgacccatcccgttctgtatttatcgtgtgtccccacccggtgtccttacgctacgcacccgtcgcgcaccgtgcgcactgaaccgctctggcccaccaccccctgctgtgccgctacgagcactctcctacacccctgcaaccgcaatctccggccccactcccatgccacgcctcctcggaccccgcctgcacatccgaggccaagccgtgaatctgcccccacagtccaccggagcgcatcgggtcggtaaaactcctgcccgctacacccacgcgcaggagccaccctggtcactccggctagagatccgccactctccctcgcgcacggcacctaccccactcacccgcgcgccccagccgccaccttgcacgcgagacctatccatagttttacccctctagagcccctctccggacccgaggcctctttcccgaatgggccaacgtccccccactcttcacatcaccagccccgcgcaactctccgctcggtgccgcccgctgagagccttccgaccacctccccgcgaccctgaccacatcaggccgacaccacacaaccgccgggatctggcccactttttcgcgacacacacgtcgaatgcctcaccctattcccgtgttcctcccgctaaaacgttatgccctacaccggcgcttggcccacctcttgcgacccggtctgccaccggcgctcaaacctctccactctcctccatgccttcagccccagccatggtgccctcttaacgggaccgggctcccagcagcgcacccatgggcctcccccccaaaacccgctccagtacccccctggccaaccccagtcgatcacacgctggagagtgtcccccgcccgtcaccactaccacccgcccccccgcaccagcatcgtcgtcgtcaagccacgacaacaactccgacctcactccccctgcgaccacccgcacccctcctgtatgccgccacacgccccccacttaagaaccctactaccgccacctgccgtgctatgcatactgctcgaaccgacacgcgtccctaccccctatgccctatccccgccagccagccccctaaccctgcaccgcctccctcgtcccctctcgcgatgcaccctgccctctgcggcgtcccaagcctcccccgctcctcacactggagtcccaccgtcgaacacaaacttactcagactgcagacatcgacaccctcaacactatcccctaagctatactcgacccaggacacgcgacaccactcccaaaacccgcccgcggcaccaaaccgccctctccccctagcataccagcacgtagtcgcgcccctggtaccagttctccgctgacgagcctccacccggagagccaccccatagtcgacttcccgcccccagtcgtacggcattctcatccctgcgccgaagcacctgactcgcccacctcccggcgcccgccgcgccccccacaccctactcgccatcatcttttcgttctgcaacgccgcgccctgccagcaccagcctgaccgggaggccccccgccacacctccgcttcgagccaggtcatccccactctacaggctcccataccacccagaccgcgcccccgcgatcccaacacgcacccacatctcccctccgcataacacctcccctcgtccgcccgcccgacgggggttcccccagggcccgaaggttgccccctgcacttaggctcggccccggcctgacacccctaacgtccgctcgccgcccccaccagcccccggctaccagccaccgcgccgcaccgccagccgct

SEQ ID NO: 102569 - DNA, 507 bp, Triticum aestivum
  Clone ID: PAT_TA_102569
ttgcatagaacagtaatttactgcatatcttgttcatattgacacacacacaatatccctcgaccggaaacaaaaacaaaaacaaaaacaaatatacagggcatgctcttggcaacttggactcgagcagggcgagaggcacaacgcttccgattcgttagggcctattgtacctacctcctaatactcgaaacaacgaagcaaacttgcaagaaagaaaaagaatgggccaccaccgatacccaatgtgggaatcgaaaataaccgtaatgacctgaaaaagtttcccacgcaacgattcgaaccgtagctctgggggagcgttataatctcattcggtaaaccgcaaaggcggaaacggtgttgagaaacttagaattccgagcccagggactgggcggtatgttgaaaaaccatgggaggatacaatacctttgaggaaacgaggactgggcatgagttaagaaggcctttggagtccggctagggagaatgccacttcagccg

SEQ ID NO: 102570 - DNA, 619 bp, Triticum aestivum
  Clone ID: PAT_TA_102570
aggacgccggcctaagctgcaatcgcccggatacacaagagtggatagcgcaagctaaaactgcatacggtgtccggccccctcccaagagaccgcgccggtatcccgtccatggtacaggtatgctggtaggttgacgccttcagaggtaaggcgcaaggggaagtaacagtagggaactgactcgcctgcataccaaggtaggtctttgtgagcgaagggggagaatcgcagtaatcccgtccctccccaagggggaggaagaagggacccgccctcgcgtaagataacctgggtagggcccacgagtcacccgtaatgccgggggggcaaagcagaatgctattcgacccagtaagagggtccccttgcggttaatgcgaagcaagggggtcccggggtcgctaaccagttcttccccccttaagaagcaaattcaagtttcagtcccaagcggaaggcccggtaaaaggtgggaataaaaaacacggaagttttccaggtccaataaaagggcggaacgattcccctaaatgtttgttggcctttcctggaagaggatttaaaactttaaaatgttttgtgaaagcttgtgggaagttttcggggataaacccgg

SEQ ID NO: 102571 - DNA, 189 bp, Triticum aestivum
  Clone ID: PAT_TA_102571
ccaaaaacccacgaacaaaaaacaacaacagcgaccgcttggacacagcgaccactccacttagctatgcgtccatcaacaggaaagcaagaagaagcccctacatggtaaaaagaaacggtatccccacagagcagggcaagggttccatgacgagtttgaacgatcagcgcgcgagtaaaccgaaca

SEQ ID NO: 102572 - DNA, 674 bp, Triticum aestivum
  Clone ID: PAT_TA_102572
cgcctcaccgcggaggacatgggtcgtgctcgtctgacgcccacaaccatttgcgtgtccctatttgtctcgtcctttcggtcatccgacgcgctctggtcatgtcgtcctctggacatcaatcacctgggcgtttgccaatcggtggtatgagtgacgggcaacttgccctcagtcaagtcaccaatgcacacgggtcagagccgattccccatcgcgccgaaaccattcgagtctgcggttgacccgccccaatccgcagcaggcgatcaaccccatgttaaggtaacgaattgaacccatgctgttgtagccgtcacgtaagtcgctgcatcgtcttccaaacgttccgggaggtgaggtgctcgcggttcgtgtcgagtcatcggccaggtgagcagcgcgatctgtgagtgaatttaccatacttcggagccatccatggtctaaaccatgttttcggctttggctttaagcgttctcgaaattttctctcgtagtgttgcatataataaattagatctcattcatcagcacaaccgactagagggagggtactattgctggatgagattgcaaaatagtgccatgtttcaatagaagttgctgatcgaggcgatggattctatgcctaacggaaaaatctcctagactcacttaggtgatcgttccga

SEQ ID NO: 102573 - DNA, 678 bp, Triticum aestivum
  Clone ID: PAT_TA_102573
tctctcccgcgccgccgcagccagtgtgtgaagtactcgaccggatcccgccaatcaccacctaagtccgccaacggcctatggggcgtggaccatgcggttgtttcattttcaaggaaccacttagcggaaaccatgcgcttcgctacttgaaggaagtattgtcgcgatcaactaattggcccaaaggagggttacctttcgaagggattgttatttggcaccatcaatgctagagcacaatcccctctatctctgggaggctaccctttcccgttgggttgggttgggaaccgcaaccacggccccagtgtgttgaaagagtatccggtccatggctccaaattgggtcgagggtgtaactgccttggggcctttggcccaaaggtctttgagttaaaggtgtccggtttccgtgggaattcttttctaaacaagcaaatcgtccgtgggcgtagggtaaaattgcggtggaattcggtttgaaaaagtgttcgtgttgaatttgggttgggagttggcatcctcctttaacatgtgatggcagctaacttgctccccgaatggtccagaacgctacagcggccctcttagtaaatgttagggggtgtgggctgcgcctctgggggggcacccacttcattttccgcgcagtgagttatgtggcccgattgtttt

SEQ ID NO: 102574 - DNA, 411 bp, Triticum aestivum
  Clone ID: PAT_TA_102574
gctcgttgctccgtcgagctacctagcatgatgttccgtcgctgcttgcgtcggtgcccgataatacattcgcggcacctagattgttgtcactagttgtcgcccaatgtagttccaggacgttcgtcggactcacgttggccggttgctcctggttctttgtcaccgttccgacacggatcgtgccgaatcatggggccaatccccccaacctagtccctcgcgattcctcgctccccatatccttctccccttttccacatcccctgaacataccaaaaaacaaaaatacaaaaaccatacaacacaacataaccgcaaaaacataccaaaaaaccaaaaaatccctacaacccaccaacacccgcatctgcccccgcgccaggacgaatacgccaattcagcaatgta

SEQ ID NO: 102575 - DNA, 747 bp, Triticum aestivum
  Clone ID: PAT_TA_102575
atcggtctcaatccgtgctagcgcattgacgaggactgacagggacgagtccgcgtcgctacacagcgcgcactccaaggcacatatgccgtcgcgccgtccgtgcgctcctgtcggccgatgacgcgaccaatacgacactaagcctgctcagggaccgcctccaacggcggcaacgcagtgagccttctgagttctgcctaacgaacgacatgctccgagccttccgctccctcacagatccgacacctaaagctcgacgacttcgccccacttgcatgtagttctcacacgtcgcctcgctatttcgctattttctagctgctacctcaactagtcctacagggccggacgtcactcgaccctactgtcagtgctaacgctcaccactctgtccaaaagcgtttctcgccacttggcgtggctctgcttcagcacctggccactcttggttgcgccgaccacttactggggcgtccggggccctccccttggcccatgcccgcacagccttcctaagtcacacgtacaccctgttctccaatccagcccagttccaccggcgctaactcaacgcaatacccaaccactctgctgctgctgcccgcacgcacaccaccgactcccccgcaacatagaaaacccctcggagcctacaccccccacccgtcgcgacacctctcccgccgcccccctcgcgccgctacccccccccgggcccggcggccctccccccccccgtcaggc

SEQ ID NO: 102576 - DNA, 341 bp, Triticum aestivum
  Clone ID: PAT_TA_102576
agctagctagctctcgtcggcggcgacaatggcggggaggcggcaggcagtctggtgcctggtggtcatcgctctggcggacgatgctgctcggtggcgttcacgcaagccagttgcaggccgaggcgtggggcgggccgggtgaagaaatggcgccaaggatgccgccggggcaacgtttcgaggaccggttgacgttcagggcaagggaacaaccaagctgcaagctatccacgtcaggcctgaccacccgaccaacgcggcgcgcaccgcccctcgcggtccgtcctcccttgcccccaaaggatcacgctcgccaaacaaagttggcattttgccta

SEQ ID NO: 102577 - DNA, 1740 bp, Triticum aestivum
  Clone ID: PAT_TA_102577
gtggggctacctgtcgtatatagtctgcgttccggtgagaccgatgttcggacctactaacgtagcacggcttaaggcagctcgtgcatactcagatgcctgtcagctcagtgaatagagattagggtccgcagtatacctgttgcagtggacttgcggcgcagggtgggctatggttctggagtggatgcggtgcgacagtccatgtagcacgcttgagtggcgagtgcatccggtgagggtgtgtgcgcccggtgggactctaaatcgacctcgaggtgaggctagcgtacgggatatggtatgtgagtgactaaggcaggggtgtacggggctgacgtcatagcctataggggcaatgcggtctgtaatttcacgagtattatgcatcgcgacctgctcttaagcgcgggatagcgtgcccacgataagagttgccgggttggcgggatctagagatacgaaccggttattggaatctcactggagtgctatccaatcgatgtgtgcgccatggtttgctgtggcattggtatactgtcctaaagtgggctacgatgcatgcgggtcaagtggcattgggactgatgatatatgctagtcatacactttgagtgacgcttcagctatgactgcgcgttaaggtgctggccatgtaagaagggattgctggctatcgttgtatttcgcgcgcggactaagtgttaacacaggtgagcctagggtagtcaggcgtgtatcggcggcagctggacgaccagtaagtagttaggctagggttaatatgtggttgatggtacggagaaaaagatccagagatgacactgcgaggatggtagagtcggttctagctgaacggtgcatagcttggcgttatgttatgtagtttatctgatactcgcgggggcggtgactttctttggtgtgtcatgctaccggcattcgacagttcctaggaagaccgtcgatgccatttagaccgcacatatgacgccaaatagagcgtggcgtgggtgatgagtgtgaaatcacgtcatcacgcaattaaaagatagaatcgtagcggcgatattatcacttacgagtgcctcatgaatgtcatatgctcgggatctgttcggcgctgtgagctcatctggcactcgggactgttcgcccaaagcaatcgcgatttcattaacatttgaggttacgacgttataagttctcatcacaggaggagttcctcggtagagttcaactagaaacgctgtactcttcagcactgaagtgagagatagggcgtaactcctggcctagcgaattatcggtgctatagaacagctattctcgcgactactgagcttaagtggagttaatattcgttgttttccaggtctgaacggtgtaagttcccccgtgcgctcacatggaagtggcatgcattcagtagcatgcgtgggaccaagcgggcagattgtatgcaaggtcaccgacgtgcctgagagctgcggctgctgatgatgcactatggtagcgaggcaagcatggccgtgtgattaagtagatagaacagtgaggtgccgcgcagcgcgttttgagtgactctagtgaggataattcacaattcatagtgacggcgctggctcgtgataataaagtcgtggtaattagggaaaagcacctattagcagcagtcacttaagttctcctgctagtctagttgctgcaaagctgcctatagtcggagggcagaccggc

SEQ ID NO: 102578 - DNA, 522 bp, Triticum aestivum
  Clone ID: PAT_TA_102578
ggcctcgagtgaagtgagcaagccatgggctcggcaacagtcctggaggtgatcctcgccatcatcctgcctccccgtcggcgtcttcctgcagctacaaagctcggcgtggagttcttggatcatgtctcttgctgagccataactggggtacatacccggggaatcatctaccgcgtgtgtagcgtagctgagtaagttttaaggcaaaaccagcctcctagcttgcagggattggaagggctttggaccggaactgagctacgcttgttgcacggagtcgaaactgaatgcttgtcgttggagattgtacgaatgagccatggtgctgaagggtcctaacgcttttatatttatagattgaaatagtattctaacgcgttgtgcaatttatttatttttgaagtatcggttgagacgaatagtttcaagataattgttggtttcgctaatctgtggtaagaaaccgaggggcgaagggaacaggcgcgtcgtgggtgtcaagatcacacctgaaggagc

SEQ ID NO: 102579 - DNA, 621 bp, Triticum aestivum
  Clone ID: PAT_TA_102579
aatcccctcaccgcctccgctcccacgccgccgaatccgtagacctgctctcggaattcactcgcacgcgacctaaaccctgcaggcgctcccccaggctactacctaccccgtacgcttgcagccaatggctaggtataggtcaccggtaagtctgccctagtttgctaggtccaagtaatgtagaatgctagaactagtctagaagctgctagtaacctaagtcgccatatagcaggcagttgttgcgactgactagtagtacgcaagttactagcagcagtttcgctagtactagaggtggtgcctaagtagcaacctgcctacaacagcgcagattggatgacttccacggttatttgcaggaagtccttactagcccatcacagtcagaagcggggaatacgtttcccttgtgctagcaaagggcgacttcgatagtttattgcacgcaaagccatcaatactggggaaacagggaaaaagaactggctaacttttctagtttgcttgggaattccctccaaaggactgctttggagctaagttgggttttggggtttgaccctggcaacggctcttttggataccatttgagttacagcccatgatgaggcctta

SEQ ID NO: 102580 - DNA, 550 bp, Triticum aestivum
  Clone ID: PAT_TA_102580
tttttttttttttgtttcgtttaatttaacagaagtaatgaaataaaaatttaatagtatacgtgtacaaaaagaccatagataaatacaaagtaaaaaaagacacaataaaactccagaaatcgccccaaaaattcaaagaagatttttcccagcttagcacacattccttggaccgcaaaggatttcttgattcttcttcccaaagccttgtgaatcatccgttaaaactcttcccaaaggcctttgaggatcaccttggagaattcttcgtcgatgcacgagtcctcaaggattttctagaaatcgtcatggccattgctagaaaagcggtcgtccaagactgccaacactccaagtctaagatggccttaaggcatgctatcctaacctcgtgcctggggtgggggggtgttggggactccgggcgtggaggagtgcagtatgtgcgtggtcctgttacacaacggaaagggcgagttttgccacgttccgcgcggacgcaccgagaacaaggcaacgctaaattttcaaccccgtagtgaagact

SEQ ID NO: 102581 - DNA, 702 bp, Triticum aestivum
  Clone ID: PAT_TA_102581
ctggccgccagtgcaccctaagctcccccgaaactcgctgacgccgcaccctacctgcacagctcgccgccaccgagacgccgccgcctacgcaacgctccgctggatcactcctctccgactccaccgtgacacctcctactccactgcgtctacgcccatcacagacacttcactgccccccaggcctgtacgccactcggccgtccaaaccatccaccccgaactaccccgcgacgggctccgccatccacgcacctcgtccgcttgctccaatcgccccccatgcaacgcgcagttatcaaccgcgacctgcgtgtcccacgacgagacacgctcctcctgcaccacccactactcctgcagacacctactcgcacacgtccgccgccctcccaccccgccgttagctgcctcataccagcactacgaactgcaccgcccgctgcggcgtccaattccgacaagcgcgccgagtcccaaccccccacgtctaccactccgaactgccccttccccctccgcctgccgctaaccccctcgctcctcctcccttcacttccacctacctgccgcccccctaccgtcccagccacccgccagccccccacagccgccccctgcctgcacccgccagcggcactcccccctccgacagccacccataccttccacgctcacacagacctctcccactgaccc

SEQ ID NO: 102582 - DNA, 510 bp, Triticum aestivum
  Clone ID: PAT_TA_102582
cgacagcaacggaagttcgtaatcatggtcatagctgtttcctgtgtgaatattgttatccgctcacaagttccacacaacagtacgagccggaaacgcataaagtgtaaatgccatgggtgtgcctaactgatgtgcgctaatctcacagttaatttgcagttgcagctctactgcctcgcgtttccgagtctgggtaaacctggtctgtgccatgctgcatttaaatgcagtcgtgccaagctgcgccgagggatgacggtcggctttgcagtaattggagcgcatcgttcctgcccttccacagcgtcaccgtatcctctggatgcggcctccgagtaggttccggggttgcagggctaatgttggtaactaagcgtcaacctgcataacagggaagggtacgattcgggttttgtcccccgcggtatggtaggttgagatgatagctgcacggcgaaatgggatccaattgctaccgagaaaaaacgggcaactttacagacgggg

SEQ ID NO: 102583 - DNA, 497 bp, Triticum aestivum
  Clone ID: PAT_TA_102583
cgacacaacaggaagttcgtaatcatggtcatagctgtttcctgtgtgaaattgttatccgctcacaatgccacacaacatacgagccggaagcagtaaagtgtaaagccatggggtgcctaatgagtgagctaactcacagttaattgcggttgcgctcacttgcccgcatttccagatcggggaaaccgtgtcgtgccagcctgcatattagtgaagtcggccagacgcagcggggatgaaggcgggtttgcggtattgggcgcctcttccgcattccatcgctcacgtgaactcgatggcgcccggggtcggttccggcatgcgtgcgatgctggtaatgaaggactaactcagaaaggccggggaaatatggggtttcccaagaagaatgccagggggggtaaccgcaaggtggatataacaatggcgaagcagagaaggggcgagccaagaaatggccgagggaaagcggtgtaatatttgcccgcgggttt

SEQ ID NO: 102584 - DNA, 388 bp, Triticum aestivum
  Clone ID: PAT_TA_102584
gacacgaacggttttattttttttttttttttaacatgtcaacaccgtcgcaagttctgcatgtccaagcacaagtcaggacgagacgtcgagacaaagtgatgttacagtgcagtcgcaaaaaaaaaatcatgagaagagtggagtcaagagcataggttcgtaagcgcgagggaggacgcagtcctaaaaaagaatccaacatgcaaaagctggttgccatgcctgccttatataggtcgtaacggcatccgcaaagacgtgaagcagtgtaacggctggacgtgggacaaacgtggagcccgactgagccgttctgcgatgagcagcagaggaaggcatgaggttggcgctggcacctgctaaaataaacatagcggaccgggac

SEQ ID NO: 102585 - DNA, 436 bp, Triticum aestivum
  Clone ID: PAT_TA_102585
cgtaatcgtcggctcgttcgtgctggtttcagacgtcctctccgccaacgacgccaaagcgcacgcagaatatccctagtccccgatttggcgccgcttccgcatgggttcgcggtgttcctggtgctactggcgtagcaccccgtcgacggctacggcgacgaatacggcgaagtcgctcggcgccgccgacgactctataactaagagacaaggcgtgggtgacggactatggcgatcttcctgggttcgttacgcttcgtacgggcggcgggcgctgggcggctcatcttgacttcggtggctgcgtggcattcaagggtcgattcgccgatttccggggcagggaccggcgggtcttttggtttccggggggggtgggtttggtgacttcgatggttgccggtacttttcgatgtgtactttgttgtttttg

SEQ ID NO: 102586 - DNA, 502 bp, Triticum aestivum
  Clone ID: PAT_TA_102586
tgctcctctgttctcttctccttgcattattatttccctccatctccttcctcgcatccagccgcaactctccccctcctttgacttgcttccaagaaagccgatcgccatgcgcgtgcagtgcgacgtctgcggcctcgagccgggcacgccggtgctctagctgcgccgtacgcaggccgacgctctgataccaccctgcagactcgtccgcgtctcagccggcgcccaggcacagctacggccggtcaatgcacgcggcgggtgttcatcgcttgccttttatgcgtcttcgcgcggtggcgtatgagatgtattggtgtggccggtagcctgatacctggaggatcagtttctgaggtaaaggtggaagacggggattgcgggggggggcgtttgtggtggggtgttgtcttctgggttggttggggggtagggggtagttgtggggggggggttggaatagttggcgtgttggtgttttgtggttgtggttggtggt

SEQ ID NO: 102587 - DNA, 173 bp, Triticum aestivum
  Clone ID: PAT_TA_102587
ccgttgctgtcgactactagatgagatcgtgctacatggtggtggcgaaataattcatgacactgatttgtacatgtcgtcgccacatagtagatagtatgctgacaacccttgcaggtgagcggcgattgtactgttgactgatcatcgactcatggacatcgaccacattg

SEQ ID NO: 102588 - DNA, 639 bp, Triticum aestivum
  Clone ID: PAT_TA_102588
gtttattccctttttctttctaagaatcaggattgcataactctctcaattgactgatgtactaacatagatcggtaccaatcgacactactagctaccatgcacaaccaactacacgacaacctcgtccgacggacaccctatagcctacgcaccacgacgaatgcggcataagtcaacgcaacactgacgctacactgcaatcgtcatgaccactcctcggcacgacccatcactccagggacgacatcacgtgactttccatagggaacgccacgccgtcacgggcccccatccatccagcccgaccgggcatcgccgcggccgcgggccgcaaggccttgggcattggtaccctcttgcgcgaccatcggcactcgcggtcggacccgccagtcatcttgcggccgtcgcggcactcgtgcccggctaagcaagcggtctcggtggtccgcttcccttcccgccaaagcacggccccccccgaaaaccctggcacgggcgctccaacgggggccccccctcccccgggccccccccgcgggcacctcttccccccccctcccgggccaaaccacctcgactggcccgcggccgacacatccaaaaccccctcggcgccccccggggcagagaccc

SEQ ID NO: 102589 - DNA, 435 bp, Triticum aestivum
  Clone ID: PAT_TA_102589
gggcgctgacgtttagctgcaggcttggctcaccacgccgccgtcgtcccggccgacgccgcggacgacaccgatggcgacacgatgggcgtggcgagcggcgctgaccacagcaccctggcaagcgacaaaaccactcaccgatcgttacacacctcgtgtttcagggacggcgcggtcgcacaacggtggcggaggcgtgggggtggccggacggacaggcgcccatgcgtcttccatccaaacgttagatccaggttggattcagcggacgcaggaaccaccaagaaatcacgccttcacgccaggccccgggcatgggggcgttaggtttcatcgtggcgtgccggttccggggacgcgcacatgccctccgggtggggcgatggaggcttccgcccggtttcaaggtttgacaccccccgcggcgccaat

SEQ ID NO: 102590 - DNA, 799 bp, Triticum aestivum
  Clone ID: PAT_TA_102590
cgttttgccggcaatggctaaaccgtgttcgattcatccctcgatggattcctgcattcgcactgcactggttcgtacgatggcagccgcgactctagtcgtggatacggtagcaaatgtgatcgcaggaagcccatgccttcgtctagcagatatgtcggccagtcatagggtgatttcttcgctcttcggttctgggaatcgaacttcgtccaggcaaggacaagaagaattcagagctccactgactcgaacgatgcacggatgctcgacatactggggatgcccacttggccctagtttatgccatgtccctgggctattttggtccccagaccggtaccgtgtacgggttgaaccagttaagggcggtttatcgtttgacgtcgagtgctcgggattcggccaagtgttaccttggcacaaggttcgatccccctgagattcgcggctacgtcccctcgccacacgcaactgcccttgtaagtactaacggatccttagatttcggggatttggcagtgtggatccgagatgggtatactcagagtggggcgccagcgctcccattatatccagtagacggcctatactttctttggttaagggaattgttgcctttggctttcgtggttccgaaccctatggtgaaggtgttgcaaaattcgcgactaaatttgcaaaaattctggggtctaaagcaaagcgtaatatctgggtgtcgttagcactatacaattaggctatgccggcaggctcttttcccccaacgtcggatacgaaggaggagtaggcgcgg

SEQ ID NO: 102591 - DNA, 830 bp, Triticum aestivum
  Clone ID: PAT_TA_102591
gatgcctagacgaccgctacgagtagctgttccgatgtgcttcatatgcgacacgtgcacgtacgtggatgcccactgcattacctgcctgtggcgtttgcactccaatgaaggcaggctacgcacttcgaagtgccaaagtagctgaaccttcggtgactaaatcaactaagtcctgactgatcatgcgcctttgtaacaagaagtctagtaaggtccgcatggttgcacgtccgactgcccaccggctccagtgatagcggagacttaatctctcaaggcattgcactgtgaaagtataggcagttcaggtttaggataccgtgaaacgagctcggggtttggatttttggtatccgttgcctgttatcttgggacagtatatcgaatgcttggctcacttctatttccctcttgcaaggaatctaggcattgccttaccacattatcctaacaggtctaaaaatgtgtgtatcagcttaagctgggcctaagaagcctgtcaatcgtggtctgtttagaagggtggcgcacgtgggagccgcgtggtgtagcacgtatagttgcttgtactaagcttggcgatgccatagggttcccatgtagggtatcggttgatattggttgttaaccgccatctgacgctgctcgtagctctcggatggtagtagtctttatgcgtttaaggccggcagggtgtgctcttgcgatttcaatctgacccctagtgcacaaagacgaacggctggtgcagaatcatcataatctttcgggtatattcctaagaatcctaaatactagagcacacccgatcaaaggattgaataggt

SEQ ID NO: 102592 - DNA, 654 bp, Triticum aestivum
  Clone ID: PAT_TA_102592
atccactccaagcacagtcgagcagaagcctaaagcagagtgagatttccccccttccccgttgattctagttcggtgttccaatgaagaccaaagatgggcctccaacctagaaccagggcctagctaccaccgccgggacgtagacccaaggccccgcaccccgaaggagatagacccggggcaggttgatgggccggcgaccaaatggatcaaggggcggcggcatgagccgatcggacgcgcgcaccgaaggcatgaattggcctgggcgaagactcaaccggaaggggcgggccaaagccaagaaagtgcccgggccgaagaaccggcctgacgtgcccaccccaaaagcaaggaaaggggcccggcctgaaggggccagaacgggacccaaaggaaccggggctgccaagaaccgggcggcaacgagccggggcccaaaatgggagggaaagaaacgggtaaccgaacggaccggggccggcatggtctgggcccgaacggggggggccgggtggccccgggccctaaggggggcaaaatgggagcccaaagggtcccggggccaggccaaaccccccttccgggggggggaaaaaagggcctggggtggggcgggggcccctaagggaaagaaaaaggggcgccgcc

SEQ ID NO: 102593 - DNA, 590 bp, Triticum aestivum
  Clone ID: PAT_TA_102593
tttcctgtgtgaaattgttatccgctcacaattccacacaacatacgagccggaagcataaagtgtaaatgctctggggtgcctaatagagtgagctaactcactattaagttgcagttgctgctcatctgccctgctttcccagtacgggaaaccctgttctgtagccaagcctgcactctatatgaaatcaggaccaactgcagcggtggaagaatgctggtttgcagttactttgaggcgcctcgttcccggcttccttcggcctcaacttgacctccgcctagccgcttccgggtccgtttccggccttgctggccgaagcgtgttagtccattcctcaacttcaaatatggccggggtaaatacctgggtttaatccaatcatggaaattcaagtggggaattaactggcaagggaaaaaggaaacaatttgctcaaggcaaaaaaatggggcccaagcaaaaaaaagggcccaaagggaaaaccgggtataaaaaaaggggagccggccatttttacttttaggcggttttttttcccccaattaaacgcccctcccccccccccccctttgaaccaaaaggcc

SEQ ID NO: 102594 - DNA, 661 bp, Triticum aestivum
  Clone ID: PAT_TA_102594
agctccaataaacacagacatcaacaccgaaagtgttaattactacattgcacagacgcagcgaagacaagcattagagagttcaattgttactacccttagtgagaacatcataaccgaccgacgagcacaggaaggctaggattaggctcggtttgtgtaccaggatccgcgcatcacatcattcactctaagatcacgcaggagtaagactaatcggcgactagaagaccagcgagcaagacaaggtaaacgtcaggattcatttgttctttcatttcgtttgggccagagccggcttgtgggtccttctaatcgtgtccaccatttccctcccaccagtccgtttcgggtccgttctgttcattccagtcaagtccggtccggtcgcttccggtccagttcatttgcaactcagtccatttcagttccggatcactgttagttacatgccaaagtcagtgcaggttcgtttttgccttgctcgcctggcattctggaggacgggtgtatatgcgccgtggtttttcgtgcccgtggatgggggtttccctcgccggttccgcggcggggtggcttccgggtgctggtctaggccctttagttttggactggccgggtggtgatgtggaccccggctcctcctttttgtgaaattcta

SEQ ID NO: 102595 - DNA, 2369 bp, Triticum aestivum
  unsure (1)..(2369): unsure at all n locations
  Clone ID: PAT_TA_102595
gttcatcggattattganagttacttaccgtccgtacctgccgccacttgttacnagttattcgtcctagctacncctaatttgcccacttactctttacgtatgtcctgagtcgcacgctacgctactgcccgttccgtacgtccctctcctctgttaccgactcgttacccacatcgttccggacccgcgcattcgtcactcactcgcccacacaacccccagttcccatatcgtactctatccgttccctgagccacaccgtggcggtatccgctgtcgctgtcccgtccgcgatagcctcactatcgcgcacaccccccgtctacctgtcatcaccttcgctcgcccactcctcgttgcgccaatacccctttcaatcgtgcctcctacgttctccagggatgagcaacggactagggcaatggccactccgtactgacccgccataccgtctgactcagcccccgctcgccgacacgcgcacccactcgtccgcccacaagcgcatccacccagcccgcttggtgctcacgtcgctcaaacctcccctccgagcactttcttccgtttcccccatcactccacttaggtgcaccccatttagtccggcgcctccagcttatttgacttgctttacggtcgttccctttcaccaagcttcgcccggtttcacatagctcagttcaggtccgatggcgccccctcgcttcacttcagcccacaacgtttccgcacggttcaacttacagctatacgaaacgcctacagtcgtcatgcgatttccgtccgttcagcttccacccgcctccctcccgacctcttagctaaaccccctctgttcggccccggcccctttagtttctatactggcagtgcccgagctgagtctcatatccgttccctccgagtccctacatgccttgaccgcacccgaaggccctggaacctcgcgcggctctacatcctctcatttaccgcccaggccgcattccttcctcgtctttccgataccgaacccgctcgcaccaattgcgtttcacatacgccccaccgccacccccgcacaacacccgcatgccagctctcttgctccacgaccacggttccaccctgcgatttgcgccggttcgtgtctgcttcagtctcagaatactgctctcatagattccctcttgagcatacatgcgccccacaccgcgatgtcttctcggcgcagatcctcgcgcagaggcccctctcccttgcgcatctgcccgcaaaacgcgggccctagatctctacccccacacgccgactatcgacggccaacacgccgcgctcctgtcctcagcgccaacacctgagatccctcttagctcccgcgctcctcttcagcgccggccacctagggggctcacgcaccctcgccagtcgcacctctggctgcaacactccgaccgcgggcaccactctcacttcagccgccttacaacccacgatcagcgtccgcatctcgggcctaacaccacgcgtctgttctcccgcaaagtctctctcgatacactccgcccctcccaaactcccatcgcgtaccggcaccgcctacatctccgccagaaaccccactccggtgctgtaacgcgcacacaacagcctcgcaccgtcttaactcccagactcactcgctcccccccacctcacctggtcgtactactcgacacctggggcctcacaaacggcctccccccgcgcccctcgcagcggtcgccgactgccacaggacaaagactccgaccggtctttgggcccttcgggcggacaccaaccaaactgcccgtgaaccagcccccctgcagacctctgcttcccactcgtcgaattgcggcccacaaagcaccacccccgtgtgtcggggttccgcgggccgcgacccccttccgccaaacccccctctgctacagtccgccataccagagctcctctgtctcctcctggccgcgtcgcgccgagtccgatacaactcccctccgttgccgtcctccccgtacctgcgcaacggtcgggccaccctacgccgcggccccccgcacgcgagtgcgccgcgaacaccaacggccccccttcaggcccgatttgacgtaccccacctagcccatgtccgcgaccccccgaatcccccccccgcctgtctttctgccggctcacggctggctatccctcgtataacactcccccccccggccaggcgtaccgagcaccccacgacgcgtgtagcactcttcctggcggtcgctcccctagtttccgccctcatgctcccccgccccgtcacataacaaccactgagaccggcgcgccctcgccttacacaaccccatcgcacaccc

SEQ ID NO: 102596 - DNA, 615 bp, Triticum aestivum
  Clone ID: PAT_TA_102596
cgagcatgtaaggaccgtgttcatggtcgtgtgcgcacccaccgacgccggaagcacgatgtcatgctcgctagcaaacctcgctcgaaacctgaagcagagaggctgagcgctttccggattggatatgcgacctgtcgcgtgagcgttgatatgatcgatggataaaggtaacaacgggtgcatggatggattgccgaaagaattggcagtctgagtgtagaatgggtagagaacgatgaaaggggaaggtcagatcggaacaggccgtccggaattgaaccttaccaaaccggtagtacgtgaatccagaggagcgtataaattatatacctaggaattgggaattaaagggttttacgtccaagattcacaaccagacccgacaggtgaaggtttcgaaatggcttagggaagagacggaatgggccacctggaccggtctaaatagagcaagaagccctaaagcgttaaagtggcccctggtctaagcaaaagagtaggcagccataaaaaaactaccgaagcgaatatgtgaagtaccaaactgggatatagcgcaaggagtgcttttggaagataacactctgactcgaacgctcagggggaacctaa

SEQ ID NO: 102597 - DNA, 2579 bp, Triticum aestivum
  Clone ID: PAT_TA_102597
gcacgaccgacccatgcgtcactgggccacccgccacggtaaacccggctcaacccacccctcggacagtcgcacgccccacggatacggtcgatgacggacacgttgcacgggacatgctatgtccccatcgagcagctattccgtgcatccttcccgtccaccccatccactcatcccgccatgccaatcctgagagcgccccacggttccaccccctaggcccgcccctcatcttgtccgcgatcgtggtcccctacgcaacatgtacacacgagctcccgaggcatagcatgaggaccttccctgactagcgctcccggagaccttggccggagtccactctccccgaccacttgcaccgggctaacatcgcccatccgtaccggctgtcgctctccgccacgccacaacgccgcgcccagaacgggagtcaggctctgcccgcgcgcctgatcgctcagcagcattcggcactcccaagcacacattcgaccccgtacgagctttctgcccgaccccctgccctccagtccgccgtcagcttaccttcgtctcctactccgcgcatccggcccgttcaatcctgcagtcccatccaacgattcctacccggccccacacgccgtcccaaggcctgtagactcgcgtcccgcccgacgcactgccccgttcaagtcccggcctcactcattcgcccccacatgcgtccctcagcgagcgcaacgacttctcccacgctcccgcgcctatccatgtcccttcccctctctgtcggcccaatgcctgaccactcctaggcagcacggccaccgcccaccgccggcgatacgccccacgcacgccgaaactgtgccccgccacacgcctgcccgtcccatcgtcgccccacaaccgggccctctaggactcgacactctcatgcgcacaccccgccctcgcagcgacccctcgacaccgaggacctgcaatcccactctctacaccatacctctctctgtcgctcctgtttccacggccgtcccagtacccccgcacccaaaacacccccaacccttcctccgatccccagaccgtgcacgaccagcccaagccggagaccgacgcccaactgccccggcgcccatgactcccgacacctcaaaccctcgtctcggccataccccgcgacccctgacgattctctccacccgatccgcgcgcccacagccgcgcgtgaacagacctcacgcccgtttccccgccacaccgaacccaccggtcgcgagcaccactcgccggcactgccgccatgcgccatccatgacctactacccggcaccgccccattccctgcgacaggccgtccccctcaaagagccctcgctctcctgctcaacatgtaccaccggtatcaggcacctctgaccctgcaccctcacgcccctgccttacaactcaatcccccccccggtgatgcaaactcccgcccgacgcaccgcgagcaccaccccacactgcgctctaaacccgccccgctgaccaccacccctcgagacctctcccaaccccctccccacaggtgctagcgactggacctctccactagcacggcactagccgcccacagacttgatccggcctacatccactcccccccgcattctgcttcacctcgtctcccccccgaatcaacacccggcgcctgcgaccacccccgccccttcgggcctttcagcaacctcctccacctcgccgtcccccccgcccctcacaaaaccctggcagccacaccctcctgcaacgaccccccctacggcccacgctctccctggtccgcaccacatagcccacccaccccatagccccccaatctaacgcgccacgtcagtctctgccatagcaccgcctcccgttgagcgcccccccacccgcgcgtttccccggccccaaaaaagtcgcggtcgtcccaccgcagtgcccccccgcccccactcccggggcccccggtataccacaccacctccgcccaccccatctctcttcgcccgagactcctcccccccgctgctgcgaactgtcccccccttgctacaccctcacttcctaccccccacaacctaacgcccggggacgctcctcattctaatcgccccccccatcgacgcccccccctcccgcgctccttgagctccccccgcacacccccactagcccacacacctcctacatcagcccgctccaacgccccccccccaaacaccattcgtccgtctagatagcccccaccctgatcggacgccaccccgtcgtgcggcgcacgcgcccaccccccttcgtaccgtcgccgctcccccccgcacccttacaccgcgccccccccccgctgtaccgcccccggcactgacccggaccccccccagttataacccccccccccccacacccgccccccaacacacactcccccccgacgcccccccacccgggtctccttaccgaccagctatcttccgccctcaccccgccgtgcaaatggaccctactgaagctgcgcccgcccctcgtaaagcagaagccgagccccatccccgcccact

SEQ ID NO: 102598 - DNA, 781 bp, Triticum aestivum
  Clone ID: PAT_TA_102598
gtttagtttatattattctaccttgcaaaggttagactcagttcgatacgaaagctggttgcaagacggtaaccttagcaaacttggtttgcaacccaaacccagcagggaactcagaattggagcccaagtaaaagaccaggcacaggacgggaactgaactgtagcgacaatacggaaggacaaggcaaccgtagaaatccaaaagggctgccaaacccaataagggaaacgaacaacaaatgggtgaacaagcaaagcaaaccaaccacgaaatccggatgctgaattaaaggggaaaacgttaacccaggaacccacgctaaacggtataggacggagaagggactgcaagggatggagaaatgggatgaaaagcccccgactcccagggcaatctagctaggtaaagatccgaggccagaagtgcgatagccggactccagttcgagggaaccaaagacatggccttttggcccaaggcgatagacgcaatgccaggcgtgccgtaaatggcctggaggtactcaagggggggtggcaaacgacccctcaaacccgcactgggtcaatattgggtcaagtccgattggggcacactatttaaaccaatctttagggcccaccagtcaggggatatgccactgacaggccctcctggtaagaacccaatccaaaactgacgcttggacaaaaggggtgcatcattccccaatgaacaaaaaagggaaaagaagagatccattatttaaatggataccaatacaccacaaggccacaa

SEQ ID NO: 102599 - DNA, 695 bp, Triticum aestivum
  Clone ID: PAT_TA_102599
cggccgcagcgcccgcttactccacccggccagcggccaaccgatgggcggtcggcaaagaacaagccgcatctccgaaaggggtaggatagtggtagcaaaaacgaagggcctgtccggatcgcgttcaccgaagtaagcaagtggggtaatgagatctaaaggtcgcccggctgctggtttcatctagcctgccaagcgttccggccaatggaacgctcgggtgtccccagtcaccaacaaggcgttaaccaaagaattgccctccaagagggggttctggaaggcaccaaggggtggtttcgggaaagttaaccttctatagccttgatttgtttctaagaaacggagttgaagggacccaaggtccctacccaaggaaaggaatcaaagaacttcccggttgcgttgaagggattggtgccaaacgggggatttgaatttggtcccgtcaactaaaaacggtttccttgggggggcaattgggaaccgtttcaccctatcgttggatcgaagtcgtgaaaatggtcattcggttgggtggaaagggaaacggttgggcaatggaaccactttcagtttggaaggggttcccttggtttaggttttgtgcacagaacccggcctttaagcaaagtaaccgtttttattcccgttgtatttttttcccgccccctttgggatttttacgggac

SEQ ID NO: 102600 - DNA, 545 bp, Triticum aestivum
  Clone ID: PAT_TA_102600
tttgaatgcagaagtctgaagtcgaattgatcaaatgttagactctgtgcaaatccataaagccaagttctgtaccaaaagactgatctacgtgtcaacatgaccaaacgaagcaagcaaaaaactacactgattttaacttcatcacgtaagtgaagtaacaaacccgtagttacggcatcagcttcctgattggattatcgagttggaaatttgtagtgaattctaaacaagttggttcaacctgaaatcacgtttccagacaggtttttgcacgcctggtaaggaagatccgtccagaaattttatacaaaactaagcctgagaaataggcatcctggggtaacgggttccgttggagttggccatcctccccggcggaatcactttaaacaggatataaaggagatagggcctaggtggttccgggggggactatcaggtggttggtcaacaaagccaggtccggggcccttcctgccacttttttgggagaagggccgttgcctcagggttcccaacaggcgaattctccggtccggtcc

SEQ ID NO: 102601 - DNA, 729 bp, Triticum aestivum
  Clone ID: PAT_TA_102601
ccgcggcgactctcggccgggacctggcttagccagatgcgcacggggcctcttgggggcgtcgaacgcgctcacaccggtaggtgtcgggggacggggcgggcgaggctgcagggcgatcgtcattgtctagcctgtggtattactggacttcaggagtgcggttccaggttcgattacatgcacgtgtcacagcgggtagtcttacggcggctcacctgtggcttttgtccaagccgaaagtccggcggattggacctcagatttgctggttggtagtccaaaccgggtctgccctgcgtccggtcacggtaggggtatggtataggtgaactgagtccggcgggaccgacttggtgtcagtgggagttgaggtgggttaaaagagcctaaagctcttggttctttgcatcgcactgggtttcgggaagaaaccgccaggggctttcgagcggtttttcccccttgagccgtgggtttgggaggtggggaaatcaaaatttcccatgcgcgatgtttgggggattgtacagttgaccttggccgtttcgaattcgcaattgtaactcgagggcgcaaaggaatgcccgcgagacggcgtccggaggagcgtgatgtttaaagagtagttgggcccaagctcttgtcgttcgctacagcggacactgtggccgttgtgggggtggcggtcgacgtgaaaagagggccaaagggtttggaacgggacgc

SEQ ID NO: 102602 - DNA, 416 bp, Triticum aestivum
  Clone ID: PAT_TA_102602
tttttttttttttaaaagtcacagtcgatacacaaccaaacaaacatgttgcctggtgcatcagtcagtagttggacaggttatatatagtagctaagtcacgattgcagaatgcaatagcagtaagggcatataggttggacaccgttacagtagtaatagacgtaaacactgattgcaagaaagtacctatctaactaataaggaatcgttcaaacaaggcctaaatgcgcaatgcagggttcctgtaaaaagaattccggttcccggtgtcatgggcccatccaggttcaagcccccccgcgattgggggtgagaccgcaaaccccgccttggggtttcaggcccccgtttctgagaaagtccccagggcccctagccaaccccccgggcaaatgccaggctccggcccccag

SEQ ID NO: 102603 - DNA, 531 bp, Triticum aestivum
  Clone ID: PAT_TA_102603
cgaatggagtcatgacattgcgatgcgatgtcgactgggtctcgcgaagacctttatgatagccgcaaacgaaagcctgaactatgcgtcggagcgcccttcaaccaagtccgccaactcgcttgggcttgtactcactgcatactatctagttgatagggcgttacatacatttagtaagtcaaccgctctactaccgggcaacctcgtaaaatgattgggctaccaaactaaattgtactgctatgctgtaattcagataaccattgaaggtgaaaaaacttcctctacattgccatattgcatccgaaaacacatctatcaactttgatgcgtatgacataaaattcagatattctgataactataaacttacggtcgaataaataaccttgactccttaaacattaaatctttacataccgtaaaattcaatttaaaaagattaattacatattgtatttttcctcccgcctcatgtaattacctttatatgtccccccaaccacaacacatataaataaattctaa

SEQ ID NO: 102604 - DNA, 526 bp, Triticum aestivum
  Clone ID: PAT_TA_102604
aaggatgtctgacgatgcgtgcgatgtcgacgcggttctggaagacctgggagtgcgcaaaggacagcatgactgagcagggatggccctcaacgggggcgccaaccggctggggtcgcacctctggatcgttccgggttagaacggggtatcggaagtttggaaggctatcgccattggttcggggactccagataacgaatggagttgaacctaatggccatttgagccgtggcccgacaacgaagaagagaaagaccttcttgggtaaggaaggtcttccgaaaagccggaataaccttggacccgttggcaaaaatcccggttgccggtctttgaaccttggggggtaataagggggaggccggaaaaaggaccgaacgatcacaaactccaatgcttgagagttaagcctttgattttacccccttcccacgaagacgtttttgtaccccacatcaccaccagttgccgaaaaaggaaaatttgtgcaggaactctccgcgtccacagattatggtgtgac

SEQ ID NO: 102605 - DNA, 263 bp, Triticum aestivum
  Clone ID: PAT_TA_102605
ttggtttttttacttttatgtaagagaggagtaatcctccgttctatgtagtgtgtaagggagtcactatgacgcaggcttccgtcatgcgggtattccgagggccgttgcgtctgacacgtattgtgcatctcctttgcgcggagttggaagtatttgcattctacactcaggaatagcatcctaataggagtgtacaaggcttttcagaaggggtattccagatatctagaggaagtgaaaatcggttttacattagtcgg

SEQ ID NO: 102606 - DNA, 930 bp, Triticum aestivum
  Clone ID: PAT_TA_102606
tgtacagtgcggatgcagagatcagacagaggcttcgtcgaaacgcatgggtagtgccgctagagggagcgccatgaacggagcacggcgtagagcccgtctacagaggcagctcactctgcaatgagtcctgactcccttgcactcgttacatgatcgtcagagagcttcagttcgatctgaggacgctatcgctcgttgatccgagggactcccagtaataggtactgcagttgcaatcgttaggtgcgcgttgaacgctgggcgcgtagaaatcgatggtaccgagaagacaccgtcaatagaggtggggacgggattcaggatcatgcatgaagtagccatgtgcttgactgacgaggcaagtctggagctcgcggatcagtgggaccggtatcgcgacgctacctaagcgaagggcggacaaaatgaacggctggccgtcttgcataagcgagcttagttctggcattaaaccagttggggtgtgggagggttagttagaaccggctatattaccacgtctgtacgacactcttaggcagtatgagaatgactgtaaggaatcttcgcgaaacggcattctattccttaagtggcgggatggaccggggcatatggaagtagctccgttttgagccttggtcaaagataccacgtgcgaatacttgcatcgccatgaccttgcgataccgaactgactattgaataagcgtgaatggtcatgggtttgtacaaaagtattttagtgcttcatgagaaatcaagatagcttttgggaaatttctagggttattagggaatcggagaaacactgaaggcccccaaaagttatcgttacaagactgcggacgaactggcaatcatcggggaacactgtccgggggtgtagtggttctcatcttagagggtacgttacaaaaggcagtc

SEQ ID NO: 102607 - DNA, 639 bp, Triticum aestivum
  Clone ID: PAT_TA_102607
tgcatattagccaaggtgcataacaggttcaaagatacaagggtcttacaacacaacaggttgtaaaacaaacaccaaaagcaaagattcaaacatgacagataacagataaagccactcggtgcaggagtcatgggcatagcatgcagcatcgccttggcaaatagcaccaggacggcagggctcttagatactcaggtcgcccttcgatcatccggtcactctagcctcgtgcgtaactacagtcgaccagacttgctatcattagctcctttctgccaggggcaggcaaagcattccctgcacggggccgctcaggaggaacctcttccccctccttctcatggctccctgcaattccaacgttaccgcagttgggaagcgaaatgggcatcggcttcgggtcgtaaccaattgaagggttctgaagctttggtggggttcaattggccgggagagcaatgtacccttaggaacgggagacctgcattgggcaagtttgataagatgcaattggaggcagcaggagccctactcgggaagctttgggttttggggttcagcggcgctgggggggaggcgcgaccttgggattggggtctgagtaagttcagttttaagcagtgcgttgtggaggcc

SEQ ID NO: 102608 - DNA, 1636 bp, Triticum aestivum
  Clone ID: PAT_TA_102608
agcccccgcgtcctcgacgtctggtcgcttcctctccgtcctccacgcccgcacccccaggcgacccaccgccatcccaccggctaccctgccacccccgcctacaccgccctccccccgtctcgcgctgccaccccggctgcccgccctgccccgggcccactgtcacccgtctacctcatcctctcctcgcccgcgggccaccgcttacccgcatgccccccctagtccccctccccccccccaatccaccccaccgccctgccacccgcccccgccgtccgcccgacccccccctccaccctccgcctcccggacccgccccggacaacccctccccccgccgtcccgccaaacggcagacctccaattgcccctctcccaaacccggcccccccgacgctcgcagtcccgatccggcgaccgcccgccccctgaaactacccccccgacctctattgccttccccccccgttgacgccggccatccgctcaggagttcagcgcgcccacccggcctccccccccatcggctccgaacgaacagctgcccctcatgcgacccgggtcagcgcccgtaggacattccccatctacaacgccccccgcccctctcccccactactcgcccactacccggcccccctccccagcttcctgaaccctcactcccggggcagcctctcccgccccgaacttacgcccccccccactgccctcgccccctgacccagcagcatcgccacgactgtccagtaactccccccctcccccttccaacccgccccgctccgccgcctacccgcgcgttccccaccccatgcgcttcgccccactcatctccgctgctcccctcagcagcactcgtcgcccgccctcaagccgcgttcccgctgccctgaaccctccccgctaacccactcgccccccccctcaccgctccccccatcgcggcccctgccctcccaggccacaaccgcgccccctcctttcccctcccgccccacgttgccgtccacccaccgcgctccactcaccacacgagcccgccctcccacctcccactatcccaccacgatctgagcccttccccgagacccccgcccccactccccccacggaaaactcatcccgccccccccctcccacatcacactccccccctcccgcccaccccttgtatactccagcccccgcggctcgccgccgcaccaccgcccccgccctcccgcgcccctcgaccccccacgcatccccacccgctagcctcacccaacccgcctaccccccttaccgcctcgctgcggactcccgacgctcatcctccctcccgctagccccaccctccctcaatctcatccctcgctgcggcgtggcctccactaaagcaacgacctccccacacccagccccctcgcataccccgaccctacccacccgcgcacaccctgacgaccccgcctcgcccccggccagactactcttctgcccactttctcgcctccacccacatcctccctacgtcccaacgcgaggtcacgctcctcgccaccgacaccccccacgtttccgcccctgcccaccaccatcccgtctcgccagcccgtcatccgctcgcctccctctcccaccaccc

SEQ ID NO: 102609 - DNA, 617 bp, Triticum aestivum
  Clone ID: PAT_TA_102609
cgacacaacggaattcgtaatcatggtcatagctgtttcctgtgtgagattgttatccgctcacaattccacacaacatacggagcccggaagcataaaggtgtaaagcctgggggtgccttaatgtagtagagcttaactcacatttaattggcgttagcgctgcacctgccccgcttgtctcaggtcggggaaacctggtccgttgccaggctgcattcaatggaatgcggctccaacgcgccggagggaggaggcgggttgtagcggtattagggccgctactgtcccgccttgccctcgcttcgacctggacttcggcttgccgctctgggttccgttcccgggcttgacgggcgtaagcgggttatgcaggcgtcaacattcgaaagggtcggggttaatgacgtaggttgaatgcccaacaagaaatgccagggggggaaataacgtccatgggaagagcaaagcaatgtgggagccaaaaaaggggcccaagccaaaaaagggcccaagggaaagccggtgtaaaaaaaaggcccggcgggttgggcttgggcggttttttttccccataagggggtttccggccctcccccgggcaccggtgacccatc

SEQ ID NO: 102610 - DNA, 605 bp, Triticum aestivum
  Clone ID: PAT_TA_102610
ttataaacagcaacaagagcgaaagattatggctaatagattgttcagtagcaaacagttatcattacatggcttacaagcttctctgctcagggcggaggaaacacaagtaagcagcgtggtccaaccaacaaaacgtactcaggtataagtaacccaataagaagatcccgaggagaagaaaacgaacggaagttgtcttcgatcgttcggcactggcgtgacgtccgcccgcgcggaaaccgagcccacggtaggaggagtgactgccttacggctaggaccttcgccatggatagagcgcggctgtttgattggatatcgggaggcaaggtccgagggcttacgaacgggaaaccgtgcaaagcgtaacggatgcgtaaagtggtcaacaagcacgtaaagtggcggacgagtagcggttgaaaacccgggcaagtgggaaggctgcggcgagcgcaggttgaagaaagaatggatgccctatggagaaatggggctcggcgtgggtgggaattctaaggcgaacccccacggggtggcctccaaacaatatgtggtcttcttggggggcctaggttacccccttcataggattgggccaa

SEQ ID NO: 102611 - DNA, 544 bp, Triticum aestivum
  Clone ID: PAT_TA_102611
ccgttgctgtcgcgcgcgcctccgtgatgactcaccgccgctacagcaagagactatcttctttcaaacgactccccaatgttgggggtacctcaattctccgagattactcggaatagcaaagggacatttgcatcgatggtgagccagtattactatagggcggaaccattggctgggtctaacgtactttgaagggaagtccaagcgaggaaggcctgcggggatatatctccagatcattcgcatggccttgcaactggacgcgtaaacctgggtcggatggatgcgtgtcaggctacggaaccgtcggccaaaggatagaatccgttaggcaatccagagtttaaagcctggagagggaacggaataatagtgcaactgaacaaaagggaataaatgcaaaccttttttagcaggctgttctggttattcgtgttgtctctagcacattcaagcctaattatcgaaggagaatctggattgtccacctgattcaaacataatcggttggatgtttttaccaacttgggggagggaggga

SEQ ID NO: 102612 - DNA, 224 bp, Triticum aestivum
  Clone ID: PAT_TA_102612
attatccttaatctgttttttgtgaagacagcggatgagaaagaaacagtatccaggaccgtgtactatactaacattgtaattatgggtccatgccacctatttctattttgaagctgttcttttaggaacagatgattacacatgaagtaatgttttccatgactatgtgactatactgaacgattttaaggtatatatgttggttcggggggtgcctccat

SEQ ID NO: 102613 - DNA, 400 bp, Triticum aestivum
  Clone ID: PAT_TA_102613
gttcttttctctcttctctttttacatgcgatcagtcacttttacttctcgtcacttacatgtagtaacacaactagtagacgtgttcgctttagcactcgctgcctcggaatgagatcttatctcttggatgtccggtatcgcacgtacatgttgcgacgtccacattccggacaatgtcagatactacgcgcgcgcttacaagcttgtctagaagtcgcgtagactcgtgatgctgtgagtcacgcggcgtctctgctcgctcgacattcgcactagtctgctctctgccgtcactcgcacgatagccgtcggttcctctttcctccgacaacttcggttaccggacccaaagggtcgccccaaagttcgttcccgggcgggctcgtcccttcactcg

SEQ ID NO: 102614 - DNA, 357 bp, Triticum aestivum
  Clone ID: PAT_TA_102614
atcagctgtttccatgtcgtgaacattgtgtatcactctcacaagttaccacacaagcagtactgagccgggaatgcattaacagatgtaaatgcctagggggtggcctaatcgatgtgcagctgaaactcagcagttgaagttgacgttggcgcatcagctagccacgctcttcacaggtcgaggaacaccatcgtcggttgccatggctgacacttatgttgagattcggtcccaatcgcggccggtggtgagaggggtcgggtctttggcggttaatttttggtgggggtcctggcctttccttttttccccagggccgatttgacccctgatcccggtgccatggccaaattt

SEQ ID NO: 102615 - DNA, 485 bp, Triticum aestivum
  Clone ID: PAT_TA_102615
agattctaccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacaattgcaggtccttctcgggggtcgacgtctgcgacgacgcccacccccagtgccccaagggccatgcaaaaagcactgatccgttcagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgagaaaggctggtggtgctagtacttgttcacctacctccgtgaataaacacatgtgatgattgtgtgtgcctact

SEQ ID NO: 102616 - DNA, 372 bp, Triticum aestivum
  unsure (1)..(372): unsure at all n locations
  Clone ID: PAT_TA_102616
aggccaaacctaaaggacaatgtcacagtttcgcgcaccgtcaccaatgtcgggccggtggaagcgacttatcgagtggttgttgaggctcccgcaggggtagccgtgttgatggagccatctattattagtttcacccaaggtggtagtacacgcgcaacattcagggtgacactcacggcgaagcagagagtgcagggcgggtatagtntttgggagcatcacatggtccgatggaagtgcccactcagtgagaattccagttgcggtacggactgtgatacaagacttcgtctcagatacatcataaatttatttgtaactggcgtatgctcctgttccttcattcatgtacttgtcctgggaaaaaaa

SEQ ID NO: 102617 - DNA, 335 bp, Triticum aestivum
  Clone ID: PAT_TA_102617
aggtgagctgccccacagggaggtgctggaccacatcttccgcatcctcaaggccaacaaggagaagatcatctcggagccaccggaggtggggaagaaagagaagctgcccgagctgctgcgcagtatcggcgatgccctgcagcaatgcaaggcacggtccaagcagcagcagtctgagtctgacaaggccaagagcaagaagatgacaatgccgtcggtgagcgactgcaaccctttcaagtctcgaccctcgcagctgtccgtcgaccccttgctggagcagaccatcgccattctcggcgatgttcctcctccttctccttcccctgatc

SEQ ID NO: 102618 - DNA, 430 bp, Triticum aestivum
  Clone ID: PAT_TA_102618
aggcataaaacacttgcctaggcttgttcattttgaagctttgcgtgtcctagaatttcaagattgtcagaatctgcatgagtatgatatgaatggcatagataaactattccagctgaagtaccttagctttaggggtactgacatgtcaaagctaccatcaggaattgtgaggctatatgatctagagacgctagatcttagaaatacacatatagaagaattgcccactggaattattcagcttgttaagctacaatatttactcattgcaagatattgcccttctggtgatccttacggtgaaacaaagataccatatgggattggagatatgaggaatttacaggttatctcgggcattaatattttcaagagttcattatgtgcagtcgaggagctagggagcctgaccgggttgaaagaactc

SEQ ID NO: 102619 - DNA, 566 bp, Triticum aestivum
  Clone ID: PAT_TA_102619
aggccgcagcaggatcccaaattaagagctagctagctagctaattatagtactccacaagcaatgagcttttgccgcctagagtccaggggcaatggcttcttggtcctcacgatggccagcgccgacgagcacaactacctgaccgaggaagccatcacggaactcgtcgaggtgctcaagaaagtcgggaacaacgcggaggcgaaaggcctggtgaccacctgcgagccggcacgttctgcgccggcctggactacgaccaccacgcggagtcggaggagcaggccgagcacctggcgggacgcgtcgccgaggtgatccgcctgctgctcgagcttcccgtgccaaccgtggccgccgtgcgcggcaacgcgacgtcgctgggcctcgcgctggcgctcgcgcacgaccactgcttcgtatgggaccacgctgtgctcggcctccctgaggcgcggcgcgggcgccggctgccagactacgtggccacgctcctgcgtgacaagctgtccttcgcgcggctgcggaagctgctgatgctcaggtcgcagacgtgcaccggc

SEQ ID NO: 102620 - DNA, 388 bp, Triticum aestivum
  unsure (1)..(388): unsure at all n locations
  Clone ID: PAT_TA_102620
aggttcatgatacgaaacctcccttcctggatgggcgagttgtntacacaaagcaagcagagcctgttatgccactgaaggatccaacatctgatatggctatcattgcacgaaagggttctgttttggttagggaaattcgtgaaaagcagagccagaacaagtcgcggcaacgcttctgggagcttgctggatctaatcttggaaatatattgggtgttgagaaaacgtctgaacaggttgatgcagatactgctgttgttggtgatcaaggggagattgatttcaaggaggaagcaaagttttcgcaacacttgaaagaaaaagcagaagctgtcagtgattttgccaaatctaaatctctttctcagcaaagacaatttcttcc

SEQ ID NO: 102621 - DNA, 379 bp, Triticum aestivum
  Clone ID: PAT_TA_102621
aggtcacctcacgcgcaccccgcggttgcagaaaccggaagcctcgtcgccagagcacgaggcccagaggaagcaagaaccctagcccgggcagcaccaatattttgacctaaaatgggagtggctggtcacaacgatcctttgttaggtgaaaccacatgtgggtctttgctgcaggaactacagctgatatgggatgaggttggtgagagcgatgatgaccgcgacaagatgttacttcagctagagcaggaatgcttagatgtttacaggagaaaggttgatcaggcttctagttccagggctcgtcttcttcaacaacttgccaactccaaattcgagcttactagactcctttcttcgctgggagaactgtcta

SEQ ID NO: 102622 - DNA, 510 bp, Triticum aestivum
  Clone ID: PAT_TA_102622
tgtgggcctgttgacgtcattggtcggttccatctataagtcatcaggttgcatctgattcggtcggatttttactgtgatcttgtgtactggctaattacttttaacttcttgctccacaactgctaaggaggccgcaaccttgcggcaggagttgtccgagtcacagaggtcgcgtggcaagctccggactgcaatgggcgtcacggacggcgagcccaaggagtaccggcagagatagccatcctcgagagcacgatggccagcaaaacgcggagctgccgaagcaggcggctgtcctgaagaaaaaggaggccaccgccgagcgggtcggtaaggcccggtctgctgcggaggacctggtgaagcagttgatgaagcgacttcaggacctggaggccgctgctatgcataagcttttatttcttccgcgtagtttcccattgctttggccatggcttgatgggatgttccttttgtagtgccacttctggacgtcgcccgtgtgga

SEQ ID NO: 102623 - DNA, 356 bp, Triticum aestivum
  Clone ID: PAT_TA_102623
agcttactagatgcacttggagatggacatttctgttgctcaatacgtagctctgtgtggagttacacttgtgattggatggctagtacactgggtatacaaatggattaacccggtttgcaacggtgttcttcctcctggctccatgggattccctattattggtgagaccttggacttcctcaaggcaagctcttccctggacatcccagacttctacaaacaaaggatgaaaaggtacggcccggtattcaagacaagcttgcttgggcagcctgcggttatttccaccgacgcggaggtcaatcggtttgtgtttcagcacgaggagaccttgttcagtatcgggtacccct

SEQ ID NO: 102624 - DNA, 365 bp, Triticum aestivum
  Clone ID: PAT_TA_102624
agggaggacgcagcaacttcgaacccagctccacccaatactgttatcaatcttcctgatgatgatgaggacgaagagccgctgaagcgcaggaggagtcagaaagcgtccgccagtaaggtgcctcaggatgtgacggcgcctgagattctgactgtggaggaagagaacaccactcgacatacggtgtccttcgcaaatccactgacgagtgctcagcagccctccctcttcacgacgcaccacgtcccagaggaccaagctggcgcagcgaaggaggcgatacgccaggcgggaatcatgatggagcagctgaagaccatccgggacgcgagccaggcagcttatgacgccagttctgccct

SEQ ID NO: 102625 - DNA, 293 bp, Triticum aestivum
  unsure (1)..(293): unsure at all n locations
  Clone ID: PAT_TA_102625
aggttactcccccaccatcctctgcacccagcaagggttgaggtgccagctggactacctacagcaatgcctgcctggttatgagcaatttggcatttcaagaaaaggttcacaggacaccactgatgaatattgcacaatattctacgaaaaggagaaagtggagcttacagaaggtggcaccnttctggttatcagaatctccatcagtgccaggaagcatttcatggggagcaactgcaccatgcattgctacatgggcaacgtttcaactcaaaagagtagaaccacct

SEQ ID NO: 102626 - DNA, 329 bp, Triticum aestivum
  unsure (1)..(329): unsure at all n locations
  Clone ID: PAT_TA_102626
agcggccatggagcaaggcgccgactccgcggcggccaggcggatggccatcttgaagggctctaattgccgtgcaaaaggtgcagcaccagggttcaaagttgcagtcctgngtgcatctggtgggatcggccagcccctctcgctgcttatgaagatgaaccctcttgtttcggtgctccatttgtatgatgttgtcaacacacctggtgttacagctgacattagccatatgaacaccggtgctgtggtgcgtggcttcttgggtcagccacaattggaaagtgctcttactggaatggatcttgtcatcattcctgctggcattc

SEQ ID NO: 102627 - DNA, 427 bp, Triticum aestivum
  unsure (1)..(427): unsure at all n locations
  Clone ID: PAT_TA_102627
aggccgactttgatgccatgagcctcggctccaccttctccggcatggggaagccgtccccggtcgactcgccagcgggctactacctgngaggcggcggcggcggtgccgtgcccgggctggagcagtggagagtgcancagatgcaaggcttcccgttcttccaagcaatggccgaccagcagcacacactgaccccagctgcagcgcctgcaatggccatgccggggatgttccactacctangcttgggcaacggtggtgatggccgcggcgtccatgaagacgacggaggagaccaacagtttcatcacgcgatgccgtcaaagagagaatgctacccgagatcaggcagcatcgccatgtacggtgggtgatcaccacctcactgctggtgctggctacacaagctcctactccaatgctg

SEQ ID NO: 102628 - DNA, 530 bp, Triticum aestivum
  Clone ID: PAT_TA_102628
agcatttctaacaaagatcaagccgatgatgcacttgattctcatagtatactggttttgacgtctagccaatgcatcaaaaagcaggttatatctgatgaccagagtagcctgtcccgtatgaactactatgggaactctgatgaccagagccgcctgtcccgtataaactactacgggaactctgatgtgtccttaggacgatacttgcaagacattttgcagaataagaaaccaagttgttcctcttgtgaggctcacgtatactcttatactcatcaaaatggaaatttgactgttcgaacgaagcatctagtgtctcaacatagtttacctggtgaatcagaaggaaaaatctggatgtggaccagatgcctgaggtgtgaacatgaactcggggtatctaaatcgaccccaagagtggtaatatcatctgaagcgcggaatctctcttttgggaaatttctggaactcagtttttcaagccactctgcagcgagaaggttatccatatgtggtcatttggtgaa

SEQ ID NO: 102629 - DNA, 263 bp, Triticum aestivum
  Clone ID: PAT_TA_102629
agggcgcagttcgcgtacatcatcatgagcccgatgtgccggcggacatggacagggttcactatcaaggcgttctccgggttgccggaatttctgaagctctctgccgcgtccgccgtgatgttgtgccttgagacatggtactaccaggtcatggtgctcatcgctggcttgctgcccaacccggagctttccctggattccctctcagtatgcttgacaatctctgcttgggtgttcatgatatcaataggtttcaatgc

SEQ ID NO: 102630 - DNA, 457 bp, Triticum aestivum
  Clone ID: PAT_TA_102630
aggtggtacgtgtgcctattccggccggaccgcgtcacggcgcttgtcaacaccagcctcgccttcatccgcaacatcatcgcacgcaacggacccggcttcgtgaagcccaccgactacttcaaccgcgcctacggccccgactactacatgtgccgcttccaggagcctggggtcgccgaggcgcggcagttcgcaccggcgcacgctaggcgcctcctgcggcagatcatgtgccactgcttcagccacggcgtggcctgtgaggaggaaatgcacgacaacaagtacccgacgtctacgctccctccttggctcaccgaggaagacgtggactactttggcgccgagttcgagaggactgggttcactggcggcatcaactactaccgcaacctggacaggaactgcgagctggctgcggcgtgggcggacgccaaggtgcaggtgccgacca

SEQ ID NO: 102631 - DNA, 396 bp, Triticum aestivum
  unsure (1)..(396): unsure at all n locations
  Clone ID: PAT_TA_102631
aggcgacctgctcggcgcggacggggtgaccacggccgccgcggcgatcggcgcggccatccgggcgctggacggggacggcgtgctggcgggcgccgaggggtggttccagaagatcctgtcgctggtgccgcggcggcccatgtccgtgggcggctcgccgcggtacggcgtgtacgacaccgacttcggcctgnggcggccgagcaaggtggagctggtgtccatcgacaagacgcccggcacggtgtcgctggccgagggcaccgacgggcagcgcgggattgaggtcggcgtggcgctgccggaggccgacatggcgcggttcgcctcatgcttctccgacggcctgcaccagctatgagcagggagatgatcctgctggtggtcagtgca

SEQ ID NO: 102632 - DNA, 573 bp, Triticum aestivum
  Clone ID: PAT_TA_102632
agctggagaccacctcacacagaaacagaggccccttcttcctagctgctcaatcctccatagatgggctccctgcgaagcagcacgagcgcggcggtggagagcgtggacgccgaggcggcgtgcgggctgctggcctcggagcagtacgggtacgtggacgtgcggatgtgggaggacttcgaaaagggccacgttgccggtgcacgaaacgtgccctactacctctctgtcacgccccatggcaaggagcgcaacccggacttcgtcgaccaggttgcggcgctccactccaaggaggaccggttccttgttggctgccgctctggggtccggtccaggctcgccaccgcagacctcgccgccgctgtaagtccgttagtgaatggttgatttttttttactattcctagtaagatcaccatctttgattgagatgtgaattcgttttggttttcgttgcaggggttcgcgaacgtgaagaacctggaaggcggttacctctccttgctcaagagtaccagttacccgcagccgcaagcagcaagccaccaatgatccatcaattgattc

SEQ ID NO: 102633 - DNA, 521 bp, Triticum aestivum
  Clone ID: PAT_TA_102633
aggcgacgcgttcctccgggcgctcgaccgctccatgcagctggcggccgggttcaacccggccgacctgtggccatcctcgcggctcgccgcgcggctcagcagcgccgtgcgccgcgctcaggagtgccgcgacaccgtgtacggcatcctcgacggcgtcgtccgggagcacctggagaggatgggcggcggcggaggccacgacgaggacctgctctacgtgctgctgaggatccagaaggagggcgcgctccagtttccgctcgacatggacgccatcaaatccgtcatcttcgacatatttggcgccggcagcgagacggcggcgaccacgttggagtgggccatggcagagctgatcaagaacccgagggtcatgcaaaaggcgacgacggaggtgcggcaagccttccatgcccgcggcaccgtggccgagcatgctctaagtgagctcacttacctacacctggtcatccgggagaccctgcggctgcacactcccctaccgttgttgctcc

SEQ ID NO: 102634 - DNA, 507 bp, Triticum aestivum
  unsure (1)..(507): unsure at all n locations
  Clone ID: PAT_TA_102634
agtaagcacctttgttgctttgacaatggatgttgcatcagggttcccctcgtcggtatttctttgagatcatgagccattttgcaacagctgaacatgaaaaggaaagggcttcagtattttgcttctcctgaaggtagagatgacctctaccagtacaatcaaaaggagagtcggactgttctagaagtaagttatgtcttaactggagattttctatatgtctttcttgcaatacaaaaaattagtgtgtgcaagttatatcatttatatgacaataggccattgtctttggaatttttttcatggttgaacagtgagatatgngttttgtgctacttttaggtattggagggattttccctcggtgcacatgccttttgaatggctggtgcaactaactcctccattgaagaaacgggccttttccatatcatcatcgccattagtacatccaaatcagatacacttgactgttagtattgtatcatggcttactcctttcaa

SEQ ID NO: 102635 - DNA, 535 bp, Triticum aestivum
  Clone ID: PAT_TA_102635
agccgcctcctgcacgcttctcctccgctccccgccccgcctcgagcagctcaggaacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccaacacgctcacgatcgtcgacagcggcattggcatgaccaagtcggacctcgtcaacaacctcgggaccatcgccaggtcggggaccaaggagttcatggaggccctcgccgccggcgccgacgtgtccatgattgggcagtttggtggtcggtttctactccgcctacctcgtcgccgagaggggttgtcgtcaccaccaagcacaacgacgacgagcagtacgtgtgggggagtcccaggccg

SEQ ID NO: 102636 - DNA, 271 bp, Triticum aestivum
  Clone ID: PAT_TA_102636
agattcgacggatctctctcctccccccgtcgaccctccccgcgctcgatgcggcacctcctctgatccgatcggcggttaggtcggccgattcgtgatcttatttttctgttgccgtgatcgtgttcagtctgcttggttctggtggatcggggctgttcgatctcaatcatcaccccgtcggtgtccggtagatgcggtcggtcttttgacggtgtgatttgaggaatctgccgcgtttgaccggcttcggtcggctcagctttgtttc

SEQ ID NO: 102637 - DNA, 486 bp, Triticum aestivum
  Clone ID: PAT_TA_102637
agggacgtcgccaacgcgcggttcgcgctgctgtccgagtcgtgcatccccatcctcggcttccccgccctgtacgcctacctcaccggatccaacaccagcttcgtcgacagcttcgaccgccgggacgggcgcgcgcggcaccgggaattcttcgccgagcgcaacatcagcctggcgcagtggcgcaagggcgcacagtggttcgagatggaccgcgcgttcgctctcgaggtcgtctccgacgagacctactacggcgccggtgttccggaacggcaagcaacggcgtccgcaacctggaggagcactatcccatgacgctggcgagcgtgctcggctggggcgcccggaactccaaccggaccgtcacctactctgactggcggcacccggtggggcagcaccccaagagccacaacggcagcgagatcacggaggagctcttcgaggagatgaggcggggctacggcgactgctactaca

SEQ ID NO: 102638 - DNA, 558 bp, Triticum aestivum
  Clone ID: PAT_TA_102638
agactagttcgagttttttttttttttttttcatatgaaagtgcgataatttgatagaaaacttcccaattattacagtccatgcatgcttaaatagatcaaagctcgggagcaggttaccccacaatatgtgaatgcaaatttacatgcatggtcatcacttctttcctgttcatgtactcatttcacgatccatccttgtacatatccacgaacgggtcatgattgtgccatttaggggtcttttctgtcataacagatgtctgagatggccccgctgctttatgactgtctagctctgcaggagtcggctgcggtttgtgcttctccatggtgatggtgatgcccacagcggcgcaggtctccccgcacagcatctgcctcgtcttggcgaaattggccccgtccccgacctggacatcgtacagcaggtcgacggctttgtcaagcaccacctgccggttgccgtccgcgccgtgcgtggaccaccacgttccggcgagctccttgccggtgcacgtttgcgacctgagcatcagcagcttccgcagccgcgcg

SEQ ID NO: 102639 - DNA, 580 bp, Triticum aestivum
  Clone ID: PAT_TA_102639
agctcaatacactttgcagatgcagatctgcatccagtccgatcgtcgcagtccgtgggcggagtgtaccctatgcgctcgcgtacgaaatcgcacgcgaatcggacatcagttgatgcaaagatcagcgaactggaagacgcggaagacgaagatgcaggtctgcgcgatgagcgcgattttaaacgcagccaggtcttcagtctgacacagatcctcgtccttgcataccaatctaccggtgtcatctatggcgacattggaacatcaccgctctacgtttattcttcgactttcacagaggctcctagccgcatcaatctgctcggtgctctttcgctcatactatggtctgttacattgatggtcaccgtcaagtacgtcttgatcatcctccgcgccgacaacgatggagagggtggtacattcagcacatactctcttctgtccaaatacgcaaacatcgcgaacagagatccacgcgaagccaccctgatacggatggagagacacaataccgatactctgggccgatccacaaggaacattcgctcaaccatcgaaaagtccaagttctttc

SEQ ID NO: 102640 - DNA, 468 bp, Triticum aestivum
  Clone ID: PAT_TA_102640
agaagtgaagcatcatgaagagatcaaatgcttgaagcttgccgtccattgtggtgacaatggacttgtgaagatgttgcggtgtgcaagttcaagtgaagcatcatgaagagatcaaatgcttgaagcttgccgtccattgtggtgacaatggacttgtgaagatgtgcggaagagtggctcacccatagtggagtatgggggagcaatcaactagtcttcatcgagccaacgcaaccaagaaaggtggtccaacttgagggagtcaagatcgtcatcatctagctcaagtggaccatgtgcaaggcaaaggtttgcccttgacaggttttctatgttaccggtctcatgatggtagttgggagaccgggttataggatcgattgccgtactatcaatggggggctctcgatgagtagcttgatcgtatcgttatagagagctcaaaccattgcatccttgcgtcat

SEQ ID NO: 102641 - DNA, 542 bp, Triticum aestivum
  Clone ID: PAT_TA_102641
agtctcgtctcccccatcctgccggcattgacctatcctagtatccatcaatggggaggccaccttctagtgatgagaatggcctcaagaagggcccctggactactgaagaagacgagaagctcatgagctacatccagaagcatggccatggaagctggagatccctacctcaacttgctggcctgaacaggtgtggtaagagctgcaggctaagatggaccaactacctgaagccagacatcaagagagggaagttctcccaggaggaagagcaaaccatcctccagctgcataccgtccttggcaacaagtggtcggctattgcgaagcatctccctggacggacagacaacgagatcaagaacttctggaacacccacctcaggaagaagctcatcaagatgggcatcgatccgatgacccaccgtccgagaacagacttctttgctgctctcccgcagctcattgcactcgccaaccttcggcagttcatcaatcagcaacccatgggatgaccacaccgccgggctgcaagctca

SEQ ID NO: 102642 - DNA, 211 bp, Triticum aestivum
  Clone ID: PAT_TA_102642
ttttcctcctccacctcaaccggcatcacctcggacgcgcggcggcgtgcagccatggcgatggtggcacaggcgggcttcggcctcacccgcgtcgtcatgctcgtcggcgcgggcgtggccggctccgtcgtcctacgaaacggccgcctctcggagatcctcaccgagatacaggagtttctggagaagggggagatgggtaagggag

SEQ ID NO: 102643 - DNA, 553 bp, Triticum aestivum
  Clone ID: PAT_TA_102643
ccaaccccgcgcagcgcgtctcccatgtcggccagtggctggacatagtctcggaggcgcacgcggacccggacctgctccgccacctcggcctcaaggacaccgtcgagcgtatcaggcaggcctggactgtaggagccaaattctatggtattcccgaatcatttgtcagggtatgtgttgctgcctgccctgtttgtaaggctgcacctgctggacagcccgattctgctatctcgtcgccaggacgaggtaagcggcgccgcaggtttgaatatacagagacgctggatgtgcctgcacgagacgtgccacgccggctacagcagttggctgccaagcacaaggtggtcctctgtattaggcagaagtatataaggtataagccattcatggccgaggtgaaggattatgcatgccatcgtgctggagtgccaacttcaagtagtggaaatactgtgtcctcttcagccagcgcctctgaggcgaagaagccacgggggctgaagcgggagccataccaatccaagaggtgtggctgtgggttccgtat

SEQ ID NO: 102644 - DNA, 241 bp, Triticum aestivum
  Clone ID: PAT_TA_102644
tggattccggaatggatatatcaacaggctgttcaatatggttttttgccaagcaatatccataattcgggagttccagaatcaacttcactaaccacatgtgatctgccatctggtgcatttggctttacacgattaacgaatctgtccccaattgaagcttccttcctggccacgtcttcattatttgagagactactgttttcaacgacacgttgcaagatggagtatgttgatgaaa

SEQ ID NO: 102645 - DNA, 541 bp, Triticum aestivum
  Clone ID: PAT_TA_102645
ccctctcggcgatcgacgcagtttgttgttggtgactcgcctgcgctctctatcccactcccctgctgcctccgcgccccgctcgacctcccgtcgccccccgcaccaaccctggccccaatttcccccctccctccgattttttgttcgtctgattcggtagccctttgaaaaggcacaagcctaatgttgatgtcatgtatgacagaagaccttccatggctagcttcaattttgattgcgaatcaaaggatgctcgtcctgttaccaaggcggatcagaatatcggttcagctaatgttgactttgaatttcacccaactagaaacaacctttcacctattgttccagtgaggctatcccggcattttatagatgaggtcgaccaagttcagtgttcgcaatatgtgtctgaaaggcttcttaactctcatgtgtctccttttgaacaggactgtgtttaactggtgacgattcctcattccaacatttcaaagtcagttcaggcatcccaatcaaatcatgttgatctcagctctcc

SEQ ID NO: 102646 - DNA, 669 bp, Triticum aestivum
  Clone ID: PAT_TA_102646
gcgagggccaagtatctgggacgccttcatcaagataccagggacgatcgccagcaacggcaccgccgatgtggcggtcgatgagtaccacaggtacaaggaggatgcggacataatgaagaacataggcttcgaggcgtaccggttttccatctcttggtcgaggattttcccagatgggactgggaaggtgaactgggaaggagtggattactacaacaggctcatagattacatgcttcagcaaggcatcactccatatgcaaacctctatcactatgacctcccactggcactccatcagcagtaccttggctggctaagcccaaacatagtgggcgcgtttgcagactatgccgatttctgtttcaaggtgttcggagacagggtgaagaattggtttaccttcaatgagccgaggtgcgtcgctgctttggggtatgacattggcctccatgcaccagggaggtgttctcagtgctctgcaggaggtgactccacgacagagccgtaccttgccgcgcaccatctcatactttcacatgctgcggcagtgcggcgataccgtgacaagtatcagcatcaccaaaaggggaggatttggaattctcttggattttgtgtggtacgaacctttgagcaacagtaatgctgatcaagctgcagcgc

SEQ ID NO: 102647 - DNA, 510 bp, Triticum aestivum
  Clone ID: PAT_TA_102647
tgcagcaaatcatctgcaacatgtcgcacctgagcatcctgaccttcaatacaatctagcgaagctccggttcaagccctcccggccggccggacggctgctgtccgccagggaccggcagcagtcggacctgatgatgtacaagcctgacgaggaggagatggccaaggtgttcgacaagatcgccggcgagcctggccggatctcgaggagcgacctccaggtgctcctgcagaggttcgagaaggcggacgccgcgggcgaggcgcggcgcatggtctgcgccgccgacagcaacaaggacgggtacatggacctggaggagttcatggaggtgcacaggaacggcgtccagctgggcgacatacgccgggccttcttcgtgttcgacagggacagggacggcaggatcaccgcggaggaggtgatggacgtcctgcgcaggctcggggacagctgcagccttgaggactgccggaggatggtgaaggagatcgacaggaaccatga

SEQ ID NO: 102648 - DNA, 274 bp, Triticum aestivum
  Clone ID: PAT_TA_102648
actctcgtcactccaggcaggaaagcaccacactgtcaagtacgcaatgccgcgtcaccttggccttcacggcgtgatcgccgccggcgcgtcgcgccacctcgccctgcaccacagcggcgtgatcgcggccgcggtgccggcggcggcggcgggggggggggtgtgcgcgctggcgctggcgctgtgcgcgtcgcactcgggggcgggggccgccgcgaccgagcggctgcggcgcgcgctggcgagcgtgagccgccggaggacggacccg

SEQ ID NO: 102649 - DNA, 721 bp, Triticum aestivum
  Clone ID: PAT_TA_102649
tgggtgctactgctttcttgtacatcctgctgtccctctgggttcagggcgcagctgccattcttggcttcacaagaagcgattttccccaggacttcgtatttggatctggaacctcagcatatcaatatgagggtgctgttgctgaggatggcaggaggccaagctattgggacactttcactcatgcaggtaaaatgccagaccaaagcataggagatgttactgcagatgggtaccataaatacaaggaggatatcaagctcatatctgagacaggtctagaggcctataggttctccatctcctggtcaaggctcattccaaatgggcgtggagctgtcaatccaaaagggttacaattctacaataacatcatagatgagcttgtgaaacatggtattcaaatacacatcacacttcaccatctagatctccctcaaattcttgaagacgagtatggtggatggttaagccccagaattatcgaagatttcacggcatatgcggatgtttgcttcagggagtttggaggcagagtcacttactggactacagtgaacgagccaaacattggtgcagttgccgcttacggcagtggtcaattaccacctggtcgatgctcagatccatttggaataacaaagtgcacagctgggaactccagcactgaaccatacatagcagttcatacttacttattggcgcatgcatcagttgc

SEQ ID NO: 102650 - DNA, 501 bp, Triticum aestivum
  Clone ID: PAT_TA_102650
gaaagtacaagttgagatacctaaatcaaaattaaaaaataaaaatagaacgacaaagaggaacatccgagcgagggaagaaaattacagaaactgaccgagctcccaaaaacagagctaggtgttgttggtgtggctgtggacgatattctggattgcttgcaatgccttcatagcattttcgaggtagatgtcgagggggccggcaaaggcagcgagtgggtttgcagcgatctcatgcttgacgtcttcgtcggcggagggcaccagcgctttgggggcgttctcgatctgcttggcctgctggaggtaggtgatcatgcgtggagtgtcgtaaaggctgacggctaccgtgtctccatgggctgcggcacgctgtgcgctgtgtgacgtctccgttccgaggacgtaggggcggccctgctccttgtagagctccatggactgcgtgagcttgatcagctgcagcaactcggcgcggagaacgctcaccatattctg

SEQ ID NO: 102651 - DNA, 544 bp, Triticum aestivum
  Clone ID: PAT_TA_102651
ttctgctacgtcgctgatatggtttgttttctactaccatcttactattgaatactatctggtcaaaactgtggatggtcaccttaccaatggtaccatttcaatgcaggtcaatggtcttatgaagctgatgaatggagacaacaccggacccattaacattgggaacccaggtaaacttcttttgcaaaaaaaatatattcttaggcaacgcgctaacaacttgatctgtaaatcatttataattctgcacttttattcctgtggtgatgaactggactttctttaaatgtaggtgaattcaccatgctggaacttgccgagaatgtgaaggaggtaagtgggatattctatactcattgactcattccatccaacctttttgtttcaagtagcagtgctccattcagcttcaatgcatggcaattctggatggtataataacatgtgtgattttacttgcagttgatcaacccagaagtgacagtgacgatgactgagaacactcctgatgaccctcgccagaggaagcctgacatcacca

SEQ ID NO: 102652 - DNA, 453 bp, Triticum aestivum
  Clone ID: PAT_TA_102652
ctggcttcgccgctgctgtactgtacatttggttatttgattttcctaattggtgggtggggtgccagttacttctggcatggagattgtgcacaagttaaaattcagcttagcgggcaatgtaaactaaaatttagttgcaaaatataattttacgcaatcttctaaaagcaacatgcgctcttatctagatagctgatccaacatgtggggggatgcttttctgcattgggtcagtgtgaaaagtttcttgactccacaaccatctttccgttctgttgaaagacgagaggagtatgccatgcttaatgtgaatcagcatgagcgaattgttttcctaatcacgtattttccttgtggtaattgtgtaattgaaatgccatgcttaatgcgaatcagcatgagcgaattgttttcctaattgtgtattttccttgttataattttttaact

SEQ ID NO: 102653 - DNA, 483 bp, Triticum aestivum
  unsure (1)..(483): unsure at all n locations
  Clone ID: PAT_TA_102653
gggcaaccaggaatccgcgaccgccgcccttcgaatcgccgcgagatgatgacctcccggcgggccagcagcggcagcaccagcagcagctgcgcgctctgcgagggatccaacctcccctcctgctgcgccgcgtgcgtgggggggggggtgttcgagtaccacgcgacgctgcgcctgaggaggaacctccgcgacaccctccagtctcgcatcgccgcgcgcctcgaggccaagaggaaagcggaggagcagaggatgtggaaactgagcaaagctcacgacatcaaggagctgagggatcggctcancgagttaaagagtcgaactgcgttagagaagatgaagatcaagcaggcatcgagtgatctcaaggtgaaaagtggtacattgaatgtggcctttatcacgctaaaaacgaagcaaaccgattcatcaacgatgcacaccaatgccatgaaagcagcacagatgggtcttatg

SEQ ID NO: 102654 - DNA, 385 bp, Triticum aestivum
  unsure (1)..(385): unsure at all n locations
  Clone ID: PAT_TA_102654
acacctgaggactgtgcagctctgctatcaagtgcgcgatgggacctcctcccacgagaacgagatgagcaggtcggagtcggcgccgggggcagcaccggccgtggtggtgaagacggtggacctgcaaacggcggcgacaccggacgtgggggcgacgacggtggacgtgcagacgacggtggcaccggacgtgggggtgacgacngtggacgtgcaaatggcggcggcacgggccgtggcggtgacgacggtggacgtgcagacggcggcgagggagctccaggagcagcaggacggcatgatgtacctggacgtgaggacggaggaggagatgggggaaaggccacatccgcggctccctcaacgtcccctacttcttcgt

SEQ ID NO: 102655 - DNA, 623 bp, Triticum aestivum
  unsure (1)..(623): unsure at all n locations
  Clone ID: PAT_TA_102655
attgccaccgtcatcgccgtgtactgcaacttgccatttgcgcacatccgaggcatcggctggggctgggccggcgtgatctggctctacagcatcatcaccttcatccccttggacctcttcaagttcgccatcggctacgcgctcagcggcaaggcatgggacaccctcttcgagaacaagatcgccttcacgaacaagaaggactacgggaaggagaagcgggagctgcagtgggcgacggcgcagcggacgctgcacggcctgccgacggcggacccggccagcacgccgcaggagaggagcaactacggcgagctctcggagatggccgagcaggccaagcgccgggcggagatggcgaggctgcgcgagctcagcacgctcaagggagggtggagtcngcggtgaggctcaagggcctcgacatggagaccgtcgacaaccaccactacactgtatgatggagatcgaaccgggacggcagcggcggtcgttcgcctcgtactcgttgcacatttttatgagccgtgccgagggaacatggccctgcctagaattttcgttttggtcgtcggatacatatgtttttagtggtctgaatttatgttctcatcaattgt

SEQ ID NO: 102656 - DNA, 642 bp, Triticum aestivum
  Clone ID: PAT_TA_102656
ttgctgatatttggctgccttgggacagcgtgcaaatggggaggttgatgaggagatgatgcggagtgggaaggttccagagtttatatatgaagaggacgatgagcaagatgatgacgagttcatagtggattgggatacaaatgaattggatgatgttattgatgatattgttacaagcaggactaaagtgttgggtggtacaacaatgtctgcatttgccgaagaggacattgttgatggtatattggggcttcgacataaggaggatgacatgctttggagtagcgacgacgaggacgaggatggttatctgtgagatttacacggattggcaggttcataccaatattcttctgaatgttaggaccaacatatggccaagtagttaagtcattatcatcgattcagtcacactgctcaatttcacgaacttggcaatatggcaattctcagacttgctatgcggcaagttttgtgaggcgctacgagggaagtctccatactgcaatgatcaactgatcaacaagacaataccactggcttgtgttcttgaattcttgtcatctctacgtgcactacttcacgatccaaagcttgattgctttcctcagtgccgctctgcacacaagtaaccagtaa

SEQ ID NO: 102657 - DNA, 578 bp, Triticum aestivum
  Clone ID: PAT_TA_102657
tatggtgttacagaaaaaatttcatgcacttgaagacagttgtgtttcaggagatgccagaacttgtggaatgggtcggggaacctaatagccaattgttttcaaggcttgaaagcattagctttggagattgtcctcttctctgctcatttcccttcttggagtgctctggccgttttagcaacctgtgtgcacttgttattcatagctgccctgagctgtctcagttaccccctatgcctcacacctccgcactaacacatatgagtgtgaggaatgctgggtcattcctatcgtacgacggaaataaattcactattgaagggtgtaatggcgctctggccttccacaatatggataaagtacaagttatgcaaattgggaatgtatcacatatttcgctgtcagacctccgaaacctgaactccctgagaaatctggatgtcaaaaaatgcgaaagcatgttttcttcagaactggatgacagtgtatccctccattcagttcagtttcttgacctaaaagaattatgtattacaggagatgtgttttcaaagctattgaagtgttttccatct

SEQ ID NO: 102658 - DNA, 393 bp, Triticum aestivum
  Clone ID: PAT_TA_102658
acacatggaaggggataagttccaggaagagatcgaatgcctcatggaggtgaagcacaaaaacgtcgcacggtttctaggatattgtgccgacacgcaaggagagaggtagactttgagggaagctttgtaatggcagatgtgcgacgacagttcctctgttttaagtatcgacacaaagatacacacagtggagttgaatggagagagcactatgaaataatcaaggaaattgcaagggtttatggtaccttcaccgtaatcatattattcacttggacctaaaacctgataatatattgttggatgataatatggtaccgaaaatagctgactttggtctctcaaagtactttcgtgccggattatcatttcaaaatttggatgaacatc

SEQ ID NO: 102659 - DNA, 330 bp, Triticum aestivum
  Clone ID: PAT_TA_102659
tttttttttttttttgtttttttttttttttttttttttttttttttgggggggaggggaagccccttttttttttaacaaaaaaaccgtgccctaaaaaaaccaactttccaattcaaatcattttcttaccacaaatggggttaccccaaaccaccaaaatcaaatgaaatgaccccttttggtttacaaaatgcttaattcaaaaaggggcccataaataggcccctggaggggtttttaactccttccgagggtttttttttctggaaaaatacccccaaaacccggacccccacccccatggtttccggttccaacacttaaatc

SEQ ID NO: 102660 - DNA, 441 bp, Triticum aestivum
  Clone ID: PAT_TA_102660
acatcttggtcctggagattctcttcatttgatggataaggtagatgctgttgattccccatgcttaatgctgggtgaaaaatgcatgcatgattccttaaataacagagcaaatggctttcctaaaacaaaccttgcagtggtgaatgctaatgttgattatcagtatccctctgtaacaactcaagatagtgatactgatagtgccgcatcctctgttggtagttgcaatccctacggtagcccctatagacaagcacatcctcaggagtacgacagtggagatatttgtagtaggactgatgatgatgatgaagcttctgtatctggaactgaatcacctcttccaattaaaggtggtctgggggaagaaacccatctgcttgagttgcatgcttatcgtgcaacaatgatggcactatatgcttatggatcaattag

SEQ ID NO: 102661 - DNA, 527 bp, Triticum aestivum
  Clone ID: PAT_TA_102661
tgaagactacggctttgcaggaaaataggattttgaacaaaggataaaggaagtggagctaaagctagaagattctactaagagaggaagatatcttgaagaattgttggaatcaagaatcaaaacctgggagcgaaaggaaatcatgctgaaccaatttgtaggtgtacaaatgcagaatattcaggatttgaggttgtcttctgtttccattaggcatgaaatccaaaactgccagaagagatggtctgaagaacttagtggccttgggaaaagccttaaaatattagcgaatgcttcagagaagtatcacgctactcttgaagaaaacagaaaattgttcaacgaggttcaggagctaaaaggaaatatcagagtcttttgccggataagaccttttcttccaaacgaggatcataagtctagtacaactgaaattactggtgataacggtgaactcattttagcaaaccctacaaaaattggaaaagaggggaataagttgtttaaatttaacaaagttcttg

SEQ ID NO: 102662 - DNA, 250 bp, Triticum aestivum
  Clone ID: PAT_TA_102662
ccactgccctgctactttgatgactactgactcctgacaccagatggcaccacaatttctgaatacttctgctcctcagtctttccatggcaaagtgcgatcggcccttgatataaagatcttcattgtgtatagcaacacaattacagctcgttaatgttaataatatatgcgcaagacagggagttccgggaagaaaaaaaaaaaaaaaaaaaaaaaaaaaaaaaaaaaaaaaaaaaaaaaaaaaaaa

SEQ ID NO: 102663 - DNA, 523 bp, Triticum aestivum
  Clone ID: PAT_TA_102663
cagctctgcacagataagtttgaagcggcatcctgcatccatcgatagatatcgacatggcgccggctcccgctcgagctattgcagtggtgctgctcacgttcgtctgctgtgggtgcgccatggccgcggaccaagcaccggtcaaatggctgagggcgcacgcgaccttctacggcggcgccgatgcctctgacgctatgggtggagcatgcgggtacggtaatctgtactcggcggggtacggtacgcggacggcggcgctgagccgggtgctgttcaacgacggtgcggcatgtgaacagtgctacaagatcacatgcgaccgcaagctggcagatccgatgtggtgcagaccaggcgtctcggtgacggtgaccgtcacgaacttctgcccgcctaacaacgcgcttccgagcgacaacggcggctggtgcaacccgccgaggccacactttgacatggcgcaaccggcctgggagaagatcggcgtttacaagggcggcatcatccccgtcatgta

SEQ ID NO: 102664 - DNA, 639 bp, Triticum aestivum
  Clone ID: PAT_TA_102664
tacgacaccaccgacctcttcttcggcgagaactggctctacgacgacctcctgttccaccgcgagccggagatcagcggtaagagcggcgacggcgacggcgacgaggaggacaagttcattgttgaccccgacgtcggcgagattggcgacgacagcagccgacgccacgagcgcagcaagagcaatgcagaggcgtatacgtcaccgccctgcagttgttgccacggcgaaatggagcacaagaatggtcgggagtttgcgagggattcttggtctgctgtgtacgggaggtatcagatcatggacgacctgacggaggtgcttgatgagtgcggtgcagacgcgcaccagttcaggcgcaatgtgaatgacgatgccacactcaagggcggtccgttagtggattccaggagtggagatgaccaggagtttgatctcagtgcgctggagaaggagcttcaggtgctcagtccgtacttgtctgaagacgcaaatgctgctaacaaccataggtttaaccatgacttcagagtaaacgatgaactaaatattgaccttattacagatgacaaaattgtcgatgacaaggaatttctaaaggatagttacagcgtgcacccttttcctgagattagt

SEQ ID NO: 102665 - DNA, 569 bp, Triticum aestivum
  Clone ID: PAT_TA_102665
cggcgacgtaccgcacgacacgcagctcctgctggtggagtccaaggccgggttcaggcctgcgacgaggtcgtgttcctcacgctgcgttctgggccagcctcagggcggcggcgctggcggcgacgagcttcagctctgcatctagagcggcgacatcgacacgcgcgccagttcagttcagtgttaatctcggtcaccgatggttgaggtgttgtgttgtttctcgctctaggtaggccctcgtcgatcttgcctttagcattgaggtgggaaaaattagcatcacgttttcttgattccctactgtttgatgaaatgcttgtgccctgatggattatgttttcttttgtatttcttctcctccctgctgcttgcatgctttgcatttctttgtttctcctacttgctcggttcatgttgttgattgtctccgcatgtacttacggcgttcttctcagtctagatctgtgtatcagaggtgttcttatatggtgtgctcccatttggggttggagatggcatgagatgcagagctccttgcgccactctctttacaaagactatac

SEQ ID NO: 102666 - DNA, 624 bp, Triticum aestivum
  Clone ID: PAT_TA_102666
cctactgtgccaggaccggcgccgcggcgccacggcacctgcggcttcgaccccgccaccagggacttcgtctgcatctgcgacggcggccggaactccaccacggactgtgcagatggccgcgtgacagggcatggagcatcagccggagtggtagctgcaaccgtcgtgttctcaatttcggcagctatcggcatcggggggctcgtgatgtacatacgcaagctgagatcgagcaaagtggtcacctgcggcgtccagagtaacgaaaatagattcttctgagccgacctcagagaactcccatgaacagtcttccgcgtgtgcaaagaagaaaggagggtatggacccacgtcagatggagagggttccggtgtatacaacacgaagccttgagatattttttcttgtagttttgggcgatatgtattatgcatatgatgggcatgcagaccgtactacatttcaaacataacgagggcggcatactcaggtgaacaaaagatatgtgcgagtgcattgccgccgaatttacatgttgtggtagcttgtaaccagcaaggcgtctgtggtgactttgttaattaattttttagcacgacaacttcattctaaaaaaaaaa

SEQ ID NO: 102667 - DNA, 493 bp, Triticum aestivum
  Clone ID: PAT_TA_102667
tcccgcaacaattgtggaaataataacttgaggtccacacactgggaggcgatctagatgacaaccttcgcagggagctttggcatgttgcttccaatagaatgggccttgtcattccggcacaccttcgcagggacatttatggggtgcatgtctcgccgatgtctgatgagggatttctatttattgccaaatgcatcaagagcgctggccccaatcttggtgcaaccttggacagtctttgtgcaacatcttccactttgcagtcactaatctcactcctcggaatctccaaatattgagagattgtgcactttcaaaaataaacatggttgggtcagtatggtttaacaaaatattatggatagggtcatcggtagacaaagtattatataaatgatgcatcacccttgttatagtagggccgataattggaatgttacaaagatatttttgaatggacgcaccatgctcaattaaatgatattaacca

SEQ ID NO: 102668 - DNA, 624 bp, Triticum aestivum
  Clone ID: PAT_TA_102668
tttttttttttttttttttcaaatcagaggccatcacgcaccttcatggcataacttggtagtacattctttgggacaggaaatagagtgacatgcccaaatcaaatgtcaaagaattcttggcaaacgatatcacaacaatacatactctttccaaacatgatctctaccctatccaggctgtatgcgcagaaacagttctgcgaaaaggcagagccgtgcacaatcaacaccagcagaaccctttcatatagcgatggcccgtgcatataatcaaatctcttgcttgactgctgctgcttggtagcttcccatggtgattttttttcccgatcaaagaaggccacatggcccccatggagtcttgaaacaagtagcaaaccataacagaaagcctaccaacaatgcttcccaaggtgatggtgttgcacaccgacagctcactaatctctgcggatggtatacttccacgtctagggcttcagtaaactaggcccttcaagatgagcatctagacatttcttctggatgctactgctgctcatacgctgctgcaggcatgtaggggagtctcttcatactaggacagtttccaatgtaaagaacatgcttgtgacccatctt

SEQ ID NO: 102669 - DNA, 597 bp, Triticum aestivum
  Clone ID: PAT_TA_102669
cattgccggtccttctccacgcgccaccgcctcccttacgaggacaccccgccatgggtctcagttggcgccacgacggccatggcctccccacccgccgatgctccagatccagccatcgttgacctcctctacatcagttatccgtcaaggtagggggcgtggctctatttatcttcccgcgtgcaccgtgtccgtgtatcctagggcaagggtgcttgtgagatcgggagatgatcaaaaggaggaagaggagatccatggttggggatacatccaacgacctaggcatcatcctgacgtcgtactcgaagcccgcatccactgcctcctcaatctatgttagtctgcagcagcaaggagatagaaaggagggtcagcatgaatggaacgtatccccttccagaggactcgccctaactagcctgcacggtaccctttcattagcacttctcccagtctttttgcaaaatttgaattcaccacttttgaatcatgcttcgtgtgcgctgacgggcgcgcgaggaatgtgatggtttttctctgaatcatgtcatagttctctcaatattgaacgtgttgttctctgaatcatgt

SEQ ID NO: 102670 - DNA, 637 bp, Triticum aestivum
  Clone ID: PAT_TA_102670
aactcatataacttgggcgcgcaatcgatggttgagattcacttttggatgatgggagttctctttgagcctcattattcatacccaagaatcgtgctaacaaaactgtttacacttgtctcagtttttgacgatttctatgacaattatagcaccacagaagaaagcaacatgttcactaaagcaataaacaggtgggatgagcatgcagttgagcaagccccagcatacatgaggtctttctacaagggtacaattgcttccataaatcagattgaagaggaactgaaacttcagaaaaacaaacatgctgaattggtgaaaaaactgtttattgatgcggcaaactgctaccatgctgaggtgaaatggcgtgaccagaagtacgttccagcaaacctcgaagagcacctaaaaatctctgcgcctagcactatatgtatgcaaataccaaacattgcattcatattaatgggagatgtcacatcaagtgagactatacaatgggcttgggcatacccaccaatcatcaaagccgtttgcatcattgcccgtgttatgaatgacattgtgtcccatgagcgggaacaagcttcgcagcatatggtatccaccgtgcagacctgcatgaatgaaa

SEQ ID NO: 102671 - DNA, 645 bp, Triticum aestivum
  Clone ID: PAT_TA_102671
gtcatatttgagaaatgaatttgatcctgctgcttataaaacccttaaagaaaagctagatgagaccaactctgagatttcatcaatgcagaaaaagatcgaagatgcccgtgctctagatttagaaactgttgctgctatcaccacagaattggatgatgcgaaggaaatgttgcagaaagtagctgaagaggaaagcacacttcagaacttagtagaatcactgaagctggagttagcagctgcaaagcaggaccacagtcaactcaaagagaaggatacagatactgaatccattgttgcagatctacatgtcaagcttcagaaatgcaaatctgagcttgaggtagctgtttgtgctgaatcagaagctgcaacagcttctgatgacttgatgctagctcttcaacagctgtcgtgtgagtctaaaactgccctgcaagaagctgaaatgatgcagaagagtgcagcagagttaagaattgaagctgaagcagcacgtgttgcgttaacagaagcggaggaacggttgcaatcagctttgaaagaagcagaagaagcaaaagcagctgaagcgaaggcccttgatcagattaagcaactatcagacagagcaagtgctgttcaagcttcaacttctgaacc

SEQ ID NO: 102672 - DNA, 417 bp, Triticum aestivum
  Clone ID: PAT_TA_102672
acatcggtgtggaagggattcagattaggactgaagacaagggtggatcagcaaccaagacgcaggggctgacctactatgaatatggattgaatgcaatcttcaacgggttggatcagctttgcacccggttggatcagatgggacatcttagttacaattctcaattgttctccgagctgttcaaggagtcggtcaacatgaccaaaatcaggttaagagccagaatcaaattggatgaggtagatgagacgccaccaataatttccaatgatactctggaggcagccaacgggaagagcgaggtgtcgccgaaaatttccacttccacagagataaaattggagatagaggaaaccaaggagatgggagttaaagcaaaagaaaagctcaagaaggccatgatgcacaataaac

SEQ ID NO: 102673 - DNA, 709 bp, Triticum aestivum
  Clone ID: PAT_TA_102673
cccattttccttcggtatgtttgttgcttcttctttgtcttcgattcgattcgtttctccggggttgaaatgaggataaatccatccataaccaaatctctgcatctacagatgatgagaaacaacatgcactaccatctgatctcacctgggattcttctccccattttcctccgctcttttgttgctttgtctttctgtttcgaggcggttctccgggggattgaaatgaggataaaccaatccataaccaaatctctgcatctacagatgatgagaaacaacatgcactaccatctgatctcaccccttccgcctccttctctgttttcttgatttccttttgtttcttttctcaagtttttcgattggttgcaatcggtgatgtaatcgtttaattatgctgagttcctctgtgattatctcaacaacaatcaccatctttcgactgagattgtatctattttcttgtcctccgatctagttttggaaaatccccatctttctttgatttgcttacctaagatctgtgatttgattgttacggtaggacgaatgccatgaggtatctgatgcttggtctctatcaatggccttgtttctcgttagattggcagagagcgagaaggaaacgggtttttgcgacactggctgctcccgtaccaggagcttcctgttactatacccccgtttacattcactcattttt

SEQ ID NO: 102674 - DNA, 516 bp, Triticum aestivum
  Clone ID: PAT_TA_102674
gagaacctgcggagtgccatgagccaccctcaggctcttgcgcagtgtgagcaaacactgacgcagctaggaattgaacacagagaagctgtcgatgatacagcgggtgcagccaagcaaattgcagaagaaaatctccaagacactgctgctgttgccagttcattggctgctcaactttatggactggacattcttgcagaaaatatccaggatgacgcagataatgtaacccgtttcatgatgctggctcgggaacccattatccctcgcacagataagccattcaagactagcatagtattctctttggaagaaggacctggacaactcttcaaggcgcttgctgtctttgctctgagaaaaattaacctcaccaagatggaaagccgtccacacaagaaaaagcctctacgtgtagctgatgataattccaccccgctgaagcactttgactaccttttctacgtagatttcgaggcatcaatggctgatccgaatgcacaaaatgctctg

SEQ ID NO: 102675 - DNA, 422 bp, Triticum aestivum
  Clone ID: PAT_TA_102675
tcgtggacttgcgcgcgccgggggcccaacctttcaggggactcatagtgccggtactagaggagtggtcgaaatccaacgtctccgacgcctttccattcctcgcaccaattgaccacctcctcggctcgcgccgccgcatctccatacatctcgccaaactgttcaacttctttgaccaagagatcgtgcaacgccggttagctagaactagcactaacaccggtagtgagaagaacaatgacatgttggacattctcctcgcgcgccaagccatgtccaagctcacgcgccaagaaatcatcacgttcctaacagatatgttcatcgccgcaagtgacacgagcacggttactgtgcagtgggctatggcgcagctactgcgccacccggagaagatggagaaggtgcgacacgagctc

SEQ ID NO: 102676 - DNA, 172 bp, Triticum aestivum
  Clone ID: PAT_TA_102676
ggcgccgagcgatccccctcctcctccccccgtcgcgtgatcatggccatggccgcctccagatcgctctgggcctcccgcgccgcctcctacctcaagatctccgccttccccagggccttgtccaccgtgctgaaggatctgacgtatgctgaaacccatgaatgggtga

SEQ ID NO: 102677 - DNA, 592 bp, Triticum aestivum
  Clone ID: PAT_TA_102677
ggtggccggcgtgtcctacgacccggtcaaggccagcagcgacgtcgccaggaccatcgccgtcctcaatggcctgggcatcatcgcgttcgctttcagggggcacaatcttgtgctcgagattcagggcacaatgccgtcgacgctgaagcatccttctcacgtgcccatgtggaagggcgtcaagttcgcctacctcgtcgtcgctctctgcctctaccccgtcgccatcggcggcttctgggcctacggcaaccagatacctcccaacgggatcctgagcgcgctctacaagttccacggccgcgacgtgtcccggctggtgatcggtctcgccaccctgctggtgatcgtgaactgcctgaccacgttccagatctacgccatgccggtgttcgacaacatggaggccgggtacgtgcacaagaagaaccggccgtgcccgtggtggctgcgcgcgggcttccgcgccttcttcggtgccatcaacctgctgatcgccgtcgcgctgcccttcctgtcggagctcgccggcctcctcggcgggatatcgctgccggtcaccctggcctacccgtgcttcatgtggctg

SEQ ID NO: 102678 - DNA, 381 bp, Triticum aestivum
  Clone ID: PAT_TA_102678
tggcatgatgacaccggtgcatgcgcgtgacacttcgggactgggctcccgggggcacaagcctctggggtaggcagccatatatgtctagaccggcaaggttaattacgtgcatgccatgcccgggaaggacaggaacacgaacaggacagaacacgacacgacggcgagctccacttgcctctacggccggccatgccgatgcctatgtccatgtctgcactgcagcttggtccagctcgctagctgggcacagtcacatacgtacatatgagggacatgcacccgatcgaccattgcatgtgactagctagctactccactgttaatagtccgtgtatgttgctgacgggttcaattggttggatggctttggtgtgc

SEQ ID NO: 102679 - DNA, 525 bp, Triticum aestivum
  Clone ID: PAT_TA_102679
ttcgccgtgccaccggggctcagccccaccgctctcctcggccccccttcgctcttctcccctacggcaaattttgaaatgtcccatcagcaagcgttagcccaagtaacagcacaagcagtccattctcagtatactgtaggcagtcaagcagattactcactccctttctcatcggcaacaacatcagctttgacatcacagttcatcaactcttctgcaaatgtgacatcaatgaaggagacagcaactctgccactgcatacagttaatgataaccttaagtcaaatgaggtttcacaaggattccaaacttcggccctcaccgtggataaacctgctgatgatgggtacaattggcgaaagtatggccagaaggcagttaagggtggagaatatccaaggagctactataaatgcacccaggcgagctgtccagttaagaagaaagtggagcactcagcatatggacagattactcaaataatttatagaggccagcataaccaccagcgtccaccaaaa

SEQ ID NO: 102680 - DNA, 453 bp, Triticum aestivum
  Clone ID: PAT_TA_102680
ctccatccaatcccagcaacctcgaagatgtcttgctgcggaggaagctgcggcagcgcctgcaagtgcggcaacggctgcggcggctgcaacatgtaccccgaggtcgaggccgccggcgccaccctcctcgtcgccgccaccgccacccacaaggcgagctccggcgggatggagatggcggcggagaatggcggctgcggctgcacccagtgcaagtgcggcaccagctgcggctgctcctgctgcagctgctagatcattgatcatcgatcatgcatgcaccgcgcgcatgcatcatatctatgatcgatccatccatccatctagtaccatgtaacgctacctgatcgagggtctttgtatgtatgtaagcacctgccagcatgagcagagcaggtgcactcccatgcatgtaaaccgacccctaaataaaatctcccgtggtttaac

SEQ ID NO: 102681 - DNA, 525 bp, Triticum aestivum
  Clone ID: PAT_TA_102681
ctcctctcaatagctggatcagacctactatctgcctctcgctgaaccttgactcatcgctcctacaaagctgttcctcattccttcaactgtgttttctatccgctgttatattcaccggttgtttctcctatctccgatctagaagcagtttcatcgctcgtctatcatttattcaggctagtgccctcaccagaagaggaacagtcctacaattcgatgacggaagtggccttagctatagctggtttaagattggctgcattgccggtcttgaagaagctccatgctaatgcttcaacatatcttggagtggacatggcgcgtgagctccatgaactggagaccacaatcttgccgcagttttagctcttgattgaagcagcagacaagggaaaacacaggcccaagttggacaagtggcttcagaaactcaaagaagcattctatctggccgaagacttgctgaacgagcatgagtacaacctccttaagctccaagcaaaggggaaatattccttgtcg

SEQ ID NO: 102682 - DNA, 545 bp, Triticum aestivum
  Clone ID: PAT_TA_102682
accgtccgtccttcccctcccttcttcctcggcggttcctcctcacaccacacgcagctagaggagcgcgcgcgcgcacgctcgcacacacacgcggaggggccataggatagggcagtggagggaaggcggcaacagatgccggggccgggtagccagaacggacgggcgtcgccgcccaagtccgagaacatccacggcctcgtgcgcgctggcgacgtggcggccgtccagaggaagctgcaggagaaccccgccctcctcaacgacaagaatcctgtgatgtgccaaacaccacttcatgtcgcagctggatacaataatactgagatagtgaaattccttcttgattggcaagggcaaagtgcaaatagggttgaggtggaggcaaaaaacatgtacggagagacacccctgcatatggcagtaaaaaatagttcttatgaatcaacaaaattgctccttgaacgtggtgtacatacaggagccaaagcaaataatggcatgtcaccattgcatttaactgtctggcatgcacttcaaac

SEQ ID NO: 102683 - DNA, 580 bp, Triticum aestivum
  Clone ID: PAT_TA_102683
atattcttcgaaaagaacctcagcaagaatcatttatcaagctgttaactgcacctcatgagattccatctcctgatgaaatagaggtctacaaaatccttcagaagtgtctcgagttaagagattgttacctttttagagaagaggtcgctccatgggagaaggaggtcataaatgacccctgtacaccaaaacctaatcctaatccattcacttttgtgcctgaaccaaaatcagagcatgttttccaaatggtcgatggtgttgtccaagtctatgcggataaagaccgttcggaaaggatttatcctgttgctgatgctacaacctttttcaccgacttacattatgttctccggatgactgccgcggggaacacaagaactgtctgccataaccgattgaatcttctagaacataagttcaaatttcatctgatgttaaacgcggacagggagtttcttgcccaaaaaactgcaccacatcgtgatttttacaatgttaggaaggtcgacactcatgttcaccactcagcatgcatgaatcagaaacatttgctgagattcatcaagtccaaact

SEQ ID NO: 102684 - DNA, 380 bp, Triticum aestivum
  Clone ID: PAT_TA_102684
ggccgatccgggcggagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtgcgcgcccgtatccgcagcggcggcgacgctacgcacgtctcctgccgcctcctccgtggctcagttctctaggctgcgcaccaagtgcaggtttgccgcccccggtgtcagagaagattactcttctacgccaatcgatgtcgtagcagacgtgaaaacagaaaagattgtagtgttgggaggaagtggatttgttggttctgctatatgcagagctgcagtagc

SEQ ID NO: 102685 - DNA, 547 bp, Triticum aestivum
  Clone ID: PAT_TA_102685
tccgaccgacaaggcaggcccgatggtggcgatggagggacaggtggtaatgtcattcttgagtgctcaagatctgtctgggatttcagtaacttgcaacatcacacgaaagcagtccgaggaggcaatggactttctaagaaacagatagggacaagaggtcctgacaaggttgcacaagtaccagttggcacagtgattcatctagtccgaggggagcgaccgtctttcactttaaataaaccaaccagatctctagatccctgggatatcccagatgctgtggatgactctgcagacagttccaatcagaagaacaaggatggcattaatggaaatgaagctgaaagagaaagtagcaatcagcgggagaagcaaacataccctagtacatgctccaagactgggttttcgaacgctgaagatggtgatgcaaatagcattcaacatcaggtcgagtttgatgaaaatgatcagtttgatgacgacgatgaagaattttgggaggatgaagacgagacggaggaagaggctctagatgcagatg

SEQ ID NO: 102686 - DNA, 650 bp, Triticum aestivum
  Clone ID: PAT_TA_102686
gggcctaggccctggattttagggccagtcctgggtgggccgacagggccgggtctgagatggccaggactacctacaatgaagtcatagtcgcttgcttggggagaagtggtgaggatgacaaaatgtgcttcctcgacaaggttctctagcggtggtgtgtgtgtcgtatcttgtgggtgactgatcaacaggtcgcgacggttttcacccgtttttttgctaattaaccgggcaactatgttcttcttaattaatggattgagtcataaggttccccggtttcaaataaaaaaagtgtcccatgtgtgtaatttttttgagcttatgcgtgcttttaaaatttaagaaaaaaccttagtttggggccctatctgaagagaagtatactgcttaaaattttgctttcctaagtattatttttttttcacttggggctcaaatgtgttatctttctgataaacactcgtataaaaacatcaattggtattactagagttatcatgaaacatattcttataatgtataattatttttatgtgaggctacatgtctgtacataaattgatgttcaaagtttcatcttgaatattatacaagttaatgtctaataagacgacaacttttatcggagttaatactttgctgct

SEQ ID NO: 102687 - DNA, 609 bp, Triticum aestivum
  Clone ID: PAT_TA_102687
catccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgc

SEQ ID NO: 102688 - DNA, 635 bp, Triticum aestivum
  Clone ID: PAT_TA_102688
tccgttcggcgctcggtcatcggtgatttggatcacgacgagtacgactccatcaaccccgttcacttgaacgcttccgctcgcgatctacaagggttctgcgatctcttgtgttgctgcgtcccgatcttctgctttgtttcatctctgttctgtcatcgagaatgcgtccgcttatttcagtcgttatacatgttttggaggtcgtggtggcggcgtagtgcggtgtgctttatgacgctttcgtacctgtatgaggttgcagaggacgtgtctgtacttgctggggtagaattcaaattgtgagggatggttgtgcttagatttggtcgctgctggtcggttcttgagttcagcgcatgaaaacctgcaactgctatcaagcgaaccacaggagggagcagcaggcatagaagaaatcccaagccaattttgctcagctgtagcatcttccacggacaataagtctgcacagcagcctggtgaggctgatgttcttgcttaatataagccaacaatggagaaacggaccaagctatctttcatgatcggttacacaccaagcctatgtgtttgttgcttctacatgttgctatgatggtcattcagcccattttcttgaacctgcactacaa

SEQ ID NO: 102689 - DNA, 432 bp, Triticum aestivum
  Clone ID: PAT_TA_102689
atccagcacactgggcaagggtttgcttgcgtaacatggccaatattgcaaaggaggcaacaacagtgcggcgtattcttgatcctctgtttcgccttttcgatagccacaattactggtctcctgaaaatggtgttgccctttctgttctacaagaaatgcaaacactgatggacaaatcagggcaaaatggccatttgctgctatcttttactataaagcacattgatcataaaagtgttgccaagatgcccgccaagcaaatcagcattgtaaaagttgcttctcatcttgcaaagcaggcaaagtcgcatgcatcagtaacaatagcgagtgcaattagcgatttagtaaaacacttgcgaaaatgtatgtaccgtgctgttgaagcatcaaatgctcaagctgatattgacaagtggaacagtgaac

SEQ ID NO: 102690 - DNA, 469 bp, Triticum aestivum
  Clone ID: PAT_TA_102690
agtgggacgcgcagcttcagcagcgcggccgcgatggctcttccggcagtggcggaggcgcccccacaggaagcagaggtcgcggcagaggcggaggccgcgcccagagcggcggcggaaaccgcggttgcaagccaagccaggcagggcgaggcgatggcaacggtggcaagtgccgctactgcaacatgtcgggtcactggatccgggattgccgcaggaggaaagccgacgaggcagccgcggcaacgacaaacctcgtccaagctgacgtggacggcgggccggcaatgatgctggcaagagtcgagcccgtgcaggagagcacagcgtctctcgcgaccacagctccgacaaccacccattctgtgcaggaggcatggaacccgtccatgggaaccatcactccagtgacaggccacacctcgacaacgacgttctcggggcctgtcgactgggaggcgatgaa

SEQ ID NO: 102691 - DNA, 391 bp, Triticum aestivum
  Clone ID: PAT_TA_102691
tggcatgtggtgcctggctgaaattttgtctcagcgtttaaacaaaccacaatattgttgctacttggtataggatcatttgtcaaagccatagcataaggcaaggcaatcacatgtaccaaatgcagagcaaccatgaaggattttgtcaaccattcggctggaagttcatgaggaatggacatttatacttttcatatagataaagtcacatatgccgagagcaactgtcttgtcgcccatgaagctctctttttataattaaattttcaggaaaataccactgtatgattatatcggtttaactccagtccacattctttactttgtcaagtgcatgctatagttcacatagtaactccatttaggccatgttcgtttaatcccctcg

SEQ ID NO: 102692 - DNA, 478 bp, Triticum aestivum
  Clone ID: PAT_TA_102692
ggtctgttctgttggtgtcatgtttttttataactatgtaattaattacaaacatatatttagattagattatccttcttagattagatagcataattaatgggatgtaaatatttgatttcgcagccaggtttttcattagttttgttccaagaatagtacttttgtctttgatttctatgtataaaacagagaataaaaaacttcttgccgaggtgcacctgatcccagtttttctttggtacggtcagtgtttgtaccttctggttgtttccattgaatggttttcaaacatttattagggattcataggaagggctaaaaaccgcataagaatagccacttctgcttgaagaaaactccatggagttccgattcggagcttagcttgagcaactgttcatttcttggtttttcttaatttggaatgcaagtatgttgcctttttttacaagaattcttcacctattcaagcagc

SEQ ID NO: 102693 - DNA, 248 bp, Triticum aestivum
  Clone ID: PAT_TA_102693
agagagagagagagagagagagaggtattgcatctctaagattggaatcttgaaaacatttgaaactagggaaatataaatttcatttttgttgcatatatcattcattatgtgtgctgtttaatgttccctgtaatttcttttattcttattccatctttctcatttagctcctacaaatgtttccattttatgcagaagctgcgcaagcgctagaccaggctgttaatctttttctggaaattggt

SEQ ID NO: 102694 - DNA, 444 bp, Triticum aestivum
  Clone ID: PAT_TA_102694
attccacggaatatacaggtgatggatctctttgtaccagtggtcatcctgcttccagagaacatacagggaactggaaggcctcctccttaaccatagtctgttcattctgctgttatctggcctattcttcaattggaaaaaacctagtcagttatctcacaaaagtcttacatgaaacaaatttggatgctgcgagacatgttgcaacttggcaaggtactagctatctcgcacctctggttggagccttcgttgctgattcgtatctggggaagtaccggacagctttgatcagctgcacaattttcattatgggtatgatgttgttgcttctatcagcagcacttccaataatctcagccggtcctcgtgcttggactctttgggtagatcctatctcttctcggtacaatatattcttggttgggttgtacatggttg

SEQ ID NO: 102695 - DNA, 257 bp, Triticum aestivum
  Clone ID: PAT_TA_102695
ggtgataatgaaggggcgtcagtcagctgagctctgatgatgtagaagaggtctgtagattgtgtgggtagggaaaaaaggttagatgtttatagttttgagtttgagtttgagttctcgcctattgtgagagaacagctctgggtttcttcttttattttttatagagatttggcgagtgtcggatgaaatgtcatcatctgcccacgaaacataaaaaaaaaaaaaaaaaaaaaaaaaaaaaaaactaaaagggg

SEQ ID NO: 102696 - DNA, 143 bp, Triticum aestivum
  Clone ID: PAT_TA_102696
ggtgctaatacagtttggcgccttcattgtgctttgtggggcaactcacctgataaacttgtggactttcgccacttatagcaagactatagcggtggtaatgacagtggcgaaagctgcgacagcagtggtttcatgcataa

SEQ ID NO: 102697 - DNA, 535 bp, Triticum aestivum
  Clone ID: PAT_TA_102697
gagaccggccgtcagtcagacgtgtggtgcgtgcaatccaggaggaggctcgactatgggcgcgtgccggcgccaagggacttgcaactatcatcccggagacgtagattcaggtcacggtgggaggtgcacccacattttctcttcttgcgccacgtcagcccactcatgccatccatgtgcacatgcttgtaggctgcccattgctgtaattgttgcttcaacataactctgtaacttcactctttctatcaatgcaaagatacgcaaggcttttgcgtattcgcggaaaaaaacttcttttcctttctgtccatgagagtgttcattttctagcgaagtggttctgatttcgtcagtttccttccgttttgatgaactctgcagggggctcaacttggaaatgatcgggctgatccgcgtcgtcagcgtcaaccttgtcaccggggaggggatctgaagttctggactgacgcctgacgatagccactgttcaggatgtaagtgcacaaactgctggacattctgggacttg

SEQ ID NO: 102698 - DNA, 496 bp, Triticum aestivum
  Clone ID: PAT_TA_102698
gctttggcagccgtcctggccgtgcttctcgtttgcgccatagttgccgcaacgaggggcaagaagcgtaggcggccgagcacggcggcatacccgagccccaagaagagcgcggccgcctcgcagctcagcagggagatggacaacgccgacattggctatgtggagtgtgtgccggacgaggaggcggcggcgatgatgatgccggaggagaaggctcgccggctggggcggagcggctgcctaacgttctgcgcgggcgaagccaccagctacagtctggagcagctgatgcgcgcgtcggcggaggtgctcggccgcgggagcgtggggacgacgtacaaggcggtgctcgacggccggctcgtcgtcatcgtcaagaggctggacgcggccaagatcggcccggcggcttcggaggcagagaccttcgagcagaacatggatgtgattggccggctgcggcatccgaacctcgttccgctgcggtcgttct

SEQ ID NO: 102699 - DNA, 435 bp, Triticum aestivum
  Clone ID: PAT_TA_102699
ttctacaagcagaacattcaaggttagacctggtcaagtggagcctcatgctgaggcagccggcgagaacgatgctgatgatgaggaaagcactcaaaggtctaccgaggacagtgagaatgcttctgaggccggtgaagatgcatcaggaagtgaatctggtgatggcgagcacggttctcccgaagatcacgatgaggaagaagatatggatcatgatcaggatccgaaggcagaaagtgagggtgaggcagaggggacaactgagacccacgacgttgaaggaggaatgtcattactcggaatatcattgccttcatccgaacgctttctgtactcggctaaaccactggccaagcatgttcccacatctttacatggtcgggaagatagatcgtcacatgtattttatgggaatgattcattttacatctt

SEQ ID NO: 102700 - DNA, 385 bp, Triticum aestivum
  Clone ID: PAT_TA_102700
tgccccgtcgtggccgtcatccagtgggcgcaggagatcgagcgccacacggccaaaggcagcgcgcgcgtgctgctctaccatggcgctcggcggggctctcagaagtatgatttcgacaccttcgacttcgtggtcaccacctactccaccattgaggcggactaccggaagcacataatgccacccaagattcggtgtgagtactgcaataaacagttttaccccgagaagctgaagattcacttgagatattactgtgggcccgatgctcttcgtactgagaagcaggcgaagcagaagagcaagaagtggtctgacaccaaagtgaaggggaaagggaaggggaaagggaagaggaaaaatggtattgaggaggaggagg

SEQ ID NO: 102701 - DNA, 421 bp, Triticum aestivum
  unsure (1)..(421): unsure at all n locations
  Clone ID: PAT_TA_102701
tccgcagccgaagcccgtgacaacagcgaagcgcgacaggaaaggcactgaactagtttgcaacaaagaagagagaaaatgtctaccgctgaggcaacccgtgaggagaatgtgtacatggccaagctcgccgagcaggctgagcgttatgaggaaatggtcgaattcatggagaaggtggccaagaccgctgatgtacgtgagctcactgttgaggagcgcaacctgctctctgtggcttacaagaatgtgattggtgcccggagggcttcctggaggatcatctcctccattgagcanaaggaggagagccgtgggaacgatgcctatgtcgcatcaatcaatgagtaccgtaccaggattgaaaccgagctcagcaagatctgtgatggcatcctcaagcttctggactcccaccttg

SEQ ID NO: 102702 - DNA, 506 bp, Triticum aestivum
  Clone ID: PAT_TA_102702
aacgacactaatttgcaatggttcttacttggctggtaagaacaagacactattcacttataaaatgacacagcgtatacatgtttaaaaaaacattgaacttgtataaccacatccaagattgttgactgcagtaatcttacaattttctgattcacaacgtgtcccagccttcaaatcggtgtagttgtgttgactgttgactactttgaatcgacaagtggcttgcttcgaggatatattactgatacataagcctgtttgtcctacactagaaactgaaatttgttgttgcacaccacaaagggaataattatccgttggatcttaatttcacctttcaaattggtagcatacatcacataagttttgttaggtcatttaagtattggattgtttgtaaggacaaacgtggcctttgtaactcctgagggacttgagataaaattatcaaatttacagccataacgtgaccactaatagtactcagatttactcaaatctgt

SEQ ID NO: 102703 - DNA, 514 bp, Triticum aestivum
  Clone ID: PAT_TA_102703
ggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgcggtcgtcagtatttttgctctgctctatggttgtcagtcgactctccaatgttgtgt

SEQ ID NO: 102704 - DNA, 295 bp, Triticum aestivum
  Clone ID: PAT_TA_102704
cgagattattgcagcaaagcccagccagaagttatttgtggtagacgagactagacgaaaaacttaccatgaacatgaagaccagccttcgtcagattctgacctaatatttgatgccttctgtgcggagccaaaagagctgataagtgttggacttcatgctgtgcactcttatgcaagaagtttggctcgttttgctggttcacttggtgcccaaggttggagaattgcttctgagcgtcttcagcagaccttacccgctgaagtgaggtttggacgtggctgggttggagaa

SEQ ID NO: 102705 - DNA, 545 bp, Triticum aestivum
  Clone ID: PAT_TA_102705
gtagtagatcaaggcgtgtagtagcaccagcgtgggagagtcgccatggggggagagaccaaggtggtcgaggagaccaaggtcgagctgaagacggccgtgtacaaggtgcacgtccactgcgggcaatgcgcgcgcgacatagagacgcagttcaccgagttccacggggttcaggaggtgaaactggacgccgggtcagggaaggtgacggtgaggggcgtcgggttcgacgaggagaagctcagggtgaaggtatccaggggatgcaggaggcacgttgagtacatacctcccccacctccccccaaggagataatcaccgaggtcaagagcacgaaagaggagatcaagatcataacggtgaaggttcccttgcactgtccggactgcgcagtcatggtcagagagatcctgcttgagcacaagcatatttacgctgccaaggcggacttgggcaagaacacttgtgtcatcgaaggcgtcatcgaggagaagaagctgaccgagtacatctaccagagaacgcgcaagcactgcgtcat

SEQ ID NO: 102706 - DNA, 557 bp, Triticum aestivum
  Clone ID: PAT_TA_102706
cccattcgatccaagggctgcagccacctgcaatcttattcagcgaaactgccaagggaatcgccaaggcgctgagccagcacgggaagcagctgaggctcgccgtgctgcagcacatgaacaaggggatcttctcctgggccaccctcatctcgcgcattcagagcgagtccccggccgtgatcatccctcacatggggctggagaacatcaccgtccgggagatcctcagggccaaaggggaggcccagtccagggcggtctactggtgcagcaccacccatctggtgcatgaggccgtcaagcacatgacggccaataatgtcgggtctctagtcgtgctcaagtcgggggacgacaagcagctcgcagggattgtaactgaaagagatttcgctcggaagatcctcttacccgggcgaccctcagaggaaacaagagttgaagatatcatgacagaagagaacaagctaatcaccgtgtccagcaataccaatattctgcgtgcaatggagctaatgacagacgagcacattcgacatgtcccagtttttgac

SEQ ID NO: 102707 - DNA, 568 bp, Triticum aestivum
  Clone ID: PAT_TA_102707
atgcctgcttattataattctatcatcagaggcgtctccactattatggtctcatacaatagttggaatggaaagaaaatgcacgccaaccatcacctaatcactgacttcctcaagaacaagctcaaatttaggggttttgtgatttcagactgggaaggcattgatcggattactactccccaacacctgaactattcttattcgattgaggccggagtaggtgcaggtattgacatgatcatggttccttttgcctacacagaattcatcgatggactgacatcccaagttaagaacaacattatccccatgagcagaatcgatgatgctgtctacaggattcttcgggttaagttcaccatgggtctatttgagaacccttatgccgatccaagcctcatgggcgaactcggaaagcaagaacaccgagaaatcgcccgggaagccgtcagaaaatcactggtgttgctgaaaaatggaaaatctgcctacactccattgttgcccctccccaagaaggccggtaagatcctcgttgccggaagccacgccgacaacttgggca

SEQ ID NO: 102708 - DNA, 630 bp, Triticum aestivum
  Clone ID: PAT_TA_102708
ttcccttcgtccccatctctgggtttgagggtgacaacatgattgagaggtccaccaaccttgactggtacaagggcccaaccctccttgaggcgcttgaccagatcaacgagcccaagaggccgtcagacaagcccctccgccttcccctccaggacgtttacaagattggtggcattggaactgtgccagttggccgtgttgagactggtgtcatcaagcctggtatggttgttacctttggtcccactggtctgacaactgaggtcaagtccgttgagatgcaccatgagtctctcctggaggcgcttcccggtgacaacgtcggcttcaacgtcaagaatgttgccgtgaaggatctgaagcgtgggtttgttgcatccaactccaaggatgaccctgccaaggaggcagccaacttcacctcccaggtcatcatcatgaaccaccctggtcagattggcaacggctatgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgattcccaccaagccca

SEQ ID NO: 102709 - DNA, 458 bp, Triticum aestivum
  Clone ID: PAT_TA_102709
aatggcatgcatctggtgcaagacaattattatagtctgccatgcagctagggtggatatgttttttggaagtgcttactttgtcagagcggggatcgaaaggaagatgttactatcaagggagcctgaagagcgaagctagaagcagcatggggagcagctaaggagacatcaacactcattatgagaactgacttatgtaagagatgacggcacaaaacttgaaaccacaaagacttcacgtccactgtacgtcgttcgcttggttgccaccatgggaaagggtagtagggtttgttgtcagggtccattcctccttcggattggccgtccttcctctttcagatcgagactctgaaagatactctcctaaatgtctctgaatatggaagctatatatcatccaagtacagtttcgagtggaaggacgtcgagctgacgagaaccgctggtgatgg

SEQ ID NO: 102710 - DNA, 558 bp, Triticum aestivum
  Clone ID: PAT_TA_102710
cggcacgagctcccctctccggcgcgccctccctcccccccggcgaatccgcaaccgaatcgaatcccaggatccgcgtcggcgggcggcggcggagccacatggcgcaccgggtggacaacgagtacgactacctcttcaagatcgtgctcatcggcgactccggcgtcggcaagtccaacatcctctcccgcttcacccgcaacgagttctgcctcgagtccaagtccaccatcggcgtcgagttcgccacccgcaccctccaggtagaaggcaagaccattaaagctcagatatgggatactgctggccaagagaggtggcttagtgagctccgtaaccatgctgactccaacattgtcatcatgatggttggaaacaaatccgaccttaaccacctgaggtcagttcaagaggaagaagggcaggcattagcagagaaggaagggctatccttccttgagacctcggcactggaagccttgaacgtcgagaaggcgtttcagactatcctttccgacatccatcagatcataagcaagaaggcgctcgctgccc

SEQ ID NO: 102711 - DNA, 584 bp, Triticum aestivum
  Clone ID: PAT_TA_102711
tttttacattgggatcttaataaaagcactcgaagcaaaaatgcaaatgccctccaagtacttatgaaagtggcattcgaagctttgaacttgacagaattcttttattgtcaagtttcctcagctcaaacacccgggagctcccttaatttacatgctccattgaatggttgtggttttcgtggatgtgatgacaaaaatgacggtggcaacacagactgtatcgataataatggtgacatatcccaagaagatacatgtggtagttctgatacctccactagtggaattgcagaagatgtagccactaacaatggatctacaacaataaagccccccaaattacaaaagggtgtattgcgcacgaactgtatagattgtttggaccgcacaaatgttgcccagtttgcctatggtttagcttctcttggacaccagttgcatgcacttggttctgtagaatctccagagcttgatttagactcccccttggcccaccatttgatgcacttttatgagcggatgggtgacacacttgctttgcagtatggtggttcggctgcacacaacaagatattctctgc

SEQ ID NO: 102712 - DNA, 504 bp, Triticum aestivum
  Clone ID: PAT_TA_102712
ggttcggtttcgctcacgggtgaggagagaaatcgattatttttcctattggtggcatggccttgtaattttgaagaactccgtgagccacagttttggggggtgaaagcggagctggctttgtgaagctgggacgtttggtctggctccgtgttcggagttggcggggtgtggagccggaggccatccaaataggccctaagtctatttaacttgtggaaactgcccagttgctgctttgaagtttttctagtctcttacatattacgccactaaataccattaaattaaagtatctcacaggcctaacatgtgtggtctaatgttgcttggacttttggagcttaaataagctctgtaacctcttgaaatgccatccctttgtatggacgactcttagcatgtgcagtttgatgttcttggcaaaagtttctcttttgtattttcattattaacctgactattatgatttaaaacaggctattttttgttttcattctttta

SEQ ID NO: 102713 - DNA, 562 bp, Triticum aestivum
  Clone ID: PAT_TA_102713
actcacagctcttatgggtgtaagtggtgccggtaagacaacactgatggatgtgttggttggacggaagaccagtggatacatagaggacaacattacaatctccggatatccaaagaagcaagaaacttttgctcgtgtatcaggttactgtgagcagaatgacatccattcaccaaatgtgactgtgtatgaatcacttgcattctctgcatttctgcgattacctgccaatgttgagtcctcaacaagaaagatgttcattgatgaggtaatggagctagtggaacttaaccccttaaaacatgcattggttggattacctggtgtgagtggattgtcaactgagcagaggaaaaggctaacaatagcagtggagctagttgctaacccttctattattttcatggacgaaccaacatctggactggatgcacgggcagcagccattgtcatgagagcaataaggaatactgtagatacaggaaggactgttgtttgcacaattcaccaaccgagcatcaacatattcgagtcttttgatgagctcttcctgatgaaa

SEQ ID NO: 102714 - DNA, 560 bp, Triticum aestivum
  Clone ID: PAT_TA_102714
ttttttttttttttttttttgcgtcaaaacatttcaatttattataatgatgtacagattcgatctttatgtcaatatatatgttctcatactatcatcactctttctagacataaatactacctcatatttcacatcccttggcgatccaatttcagaatgttttttcatccatagcatacgtctctattcctgtaagaactcatttgcttcaagatatgacacaacttgatcagccatcgatttaggcgtggcgcagtcaccagctttgcactgtatcactatctcgcagtcagaaggggcttcataaggatcatcaattccagtaaaccctttgatttttcctgcacgggcaagcttgtacaagccttttggatccctagcttcacaaacttcaagtgggacattcaaaaacacctcgatgaatgtagaattgtgcagtaatttgcggcaagcgctgcgttcacttctgtagggtgatatcaagctagcaatgcagatcagaccagcatctgcaaacagctttgctacttctcctactctgcgtatattttcagcac

SEQ ID NO: 102715 - DNA, 400 bp, Triticum aestivum
  Clone ID: PAT_TA_102715
tttggagaactagatttagaagctttgagccggttggatggcagaaggtggtcaagctgtaaaagccaggatgggattgctgtgcctttgagtggagctgatcatgcagtttcagaccagagaagcttgagccagaagtaccgtccaagatcatatcatgaaattgttggtcaaaactttgtagtacaatcacttagtaatgccatcataagggagagaatagccccagcatacctgtttcatgggcctcgtggaacaggaaagacttctgctgcgagaatcttttcagcagctttaagttgcactgctaatggagagaataagccctgtggggtttgtatggagtgtaatgactttttctccggaaatggaattaatctaattgaagttgatgctagca

SEQ ID NO: 102716 - DNA, 295 bp, Triticum aestivum
  Clone ID: PAT_TA_102716
aggaggtaaaatggggccacataagcatggcggaagccaaacgacgtctcttggcgcacgcactgttggaccactgccaacgcccgctttatccttctatcagagtcacacgtaccactcttcgacttccccaccgtctactcctacctcatcaactccaccaaagtgtacatggagtcctatgatgaactgggcgggacaggccagggccgatacaagcgtggcatggcacccactatcatcccttggcagtggcacaagggctcacattggttcgagatggaccgtgcccttg

SEQ ID NO: 102717 - DNA, 575 bp, Triticum aestivum
  Clone ID: PAT_TA_102717
tccttgccgttcaagccgatgtggagacccaagggacttcgtgcggaccttggtcgccgaggtccgggatgcgaccttcgcgagcatcgaggacgtcgtcgcgtttgtgacatggctcgacgaagagctctccttcttggtggatgaacaagcagtcctgaagcacttcgactggccggagaaaagagcggacgcattgcgagacgccgctgccaggtaccagggccttctgcagttggagaagcagatttcgtccttcgtcgatgaccgcgcgctccaccgcgacgcagcgctcggcaagatgtactccctctttgagaaaacagagaagagcgtccacaagttcctgcaagatagggatgccgccgatacgaagaacaatctcatctcacggtacaaggagcaagacatcccagttggctggatggcagacgcaggtttaattgtgaaggtcaagttggcgtgcgtcaacctcgcaaagcagtacatgacgcgggtggtctcggagattgatggtttaagaggcatcaacaaagatcacaccagggaaacagcattcttcaaacgtctgaaag

SEQ ID NO: 102718 - DNA, 578 bp, Triticum aestivum
  Clone ID: PAT_TA_102718
gtggcggtcgtcgcctcggagggcgcaaggggaggcgtgctgctcgcgtcactcgcggagctctgcgaggcgctctcgttctgcacggaggacgccgggggctacttccccgtcgagtctgccgcgtcgtgtggctggccggcgccgaggtcgccagccccgacgagatgctgctcgccgtgcgcgccatcacctgcaggtggttggatattagttatgaaggttgtccctggatttttgctctatcgaggactgcatgagcttggtcaatatgcattctctggaaattctatgggagccagccgtaaagaaggaattcctactgtatcctgtggcattcttagtcagaatttgttattgccatcggaaggtgtactacttgaccatgtaggatgcaaggtgtcacgatgatttgatgaggtaaggtaatcgttgagtcatgttgtcaaatgctaatggatggaatttctaatgtatggctggaacaacaagtcggtgatgatatcgcgacgtcttatttgagaactgtagtcatggtttaccacgctggaccttgtgaagattatgcctgttctttg

SEQ ID NO: 102719 - DNA, 611 bp, Triticum aestivum
  Clone ID: PAT_TA_102719
accttttgctctgtgattgcagactgaggcattttcctctaggccttgcctctaatgcaagctctttgaaaatattatttctaaaacatgtcaagcagctcagctacattgagagctttccttctgttgttgagcttacagtgaatggatgtcctgacctggagaggatcaccgatctccccaatctgcagaagcttaccatcgacaactgcccaaagttgaaggtgctggagtgcatcgcttcactcgagaggctggtcctggaggattacatcatggaaaacctcccagaatacatgcgagatataaaggcaaggcatttgcagttattctgcaggctatggttgctctctgcggtagccatgggacaatctgtcactgagtgggacaagttcagccaagtggagcatgtcaaggcatatgcaggtgatggagacaaccaaagaaaatggtacgttttgtacacgagaggagacaactgcaagttggattcaaatattagcagctctaccaaatttgaagaaaccttatcatcatctatggtggatgcacaaggatttgactctctgtacaaaatgagaagaagtactttcagttacatctgcagcttg

SEQ ID NO: 102720 - DNA, 502 bp, Triticum aestivum
  Clone ID: PAT_TA_102720
tgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcctaaatcgctaaaaaaaaaaaaaaaaaa

SEQ ID NO: 102721 - DNA, 612 bp, Triticum aestivum
  Clone ID: PAT_TA_102721
tcacttgatttgtttgggtctcaattagttaaaccgcgaattgaaatttgtttcttggtgcaggagcttcaaggcaacaaaggcataggcttcacggcaacacattctatgattttcttccaaaatctgaaactatttggcccctaaattgtagtccccttgagaaagtcagagtattgatggtctggtctatggatgttgaaaaatttgattgcagccgggaccgcaaagaaagtgcagggctcaccgttgtagatatctgcagggcaacatcaaatttcagtgacaagaacatcgccaggcagggggcttcatgcatcattgcatgttcttctattccatatggccactctcttccgcgagtgctgtctctggcaaaagtttagtgagcagtgcctgccggagtcgcaggactcctgctacccggaggagcaatatttacggacaccgctcgacgtggccgaccctgccggctgcacctggtacacgctcacgcgcatcgactatactgacagtgtcgacggcgacccacagacttatggcgtgccagaagtgtcgctgctgctcaccgccgagctgcatcagtccaacaactccacctatgagcacatg

SEQ ID NO: 102722 - DNA, 627 bp, Triticum aestivum
  unsure (1)..(627): unsure at all n locations
  Clone ID: PAT_TA_102722
cttatttctcacatcccggaagtgacgttacatgtaccagaagaatgagaggtgctgtgccgaggagacgttgaaatgccatttggcacaatgacttgagatgagaatacgaggttctcaagaggtcggagcccttcaaccaagcaagttgaggtgttgccggtctctactccagtgcagagccaattggagatcctcctaattgaggagacaaagcttaggtaacatggattagtcctctcacaagatgcttccacagcttaacctgggcagcagaacgagctggatgcaagagcatcttcagttggactgtctagtgccaggtcaaagtgggaggttgcagcaacattctctgcctgcccttctccagatgaatccaggagatgcaacaaaaatgatctggatctggactgactctgcgggatcgccggtgttttttttttcttgtatccggagtgtcatcttggctgcgggtttgataggcaccggagaaggcatgaagaggcccacatctgaaaatccgttctgcaggtaattattcagtccgctctgcaggctgatnaaagagatagtctcagcatcgacgccgtcaatgttgtccagaacatgcactctgaaatctgaaat

SEQ ID NO: 102723 - DNA, 588 bp, Triticum aestivum
  Clone ID: PAT_TA_102723
agcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctggagaccaacaagattgttgacttcatcaagtttgac

SEQ ID NO: 102724 - DNA, 562 bp, Triticum aestivum
  Clone ID: PAT_TA_102724
ggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagatcttcggagtttgaagctagaggtgtcagaaaagttaccacagggataactggcttgtggcagccaagcgttcatagcgacgttgctttttgatccttcgatgtcggctcttcctatcattgtgaagcaggttcatttcgcggatccgctcactgtacagacgaagcttctgaagaatcgttatggccgccaaataccaacaatgtgatacagtttttcactgcagatacacactagggaaagaagagtgtctttgttcgacaaaccagagtgctttgtgataggaaagtatcaaactgctccatgtgttcgagaaagcagaatgctctgtgacagtcagctatagcgctgtttgtcttggctggtatttgctgataataatcatcaagttgttgtc

SEQ ID NO: 102725 - DNA, 572 bp, Triticum aestivum
  Clone ID: PAT_TA_102725
agcatccagatctcgtgcagtttattccattgctaatgcttgtcggtctaatttgtggttttcctgcttaatggcgctcaacttggttgacgttccggccttagcttcccatccatgcggtccagtggtgcccgttcctctgctgttttgttgcgagggcgtagctagcttcgaacgacgaggcgtacaagtgggccctacaggatgacgacgagcgcgaggtcgccgggcggctcctgaccctcactgagatcattggttgtgagtgcaagagacagatctttcaaatttcaatcacgttttatcccacttcctattcgggatttgcttagtgttacgtttttcagtaggggaagagatgagcatgatgttgaagatgacgaaggcgaggaagatggggatagcgtgcagttgacagttccatcacaatcattgtttgttgatttatgtgtatgcttgggcaattatgcagcttttacatgaagattataacccttttattttattcaggtattgtcttttattctagaatgcttacacagaaaagattgcagagctgtgattaatttgac

SEQ ID NO: 102726 - DNA, 518 bp, Triticum aestivum
  unsure (1)..(518): unsure at all n locations
  Clone ID: PAT_TA_102726
acaatgcagtgaggtatagtattttattctaagttgctaacataggaaaatagttacagaacccagctggcattagacttataggtcaaattttgtgatagtttcccttttatcacgaacgtgtggctcttattgcattatgttacgagggagattaatatcacctgccgaatcaaaaataccaacatttaagcctagaagggttagggtttaggtgtgagccaattgctgaagagaggttaatcaactgtatgcaaagttttgcaacacagacattgtgtatgtggaggaagacgatcaattgtaaccaacatcagaatacaagtactgtagttggtcgaattgctcaatcggctaagattaaatntgcatctggttacaataaaatgctatctaggtcacatacatgaaaatgatatggtaagatggcaattcaccaaagcttctaaacgcatgtctagtgataaaatttaagctggttaaaaaaaatagctcctaaataaaggtatcctatgaat

SEQ ID NO: 102727 - DNA, 606 bp, Triticum aestivum
  Clone ID: PAT_TA_102727
tgttctcaacctcccctccgtccgtcgcagctccagatttccttcccctggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactgccttgctcctcttgctaaggttatcaatgacaggtttggcattgttgagggtttgatgaccacagttcatgccatgactgcaaccc

SEQ ID NO: 102728 - DNA, 636 bp, Triticum aestivum
  Clone ID: PAT_TA_102728
cttatgtatggagtgatgcagaggatccagatctgtatggtgaatgggattttgaggtgattgtatctcatttcttattgtggcctatcgatgcgtctgttattctttcggtcccacacttcttgattcttggaatgaacacatttattgtgttccaagtgaaactgcaactgaaccatttctgatcaataatacaaatgttaatagatttcaccgaagttatgagctgtgacagaagaatcacaacaaacatgtttgccccataagattatgctaatgtccacattgaaccacgctatttatgatgagctcatgtaggtaattttgctgctgaaagaaagttttaactccatttctatgttggcattcagcagagagggctgactgccaccttcttctgcccatttcagaacaaaatgcttctgtgattgtagtctatgtctattatgcatatactctgataattttcgaactgcccggtttccactatttgtcgatgtggattttgctttcagggataatttcttttttgcatacaaataattacatcggccatgtgttctctataggagtggaagagggttcacatgaaggatttcctaacgatgacacttggattcatggacggactcgaac

SEQ ID NO: 102729 - DNA, 626 bp, Triticum aestivum
  Clone ID: PAT_TA_102729
taaatctctgttgtttgcctgattgtgttaactatgcaacttccaacatacattggccaaaggaattcgacatcgtgaagtaccactaatcctagcctacatggtgtctatcaatagaatggagaattgtgggtcgaacataacgaccaaaacagtgtatgtattacttagttgtgaatatggtaaaatagcatgtcctaacccagcagttggtcctgatgaattcgaccccctaagatccaacttagacaataatcaggcagaatatctttcattatgacgaaaaggcagaatgtctttgatttgcatattattgtattaaatttgtgttttgaccaggacaaattatgcatcatatgtctcatttttgaaatctacagttctacattttgacattgttctacaactgccaattttccctatcacggtattcatttttattctgctttaacctgtttgccgtgctgtgttctctaatctttacttgtcctccctgataactaatgtggtgatagggatgttgcttcatatgtccctgttcctcttcaaaatcacttaatcacatgtagtcatatggatgatcacatacttggcaagaaagttattctctagaatagacttcatga

SEQ ID NO: 102730 - DNA, 655 bp, Triticum aestivum
  Clone ID: PAT_TA_102730
cagtttcacaggcaggtggcaagtctggtgttcagaagacacctcatgaatatggtaacgccatgcaacaaacggttgagcagactgtacaaaagagtgaacgtgcaatttgtctggatagtatccatgaaaatcacgatactgatgtttatagtgaagataatttacttggtgaagaaaggacaactaataacaataatactcatgtagaggaagtaaacaacaaagaatgcaaccaacagtcccacagtacttctcagtctactattaaactgaagttagtcaggtcaagaggcattccggatgcaaaaggttcaccggacaaatcaaagactactgcagtagggagtgacgtgaactctgagtgtgataaagttcccatggagcatgatgaggatcctaccaccaatcaacatataagcagtgacttccctagtgcgtctagagatttccaggaatgcacagataaaagcactggttttcatgattcaaggaagttccattctgaatctggaaagacgattgctgtgtaccaaaggtcaaagttaagtaagcacaagaaaaaattggattcagattctggcaatggagatagtacctccgtctccaatgatgatggtgggtatcaaccttcagagtacagtcctgttgcacc

SEQ ID NO: 102731 - DNA, 653 bp, Triticum aestivum
  Clone ID: PAT_TA_102731
ggcgcgtgcggggtccgcacgcgagctagccgatgcctactgcaacatccggcgcgacctgctcgacgaatacctctccgtgctgggcgtcgagcgcctcagcatcgacgaggtgcagcgcgtggagtggaagcagctcaacgacaagatgaagaagtgggtgcaaggggttaagacggttgtgcgtgtgctgcttgctggtgagcgtcgcctctgtgaccaggtgctcgctgtgtccgacgagctcagggaggagtgcttcgtcgagtccaccaaaggatgcattatgcagattctaaattttggggacgccgtggctgtgtgcccccgctcgcccgagaagctctcacggattcttgatatgtatgaggcacttgccgaggtagtccctgaaatgaaggatttgtgcctcggaagttccggtgatggtgtaatcagtgatgttcaagcaattcttgataggctcggcgaagccgtgaggggtaccctttttgagtttgggaaagttctgcagcaagagtcatcgcggagggcgatgacggctggtgagatccacccaatgacacggtatgtcatgaactatttgaggctgttggtcgtttatagtgagacacttgatggcctcttggatgatgatggcgatgagagcaatg

SEQ ID NO: 102732 - DNA, 649 bp, Triticum aestivum
  Clone ID: PAT_TA_102732
caaccttgactggtacaagggcccaaccctgcttgaggcacttgaccagatcaacgagcccaagaggccctcagacaagcccctccgtcttcccctacaggatgtttacaagattggtggcattggaactgtgcctgttggccgtgttgagactggtgtcatcaagcctggtatggttgttacctttggtcccactggtctgacaactgaggtcaagtccgttgagatgcaccatgagtctctcctggaggcgcttcctggtgacaacgttggcttcaacgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaagtttgctgagctggtgaccaagatcgacaggcggtctggtaaggagctggaggccctgcccaagttcctcaagaatggtgatgctggcatagtgaagatgattcccaccaagcccatggttgtggagacctttgccacttaccctcctcttggtcgttttgctgtccgtgacatgaggcagactgtggct

SEQ ID NO: 102733 - DNA, 646 bp, Triticum aestivum
  Clone ID: PAT_TA_102733
tttttttttttttttttttgttaaaacaaatcgttaaagttagtatgtaaagtagagttgcattgtttctccaactcatcagagtcgtactatttactaaaaaacagcgccgtactatttagccacctattacaggttatatgcactactgatttcttcaaataaacacatttgtttacgttttttttgtataaataatcacattcgtctacatcttcataatctttttttgtgagatacattttcataatcttgacattttgaatgtcaagggtgcccttacatccagttacgagttctgtaattataactcccaaactgaatatatctgacttgattgacacctgaccatgctttatgaattccggagcgcaatacccaagtgaaattgcggagttactagtgacaatgtgtgttactccatcgagtagttttgatataccaaaatctgttatttttggtaccataagatcatcaagcagtatattggcaggtttaagatccctgtgaataatacccttttccttatgaagatactccaagccgctgcaaattcctttaataatttggtaacgggtatgccatttaagtccccttaattcatcggcaagatatttgtcgaggcttcctttgttgatatactcga

SEQ ID NO: 102734 - DNA, 492 bp, Triticum aestivum
  Clone ID: PAT_TA_102734
aacctcaaaaaccatggatttggaggagagataatccacgcattgacaacaagaaggggaatgcagatgacattcaggtagaaccgcagaaccaggtcaatgagagcagtgtaggtctaccattgttgataatgaaagatatggaggatctgggtaggaaatggaaagggagtctggaaaattttgtgtctgagaatatgaaactacatgatcaggtccaggagttaaagagagataaaaaggaggccgaggagcgagctaagaaggctgaaaaagaaatgggaaatgctatggctgacaacatgaagctgaatggtcagctccaggaatcggaaagaaataaaaaggaggccgaggatcgaattttacagttggatttcttctcaggaagtgtggcagctgtaaacatggatttgcacaataagatagaggttctagaaaatgagcataaaaaggccgaggaccgagccaaggaggcagaaagtgaaatgg

SEQ ID NO: 102735 - DNA, 579 bp, Triticum aestivum
  Clone ID: PAT_TA_102735
aacctctgcgtcgccgccgatgttacaacagcaaaggaactccttgagctagccaacaaggttggtccagagatttgcatgctgaaaacccatgtggatatcttgtctgattttacaccagattttggtgccaagctccgttcgattgctgaagagcacaactttttgatccttgaagaccgcaaattcgctgacatggggaacacggtaactatgcaatatgaaggaggaatattccgcatatcagactgggccgatattgtcacagcgcatgtagtccctggacctggaatcatagatggcttgaagctgaagggtttgccaaagggaaaagggttactcttggttgctgagatgagcgcaccgagcaaccttgctcatggagattacaccacggcagccgtgaagtttgccgagcaacattctgatttcgttatcggattcttgtcggtaaaccctgcatcctggccagctccagcgccgagcccagcgttcgtccacgttgtcgataccggagttgatgttgtcgctggaggagattctcctggtcagcagtatgaaacccctcatttggtcgta

SEQ ID NO: 102736 - DNA, 612 bp, Triticum aestivum
  Clone ID: PAT_TA_102736
aactggaccgtagtggcgccaccaccaggtatatttctgtcaagtcgatgacattttttgtctttatattgtccttgacaggatatattcttttcatgactatgttacaatcttatttggcattcatgtctcttttgctattttagatcaaatatatattttagttttccctggtatgctatttctatacatgcaaactcaaatatttgttcatattagtttgagcttttcacatcatcccactcatcctagattatgtcataacctcaagatagttctgaacttctgacatttgaagtgacacatacaactgtagatgcttaatgtatgattggatacaaattctccttaatctacaaagcttatgatagaggctgcatagcctgcagttgatggttcagtagtatagaatgtccattatattacttgtaagagtgccaataattcctatccaaatcttccgttattaatatcaggattcatccaccactacaacaacacttgttaccgtatatatagtttgtgaaggtcattctccatggacctccaattctttggtgtacttttggttaaaatattctgttgcactacagttctaacatttaacatgcg

SEQ ID NO: 102737 - DNA, 594 bp, Triticum aestivum
  Clone ID: PAT_TA_102737
aaaccactctccctatccccgtgtccagaatctaccccccggctccatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacatcagttgtttgacccgcctagaccacaacagggcactccgtcagatttctgagagacttggtgtccaagtttctgacgttaagaatgc

SEQ ID NO: 102738 - DNA, 435 bp, Triticum aestivum
  Clone ID: PAT_TA_102738
tgcaatttcgacacataatattggataataatgagaacaagcctgttacaaacagcatggacgactcaagaggtcaagttcctacaacgtgcagatatgctgaacattttcaagaacttttcatgcaaaacgtggatattggatgactttgacttctatgacaataggcacaaagtagtgcaggacacaagaggcaagccgcttactacatcattggatcacctcacgccgaaggatgagaaaccgtcatagtctgaaaagcaagctcaatctgcatgtaacgtaaagcatcataatgccaagagaaaccatgagcagagcaacgatgttacaacagatgttgatacagccaagacaagtcacaagcagatcaatgtggatccggcagatgttgatacagccaagacaggtcataagcatagcaacgtggatgcg

SEQ ID NO: 102739 - DNA, 162 bp, Triticum aestivum
  unsure (1)..(162): unsure at all n locations
  Clone ID: PAT_TA_102739
gcagagaacagtgaacagggtcatatgttatctggtgcatgtcgcaaacttcagttcaatgcatnttctgtccctgacctaaatgcacccatgcccatggacatggactcttcccctgagaagagctatgatttaaataacagacttttaagatcaaatgac

SEQ ID NO: 102740 - DNA, 599 bp, Triticum aestivum
  unsure (1)..(599): unsure at all n locations
  Clone ID: PAT_TA_102740
aactagtggcaggagaaaatatgcttagtgttgtctccatagttgcaatggggntggggcaggaaagacaacacttgctgcaaaagtatacactgcatctcaagtcaaacaacactttgagcaacttgtttgggttattgtgtctcagaagttcaaggtcattgatttactaaaggagattttgaagcaaatatcaagtgatgaaggtcagtctagaaaatttgatgacatgaatgagtatgaggtgggaaagaagatccacgatatcctcatccaaaaaaatacttggtagttctcgatgatgtgtgggaaacagacacatgggagcaaataaatagaacaattaaggcctttcctgatgcagccaactttagtagagtactgcttaccacaagaaaagaagatgttgccaatcatgttgatatgccaacccatcctcatgctttgaagggtttagatgaagagcaaagctgggaactttttagtagcagagctttaccttcatatagaatatcaatcatacgtgatctggataaatataaagaaatgggaagaaagcttcaaggaaatgtgatggattaccacttgcacttgcagtg

SEQ ID NO: 102741 - DNA, 515 bp, Triticum aestivum
  Clone ID: PAT_TA_102741
cggcggcggcggcggcggccatggtggccttcttgctgctgtccgcagcctcgcacggaggacggagaggacccagtttcaacagcaacaaccggacttttgtttttaattataccctagcgaagactattgtggaatatgcttcagctgtgtatatgacggacctaacagctctatatacatggacatgctcaagatgtaatgacttgactaaaggctttgagattaggtgtataattgtcgatatccagaactgcttgcaggcattcattggtgttgatcataatctcaatgctgtaatcgttgcaatcaggggaactcaagagaacagtgtacagaactggattaaggacctggtatggaagcaggttgacctaaactatccaaacatgcctgatgcgaaggtctttggcacgaacttgagatatatactctgtttatataggagtagctgttatttattttctgatgaggtttatgttctggttaaaggtccacactggattttactctgc

SEQ ID NO: 102742 - DNA, 606 bp, Triticum aestivum
  Clone ID: PAT_TA_102742
gcccacctcccctccctccagcaaactcacgcatcccaccaccgaagctcccaaccccacccgaagcggcagccatggcccccaaggcagacaagaagccggccgccgagaacaaggtcgagaaggcggcggagaagacccccgcgggcaagaagcccaaggccgagaagcggctgccggcgggcaagacggcgtccaaggaggccggcggcgagggcaagacccggggccgcaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacctcccgggagatccagacctccgtccgcctcgtcctccccggggagctcgccaagcacgccgtctccgagggcaccaaggccgtcaccaagttcacctcctcctagactgaagatgcgccgcttgttgtgccagatgtggctgtctgatgtatctctgctgttgactctgcttacc

SEQ ID NO: 102743 - DNA, 232 bp, Triticum aestivum
  Clone ID: PAT_TA_102743
tgttactgcagacaggtaccataaatacaacgaggatatcaagctcatatctgagacaggcctagaggcctataagtgctccatttcctggtcaatgctcattccaaatggccgtggagctgtcaatccaaaaaggttacaattctataataacatcatagatgagcttgtgaaacatggcattcaaatacacatcacacttcaccatctagatctccctcaaattcttgaa

SEQ ID NO: 102744 - DNA, 579 bp, Triticum aestivum
  Clone ID: PAT_TA_102744
ggcctcccgtgctccttggctcggccttcgtcgccttcttccacgcctcccgcgcggattcgcctcctctggttcagagattccaggcggtgatgacgatgacgatggtcgacatcctacgtggcttgcgggacaggaagggaggggagccagcatacgttgttcatgctcagactcggtggcgtgtttgagctcctgcattgtttcgctgcggtgacaatttttcctagctcaacacctatcaatttcgtggcttcttatggttcagaagaatatatactccctccattcctaaatataagtttttgtagagatttcactatggactacatacggaacaaaatgagtgaatctacactctaaagacttatatttaggaacggagggagtatatgtgaacatggaccattgcaagagtaccatattcgtttatggtcgaagcattttgattgtcgactattacccccaataggttgcaggtacacaaatgagattgctctgatgcattctgtcaacatggcaatgctaccgaatgtattagtattaatctgtttggactttctttggtattggatctat

SEQ ID NO: 102745 - DNA, 521 bp, Triticum aestivum
  unsure (1)..(521): unsure at all n locations
  Clone ID: PAT_TA_102745
accggccatggagggcaaggaggaggacgtgcgcctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccactttcctcttcctctacatctcggtgctcaccgtgatgggcgtggtgggcaacccgtcggggtccaagtgcggcacggtcggcatccaaggcatcgcctggagcttcggcggcatgatcttcgtgctcgtctactgcaccgccggcatctccggcggccacatcaaccccgcggtcaccttcgggctgtttttggcaaggaagctgtcgctcaccanggccgtcttctacatcatctacaacaagaagcaggcgtgggacgaccactggatcttctgggttggtccgttcatcggtgcggcgctggcggccatctaccacg

SEQ ID NO: 102746 - DNA, 506 bp, Triticum aestivum
  Clone ID: PAT_TA_102746
cgacacgccgctccccgactcgtcggagcagatctacatcgcccccgtcgcgctcctcaagatgctcaagcacgcgcgcgccggggtgccgatggaggtgatggggctgatgctgggggagttcgtggacgagtacacggtgacggtggtggacgtgttcgcgatgccgcagagcggcacgggcgtgagcgtggagtccgtggaccacgccttccagaccaacatgatggacatgctgcggcagacggggcggccggagatggtggtgggctggtaccactcccacccgggcttcggctgctggctctcgggcaccgacgtccagacgcagctgagcttcgagcagctcaacccgcgcgccgtcgccgtcgtgctcgaccccatccagagcgtcaggggcaaggtggtcatggacgccttccgcctcatcaacccggcggcgatgctcacggggcacgagccgcgccagaccacctccaacgtcggcggcaccgtgcgcccctccc

SEQ ID NO: 102747 - DNA, 555 bp, Triticum aestivum
  Clone ID: PAT_TA_102747
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttctctctcgagaaaagttggtgttgcttgttgttcagctatccggaatatcctccgtgaataaacagctgtaatgattgtgcgtgg

SEQ ID NO: 102748 - DNA, 435 bp, Triticum aestivum
  Clone ID: PAT_TA_102748
ccgacaccgaccgtgccgctgctgagaaagccgaggccgacaagaaggcagccgcggtaattccagctccaatagcgtatatttaagttgttgcagttaaaaagctcgtagttggaccttgggccgggtcggccggtccgcctcacggcgagcaccgacctactcgacccttcggccggcatcgcgctcctagccttaattggccgggtcgtgtttccggcatcgttactttgaagaaatcgggggagacggtgtgcagaggggagacgagagcgcgacgagcgaggccggctagttagcagcatacatacaaaggccctggtccaactggggctggacccaatggggctcacgcctatttttcctctggaaaataattactatagcaaatacatttgtaccactgaaaaaaaaaaaaaaaaaactcgagggggg

SEQ ID NO: 102749 - DNA, 544 bp, Triticum aestivum
  Clone ID: PAT_TA_102749
acgcacgatggcgactctgcccagttggactcttctgttccatcgctcgcggaagcagcaaaaccaggttttaggaaagctgagaaatgcagcaagaatgctctgcggagtgtatcagagcttcacattggtgatgagaagcaggctggctctagcaaattcgacatggacaaagtgatgaaagggttcggagctcgtggtgcttctggagcttccagtggcactaacatacaggctggtgacgttcctttgaagtcttcagaggcgtgcccttccaaatcacaataccaggaaaaagagctcctttggatctcaccttgaagactaccctgcagtttgtgtcatcatcttctgtgaagtggtgtcacaatttgagtacaagttgtaggggcagtgttgctggaggtaggtctcaaagttcaggacacatgaggcaggagagcaacaaggaattcttgttctcgaaggcactgcagtcatgggtatatccacaatccatgttacctgctcccatcgtatctgctatgctctcatcaactgcacg

SEQ ID NO: 102750 - DNA, 601 bp, Triticum aestivum
  Clone ID: PAT_TA_102750
caagtgtcctattatgactaacccatgttttgaatggagacatcttcttaccgttcccatatccttcagagtttttttacttgtgggagatgcaaatatgtttcgggaaaggggacaacacacatcttttcaattttgggcaagtactattctgctaaaagtatttgacgtgttagcctgcatgtgtttttgaatgaatttgcagtagtttttgcgctcaacaatatttttcccattgtagtattttagctgcctttattggcatgcacattcttaaccaattagtatgcacattcctattttgttatcatatttactataggtgcagctgtcacaaaagcgatgtaataaggctgaacaattcaattataattgccatgaacttgttcaatacctagcattgttagaatattttgttatacactcttttcgagaataaaacatttgctccttttgagtaatgtaatgtttgaacagttcgtttcgaagggagctagaagggtgcgtagtatcttctagagtaagatcaagcataagcaacaccttcatttttttcaaactactagcatattaagttctgctcaataattaatatgatggc

SEQ ID NO: 102751 - DNA, 237 bp, Triticum aestivum
  Clone ID: PAT_TA_102751
gattgatctactgccagttgaaggttttcaaatgttgaaggaggaggataataggaacttctgtgatgtcttgtcatctattttcttttctttgttgtagaatagttttgtttggcacttactagttccttggacataaagatatgtactgccagaatgaatgcatgtaaatatattttgggctcctataatattccatgttgctttgaaaaaaaaaaaaaaaaaaaaaaaaaaaac

SEQ ID NO: 102752 - DNA, 540 bp, Triticum aestivum
  Clone ID: PAT_TA_102752
gcgccaccccggtcaccgaggtggagatgacgctggggactccccagtcgactatgcacttctacgacgtgagcctggtggacgggttcaacgcgccggtgtccatgacgccggtcggtggcggccgcgggtgcggcgtggcggcgtgcggggcggacctgagacgtctgctgcccgtcggcgctggaggtgagggaccgggaggggagggtggccggttgccggagcgcgtgcctggcgatgggcagcgacaagtactgctgcaccggggagtacgggacggcggcggcgtgcaagcccactatgttctcgcacctcttcaaggccatctgccccagggcctacagctacgccttcgacgacgcctcaagcctcaaccgctgcaaggccaaccgatacctcatcacattctgcccaccacaacctgaatgaggcatcgctatcaatcaccatgtatttatatttctgaatccaaaacctgagtgaactgtgtagctacatggagtatatgatacagtatgagggtgtttgggatgttat

SEQ ID NO: 102753 - DNA, 581 bp, Triticum aestivum
  Clone ID: PAT_TA_102753
cccgtacattatatccaacatctcatttgtatttccacgaacattggaaaattcatctaatattgcaaagagagaccaaacataaggatattgtcatcaaatccatggttgaagcaatgcaagaagaagttcatgaagtattggaagctgtcattcttgaccatttgtcttccggtcatactcgaccccaggtacaagtttaaattcttggagttctgcttaaaatctggacttgaaagtgatgcaacaaggtatcttgctaaagtgaagagaacattcaaagatctatttgttgaatattctatgcatgagggtgagtcaaatatgggaaatgatcaaggaaccaacaatgttggtacaagtattgataacccatgggatcaatggaacaaacaagttaagcaaaatcaagaaaatcgagcaaagctgagtgaacttgatatttacctaaaagatgatgtttgcccgcaagaagatgggttcgacatactatgttggtagtccaataatgcacacaagtatcccatagtatctcggatagcaaaggatgtattggctgcacctgcatctagtgtagcatc

SEQ ID NO: 102754 - DNA, 549 bp, Triticum aestivum
  Clone ID: PAT_TA_102754
actgcacccggacatcctcatgccgccatgccggtaacctcggacgcaccactctgctccgggccttccttgcgctggcgtcctcagattcaccagacgcatccatcgccgtgcgatcgagctcgattccagtaggatgctatgctcgatggctcttcacgtcggcagcctcgaccgcgcctgacgcggccaacccggcgaagcccagtgagcctgtgcgcacacgttgctctgccccatgccctcctcgtgccgacggcctcaggcgtacctcgaccctctccgccgaggcctcgattccagcggacgattttgggaaggagaagctcgatggcctccccttgccttctaacgtcgctacgaacgcccgcaagcccaacaggaggaagctccgatcaagataggtaccaatggtgagcttgagcctccgatttattctggttattgcttgctttgtgattggcttgatttcataatgtgatgtggtgttcgtaatgtttcgtggcgcttcctggtagctctgtggtgcttgctagcttcaagtgtgcg

SEQ ID NO: 102755 - DNA, 484 bp, Triticum aestivum
  Clone ID: PAT_TA_102755
agactcaacgccgagcgaacgaaaaccatgcaggaaattgtttgtggttgctcgatgagttcataatttgattccaacaaagaaaaatttatgggaaacctgaatctgaaaacagcaggtcctgcagatgtgagtgccctgctctgatcaggcttctgcgtgcatcggacaacagctggtacataacagagcatcgagcgagtcacagccattcgatgtctctgacaatgggagagaaggtgcactggccttctcataagcacattgatgtatacaccaaggatttgataaagcaactaagggagaacaatgttaaccttgggaaggtttacaacattattgggagcttctttgggtcactcgagaaggtacctttcacaaaaaggacgctaagaaacatttgtgggaagattagccgtgagcaagctgaggatgatgtccgaaaaacacttcaagcatttgctgacatccaggccaacgatcc

SEQ ID NO: 102756 - DNA, 469 bp, Triticum aestivum
  unsure (1)..(469): unsure at all n locations
  Clone ID: PAT_TA_102756
gcgaggtcgcttgctgccgattcgatgagccctgtgcatgatggattggtgataagcaaaccaccagggatgaggtttcccttgagaagaaatatgccggcatctgttgagccggccggccacctccacaatgccaatggctttgacgccgtttcgttgtcgggttcagatgggagctcagggagattcactcccaaaaccagtgcgaacatgcatagcacatttcttcaggatgcgaccaatgtcctctcgccttttgccaacaatgccacctcgagaaacccattgagctctggtgactggtcaggaagctcagctcctgacgctagcactgatgggtcgacgagcaactcgggtgagacggggttgagaggtgcagaggatgatgtanagaagctgagaagtgagatagggactttgacaagaaaactggatgtctcagacatggagttgcagacactcagaaagc

SEQ ID NO: 102757 - DNA, 390 bp, Triticum aestivum
  Clone ID: PAT_TA_102757
aaaatttagttgaatcatcttcaatccctccttttggtaatgtacatagcatttacaggcgacacactacactaacgatcaacggttctgaagaaacaaactaaaagcttggtctgcgcaaaggagacagaaaaaaacacctctgctactcaccacttcactgacattttggtgattacagtaccatccggttccagtgtaggatgaccatcgtgcaatgtcgtgtggcagttctgatgtatacaatggcgtgtggcagttctgatgtatacgtgcagtaagagcttaagaagacacaccatcgtgttgagagaggaactctattatgcaagggtacacttcatggacagccttccgccctccaaccaggtcataatgtgcatagtgagg

SEQ ID NO: 102758 - DNA, 512 bp, Triticum aestivum
  Clone ID: PAT_TA_102758
aggggttgagaagcacatggaggagctcgaaaggtgggtcaccgacgagaacagcggcggcgtgctgtacatcgtcgggttcggaggggtggcggaagaccaccatcgccaccgccctgtacaggaaatttggggaaaatttctcccaccgtgcgacggtctccgtgtcccacagctccgacgtggaggccgtcctcatgaacataaagagtcaggtcatgccgctgcagatcgacagccaccaccagcacggcagcttgccggagaacagtctcgcggcagcggtagaaagccgtgccccggcacatcgggcaaggtgcctcagccgtcgtggccaggctccgcaactttggcacgtcaatgcaaacaactgagcgtgggaagcaagatcagctcaaggaggaacttcagaagcatttcggggaagacagttacttgctcttaattgaccacgtatggtctgcaacgacatgggatcaaattacaaaatcacttcctcaaaggaacaaacg

SEQ ID NO: 102759 - DNA, 302 bp, Triticum aestivum
  Clone ID: PAT_TA_102759
aggaagcaggacgtgaaggtgaacctcaccaggttccggcccttcctcctccaggccatcgacaagctgcaggagtagcgccggcggcggctccattgtcatccccagcccaggttggcgatggtaggtgtaccactcacgtcacaatcacatacacatacacacacaggcaaacacgacgacaagaacattgtaaaactagtgctggaaagggtgatgatcagattggtttgttggttggttttgtaatactcattttggttggatatatagtgcgcttgcacgcaagaggaatgctcatc

SEQ ID NO: 102760 - DNA, 221 bp, Triticum aestivum
  Clone ID: PAT_TA_102760
agttcaggcataccttctgcaaaagttcaaaaatctgaagaaacaaagctcaaaccaagttcagaaactgtttttggattaaattagttgttttgcttaattatgtggtatatgtgtgtattgtgattgtaattgtggcttggagttgagaaaaagataacaaaaaggtacataaatgaacccaaaaacattcggtagtttctggaagcccaaagttgttc

SEQ ID NO: 102761 - DNA, 359 bp, Triticum aestivum
  Clone ID: PAT_TA_102761
agcggcggagttcttcgcgatgccggcggaggacaagctcccctactgctcctacgacatgagcaagcgcttccggctcgccaccagcacctcctacgaccgcggcgagaccctctactggcgcgactacatcaagttccgctgctacccggcctccaacgagaacgcgcgccactggccgtccaagccggcgaacttcacgccaagcctcatcgagtactcggcggcagtgcacgagctggcccagaccatcctctgtctgatcgctgaggggctgggcctcgacggcggcttcttcgccggcgacctcagcggcggcgacacgcacatgagcgtccactactacccgccgtgccctg

SEQ ID NO: 102762 - DNA, 296 bp, Triticum aestivum
  Clone ID: PAT_TA_102762
agaaatgagagggggtattgacaggtagattatgattgctgttgttactagttgctgctacaagattgcaagtgcaatgtttggtattacttgcttgagaatactttctcatcattccctttatctgtctgttatgatcgttctgatgatgaagtatggagaaatacctgtaggtagtttggttgatattaccggcttttgagtgtgcttagaaatatctggcattcgtatcagtcgtgttcagttccaaattcagctggctgtacttgccgtcttttaattcgaccaggcatgca

SEQ ID NO: 102763 - DNA, 362 bp, Triticum aestivum
  Clone ID: PAT_TA_102763
agagttcaatagaagtttgaataaggctgcacgcatcttgttgctggtcttacactatgaatttgcagagtgtttctaataagatggatttgagagggtttagtattatgatttatttggttcaaatgaccattgaccgttgtactgatggtgggaggagtgtctccttaactggtccatacggagtgcccaaagaaatgtgtagcattgtggatgtaggatcgaatctgatagattttgtgttgctttgcttccttgtagaggcaaatgtcagtggcggtgatagagcatgcagagactatggagaggggaaaggcgaagcctgggggtttgagtgaccctcgtttgggtactattgacca

SEQ ID NO: 102764 - DNA, 321 bp, Triticum aestivum
  Clone ID: PAT_TA_102764
aggtgggcacgagcctcgatccaacgagcactgacggtgactcgactccccgttctcgccccgccgtctccggagttctcctcctcgtcctccgaagccaagctaccactgccagggccgctcgatcctggccgagaccaagggagggggccgacaatggcgtggaggcgactggcgagcggcgccgccatggcggcgcatctccggcggggcgtcccctctccccacttcgcccccgcccgcgccttctccgccctccgcggccctgccgccgacagccctacccttcctgtcaggcacgcgtggcagggcgtctggtcc

SEQ ID NO: 102765 - DNA, 126 bp, Triticum aestivum
  Clone ID: PAT_TA_102765
ggttcctgagcttttgtgacctgagccatggctgccaagctgacccgcctccacagcctcagggagcgccttggtgccaccttctcctcccatcccaatgagctcattgcactcttttccaggtat

SEQ ID NO: 102766 - DNA, 289 bp, Triticum aestivum
  Clone ID: PAT_TA_102766
ccaaattcttgccacttaaatattcctgaagatcttactgcaatgttgcctttcttgatacacacaatacaacaatagtttctatgttgccaaggtacaagtataatttcctgatcttcaaacaccagttacactatattcatacaaaaagaatgtggcaagaatgacaaatcatgccaccaccggaaaaaaaaagaatgaaacaaacctttgaaaaaaagagaaaaaatgagcaaactgcagggaaaacctcaaaaccaagcgccatgattactcagggaactccatt

SEQ ID NO: 102767 - DNA, 425 bp, Triticum aestivum
  Clone ID: PAT_TA_102767
agcaacgacccaacttccatgctcaagaatagttagaagagagaaggtagagatagagataagagtgatcgggcactctagctagtaccccgaccaccacttatctcaccctgaccacctcttttgtacacacaagcacttgtacttccaagcttatatggaatactaacaggacgtaggatttgacgccacgatggcggcctgaacctatataaacctttctatgttcatgctctcctttgttatcttctatagttgattgacttggtgttttagcccctggccgaactaacaaatacggggtatccttaatcccggtgtttggagattgccttccggcacacctagtccagaatccgtttaattttgtccagatcacgtgtgactgaaacttgatgacggggcccgaatgcctctgtggtact

SEQ ID NO: 102768 - DNA, 416 bp, Triticum aestivum
  unsure (1)..(416): unsure at all n locations
  Clone ID: PAT_TA_102768
aggagacgagcatgtgggagctgcacatgcacaatgctatcgcacgatgatcaatgatgtgctgccacgtatattggatgacacaattcaactggaaataggcatgaaaatcaatcaaatatttccgaacattcctgatcagcagccaaggcccctccggcggcttaattgtgtggcgcagaagcaggatagggaaaatttatttgttcgtatggagaattggaataatattacgaaggctacgagggaggcaaggcatagtatctttagcatgatggttaatgctgtattaaatcagatcggcgcctcgagttcagacgctggcatttcttctcagaatcgcagtgagggcgatgatgtgaagatntgatacttgagagcttatcatgacatccttctcagctcgctcaggctgt

SEQ ID NO: 102769 - DNA, 353 bp, Triticum aestivum
  Clone ID: PAT_TA_102769
agccgtgaccaccacgcctttcggcaagggctcggtcggtttcctcttgattcttcctgttcccctctatccatccaatgcggcagtgaggagcttcacagcggagggagggaggagctcgccgtgcatggtttgacgtgttttctggtaccctgctagtgcgccgccgagatgggctgcgtcgcgtccaagaaggccgtcgtctctatcactccggcagtcgactcgtccggcgtgttccgtgaccgcgcgctggagcccgctgccgtctccgcctcctccctgcgcagctcggctgctgcagccgcggcggcgaggttggtggagaagaaggacgacgcggaggagacggg

SEQ ID NO: 102770 - DNA, 221 bp, Triticum aestivum
  Clone ID: PAT_TA_102770
agagcacgaggcagagctgatttgttcgacggcacgtcgtggcaggtggcaggacgactcgcctccttgccgtcatcgcagctcccgtctgtcctcgccgcgtctccgtcgattcccccgattttgaggatggtctgggcagtcctgagcacgctgttgctgctcctgcagcagaacgacagccacagcgtcgcgtccggggacagctctttgtccacttc

SEQ ID NO: 102771 - DNA, 329 bp, Triticum aestivum
  Clone ID: PAT_TA_102771
ggaattcggcacgagccgacccccacgcctccacatggggaagaggaggaagaaggcttagcgcgctacatctccgtcaaggcctacttcctgttcatcagcatgggagcgacgtggtaaatccatccacctggtcgctaaactacattacgctctgctactctgaattcgctccagagatcattgaatcatgcttttgggatggcaaccggagatgaggaacgggtatgtccatgattttttccagtgggtctgtgattgtggaaactgctggtatgtccatgctattcacgagctggcctgttgttgtgtaaactgctagatagtgt

SEQ ID NO: 102772 - DNA, 296 bp, Triticum aestivum
  Clone ID: PAT_TA_102772
aggcgtttatggtgctatgcatttgatctttccttctttacatgatctgagtttgaaattagttcagactatgtgagctgactactttgtgttctaccatatgaacttcagtagtgcattcataactagcaatgccggctattatacttcaataacatgattctgagctgctaacctgaaaaaggagaatatgctctttcctcattctttccactgtaatgttgcttttctcactgtattatagctgcatttccatgcaatactatataattgcctgtgtgtggcagaggggcacc

SEQ ID NO: 102773 - DNA, 239 bp, Triticum aestivum
  Clone ID: PAT_TA_102773
ctgcaggaattcggcacgaggattttttttttttttttttttttattcaaattgaaacgcacggaagggttcaagtaaagagcacgataaaagtacaactatgaagtgctatggagatgccattgatgctcaacaagatcatcttgaggttgcgtatgaaattctctgttctcgatgcttgtgtgcggaaatggatccccgtaaaagagaagccaacaaattttctttacatctttcta

SEQ ID NO: 102774 - DNA, 313 bp, Triticum aestivum
  Clone ID: PAT_TA_102774
aggtaagatgtatagtttagtggctctaattcattctgagatattcagcgtgccccttggtcacttgtttctcactattctaacaacgtgcgcagttttcttgctaaactcattccgttatctagctctgttcatgcctacatgttattgtagcttcattttaccatgagatttctaaagatttactacattcttactgtgtatccatcctaaggctttcctgctcgttattcttaaggcagactgcatttatacgtaagcaaagagaacacataatctatttatactaccaggttgctatactgaccacaaa

SEQ ID NO: 102775 - DNA, 390 bp, Triticum aestivum
  Clone ID: PAT_TA_102775
aagaaatctcaagcttagcacagcaccaatggcgtcggagcagaccttcatcatgatcaagcctgatggcgtccagaggggcctcatcggtgaggtcatcagccgcttcgagaagaagggcttctacctcaaaggtctgaagctccagaacgtggagaagtcgttcgccgagcagcactacgccgatctgtcctccaagcccttcttcgctgggctcgtggagtacattttctccggccctgtcgtcgctatggtctgggagggcaagagcgtcgtctccactggacgcaagataattggcgccaccaaccccctggcctctgagcccggcaccatccgtggtgactttgccgtcgacatcggcaggaacgtcatccatggaagcgactc

SEQ ID NO: 102776 - DNA, 282 bp, Triticum aestivum
  Clone ID: PAT_TA_102776
gcgattttgggctgctgctgtttctggaggaagaagcgtcaggccaaaacggcgccaagtagtcacagcgacgtgcttccgctgaggcacaggaaacacccctcggcgagcccggcacggaatcaacggctggaggagaataggatgggttccgagaaagatcttgacctcccgttcttcgatctagaggcgattctgactgcaacggatgacttcgaccctgtttttaagatcgggcaggggggatttggttccgtctatatgggaaaacttgaggatggg

SEQ ID NO: 102777 - DNA, 356 bp, Triticum aestivum
  Clone ID: PAT_TA_102777
agcccaaacctggtccggctcatgggttgctgcctggagacggaggtgcccatgttggtctacgagttcatccccagagggagccttcaggacgtgcttcacggaaacaaccaccctctcccactggaaacacgcctcgacattgccatcagctccgctgaggggctcgattacatgcactcgcagagccagatggtcctccatggtgatgtcaaatctggcaacatcctcatcgacgacagcttcacgcccaaggtgtcggactttgggacgtccaggctcatgtgcatcgacaaggaccacaccaactgggtggtcggggacagcagctacctcgaccccgtgtacatgaagac

SEQ ID NO: 102778 - DNA, 204 bp, Triticum aestivum
  Clone ID: PAT_TA_102778
gcacgagcctcgaggccgaggcgcgcgccgaggccatgaacaagtccaagcagcagcccaccaatccctcctccggctccggcgccggccgtggttctgccggcaagaagctcggccccaatgctcgcgctgggggcggtgctgctgggaagaagaattctggctctgggaaggatgactccgatggcgactccgggaaggagc

SEQ ID NO: 102779 - DNA, 392 bp, Triticum aestivum
  Clone ID: PAT_TA_102779
agcgaggaccgggcgacgccgccagcgcgaggacctagaggcgacgccgccggcgcgaggtcatggaggcgaagccccgtctttggttggtcgctgtggccgctccctcacggccccgccgacaccggcgcgaggtcctgacgacgctgacccgagatggaggccccgcctgcgcttggccgtagtggtgtaccaacgcagcaaggtatctcttcccctgcccccgtatcttccttccgtccctccctccctgctgttagttctgccggcggcggaccaactgctcgttgcagcaccttcacatatatatatccagttagggttgagcagtgaacacacctcatttagatattccagtactgaaattggtgggggacaaacactgacctctg

SEQ ID NO: 102780 - DNA, 324 bp, Triticum aestivum
  Clone ID: PAT_TA_102780
agggcagtgtagccgaggcgttggtggtgcacaatggttctctttgggccacaacgcctgaggtggcagctgcggaagagcagcagaccaagattccgaggaagggagccgtcatcaaagggaagatcaacaacgactcggttgacaagaatgatgacatcgacacggggttgtggtggcggcggcggcggcaacaacgacgacgaaaatacatcaacacgtggctacgatggtgacgaaggagatacatcaacacgtggctacgacggcgacgacgatgacgaagatacatcaacacatggctaccactactagggaaaacct

SEQ ID NO: 102781 - DNA, 323 bp, Triticum aestivum
  Clone ID: PAT_TA_102781
agggacctgcgcagcaagagcgacctcctcctgcgctgcaaccccgtgcaccgcgccgtgcccgtcctcatccacgacggccgccccgtctgcgagtcgcaggtcatcctccagtacatcgacgaggccttcgggcctcccgccctgctccccgccgacccgcacgagcgtgccgtggcaaggttttgggccgcatacttcgacggcgagctgggcgcgccgtgggaccgggcgctcagggccgggaccgaggaggagcgggccgcgtggatgcagacggtcgtggccgcggcggacgggctggaccgcgggctgggcgaatg

SEQ ID NO: 102782 - DNA, 394 bp, Triticum aestivum
  Clone ID: PAT_TA_102782
agcagcgctaagaagttctgcgaccgccggaggtatgtgtacctgctccccgtcttggcgctcgaccccagcgcacaccccgaccgcgaggctgtcaaggcaagcgcggggagtgagaaccaacttgcgaagtgcgtggagtgctccgagagggggaggaaggtgccagatattatgggccgggagggtaagttgcccgactctgaggaggagaaggttcttgatacgcccggagaggaaactgtggccgttcatggagaattgggggatgcaaaatctgttccagcaagctctgttactgaggcttgcgatagtgagactgggctgggaggtgatgggatcgctataccgagctctggtaatggaacaaaagctcaaaatgctgaactgggat

SEQ ID NO: 102783 - DNA, 353 bp, Triticum aestivum
  Clone ID: PAT_TA_102783
agctgcggcgaccggcccatcctccaccgcgacgtcaagtcgagcaacatcctgctcgacgaggccttcaagccgcgcatcgccgacttcgggctcgccaagatcctggacgccaacgccggcggcaagggcaagggcgagccgtggtcgtcgtcgggcggcgcggtggcgggcacggtggggtacatggcgccggagtacgcgtacacgcggaaggtgacggagaagagcgacgtgtacagcttcggcgtggtgctgatggagctggcgacggggcgcgcggcggtggcggacggcgaggacgtggtggagtgggcgtcgcggcggctggacggggccgggagcgggcggga

SEQ ID NO: 102784 - DNA, 159 bp, Triticum aestivum
  Clone ID: PAT_TA_102784
aggcgggatcttcctgcacactcgcacacatgttatgaccttggtgttgatgacatcctccctccacgctaccacaaactgaagcaaatggtggtggaggctaaggcagggtatgtggcagacaagaatgcactgaagttggccggtagtcatgctttt

SEQ ID NO: 102785 - DNA, 401 bp, Triticum aestivum
  Clone ID: PAT_TA_102785
agccggagctcgtggcgagcgatccggtattggcgttcaaggcggcgctgtggttctggatgacgccgcaggagcccaagccgtcgtgccacgacgtgatgctggggcggtacgtgcccaccgacgccgacaggcaggcgaaccgaacggcggggttcgggctcaccaccaacatcatcaacggcgggctcgagtgcaacctccctgccgattcgagggtgaaggataggatcgggtactaccgccggtactgtgagatcctcaaggtcgacgaccttggggacaacttggactgcgctcaacagctgccctactcgtaaccaacccataaacttgacactaatcagtctaggcactgctaatcaagctagagtgctagacatgcatgcaagtctcagtct

SEQ ID NO: 102786 - DNA, 318 bp, Triticum aestivum
  Clone ID: PAT_TA_102786
agcccctctcctcccccccgccgccgctccccagatccgctgccatgtcgacggagaagaagcagctgaaccccatgcgggacatcaaggtgcagaagctcgtcctcaacatctccgtcggcgagagcggagatcgcctcacccgcgcctccaaggtgctggagcagctgagcggacagtcacctgtgttctccaaggcgaggtacactgtcaggtcgttcggtatcaggcgtaatgagaagattgcgtgctacgtgactatcaggggtgagaaggcgatgcagctgctggagagtggcctgaaggtgaaggagtacg

SEQ ID NO: 102787 - DNA, 288 bp, Triticum aestivum
  Clone ID: PAT_TA_102787
agcggcaccgtcgagggcctccttggcagtctcgagagcgacagcccccgggtcgtggaggccgcgctgggagcgctgtgcacgctcgtcgacgaccgggtggacgtggagaggagcgtggccgtcctcgcggagctggacgcccctcggcgcgtgctcggggcgctgaggcagcacagggagaacgtgctgtggcagaagtgcttctgcatggtggacaagttcctggcgcacggcgacgaccggtgcgtgagggaggtgaccggggacagggtgctgccggcggcg

SEQ ID NO: 102788 - DNA, 159 bp, Triticum aestivum
  Clone ID: PAT_TA_102788
agcaacgccaagctctcggacttcggcctggcgaggaacggccccaccggcggcgacagccacatcaccacccgcgtcatgggcacctacggctacgcggcgccggagtacatcgcgacgggccacctgtacgttgaagagcgacgtgtacgggttcgg

SEQ ID NO: 102789 - DNA, 318 bp, Triticum aestivum
  Clone ID: PAT_TA_102789
agcggagccggccgcggagggggagcccagccaagccagccagcagtgaacaaccgtcccaaccaccgacgggcgggcatgagggccaccgagatgttgaccgccgcggcgggggctgccgccgggacgacgccctccacggcctcggtggccggcctggccggggccagcgggggcgtccccgccgcgggcgccggcgggaacttccccctcggcgccgccctcctcgccttcgccttcgccaacctcgtcaacgtcctctccatctggtaatgtatgatgcatcaggagttaggtttcacacaggccgccaagctg

SEQ ID NO: 102790 - DNA, 358 bp, Triticum aestivum
  Clone ID: PAT_TA_102790
agcagggaggagtgcactgcggcgtacgcggccggcgtgcgcgcgcagtacgccgggcggtggctgtgcggcctatgcggcgacgccgtgggcgaggagctcgccgcggctggcgccggcggaggaggatcggccacggcggaggtagaggcggcgatcgcgaggcatgcggccttctgccggtcgtcgcccgcagcggccgagcggctcatcgccgcggtgcggcggctgctccgcagccagagcgggaggaagccgaaggccgtggtggtgctcgagttccaggaggcctgaacctgaagcagatcgaagatctgttcgttcagaagctagcttaaaattctcttcatctacagta

SEQ ID NO: 102791 - DNA, 319 bp, Triticum aestivum
  Clone ID: PAT_TA_102791
gaatcggccgagcgccgccgtccttggaagcgatggcggcggcggcggcaggagtcgctggggagtcgtcggggacgaagacgaagaagcttaagattgctgtcatccaccccgaccttggaatcggtggtgctgagagattgatagttgacgcggcatgtcagcttgctgcccatgggcacgatgttcatgttttcacatcacaccatgacagaaatcggtgctttgaggaaacagtctctggtacattcccagttacagtatatggagatttcctgcctcgtcatgtgtcttaccgctttcatgctgtctgtgctta

SEQ ID NO: 102792 - DNA, 330 bp, Triticum aestivum
  Clone ID: PAT_TA_102792
agcggatcaggacaggacaacaagccccttcattgcctatccttgtggtcaatcgaagctgatccttccttgtttgcggctgtagtcgccgtggaaccccaaggccaaggcatacatcatgtctcgtgatccagttgatttaagtccaggtcagctacataagctagctgagttgatccaccgacaagaagtgcagaagcttcaagagcttaagttcgagtcatatgcttttcagcaaaagtatctcaaagatgcgaaagatgcccgtgataaggtgtaccatgtccttgaaagtgcacaggacatgatagcgcaaaccaaggatcctgc

SEQ ID NO: 102793 - DNA, 337 bp, Triticum aestivum
  Clone ID: PAT_TA_102793
aggctacaacttgaagctgcaacttgggcggtgccatggatccttgtgcagagaaaacaagacggggggaggtcagggaggagcagtaggaggagtgaaggaaaagaaggcggcggagaaggctctgctcaccggagagctcgatcggcggcgacgaactccgagccgcacgttctggtgacggagggctggaaccggtcgatggggagacctataggcgcgcgacggcgacggtttgggacggcggcgaagctgcaactcggacggcgccatggcttcctatgcagagaaaacgagatgagggggaggttagggaggagcagaaaaaaggcggcgg

SEQ ID NO: 102794 - DNA, 245 bp, Triticum aestivum
  Clone ID: PAT_TA_102794
agcgcacgccaccttacccgagaacctagccatggttgccaagccgccgccgcagcagcataatcagaagaagatcgaggcggaggcatggacgacgcgtccctcgagcacacgcccacctgggtcgtggccgccgtctgcttcgtcatcgtctccgtctccctcgccgccgagcgcttcctccactacctcggcaaggcattaaaacataagcagcagaaaacattgtattcgtccctacagag

SEQ ID NO: 102795 - DNA, 409 bp, Triticum aestivum
  Clone ID: PAT_TA_102795
ggctgcaggaattcggcacgagccgccggcgactggcggcggcgactggccgaggcgactggccgcgtccattagcggcggcgattggcgatgtcggccattagcggcggccattctgcttcatcctgttcccgaagtggcgcggttcgaaggagaggcgtcggcgggtcagctcggtcgcccgtcccatcgggagcagcccatggattacgagccgacgaagttctgcagcttgtgagggaggaaggctgcacggtggatctcatggagtccagcaaacccaggaaggaggtactattcgtgcgtggataaccagcatgggttcatcgaatggcatgaggggccgacgacaccatttatccgtgatttgttgggagatcttcgggacaaagtgtggatgaggctgctc

SEQ ID NO: 102796 - DNA, 357 bp, Triticum aestivum
  Clone ID: PAT_TA_102796
aggcggcctgaaccggccatggaggctgtgcacggtgacccaggtggaggagctcaagactctgctgcggctgatcccgatatggctcacctcggccgtctacttcgtcgccaacacgcaggcgcagaccacgttcgtgcagcagggcaccaagacggactcccacatcgcgggcggcgccgcgtccgtcccggccgcgtcgctgacgtccattgagacggtgctcgtcgccgcctacgtcacgctctacaacagggccgtcgtgccatccgtggcgttcacgccgctccagctcatggggctcgggcacgccacggcggccggggcggtggccgtggccgcgtgcaccgaggcgcg

SEQ ID NO: 102797 - DNA, 106 bp, Triticum aestivum
  Clone ID: PAT_TA_102797
actctgaaaggtgtgcatgagtcagggtcggttcctggcatggaacacactccgacgactggcggctggacggtaggattgtgacacacgtaggatcgggacctgc

SEQ ID NO: 102798 - DNA, 265 bp, Triticum aestivum
  Clone ID: PAT_TA_102798
agagagagagagagagagagagagagagagagacatgcatatatggatgcctctgttctgaatagacaatatttacttgaacctatatggtctgaataaagtttacgctgtcaatattttcccgtgacctaccaaggagaaaagaacttttagttaataccagtcgaattttggctgccgggtcaaccaatctcctcggttccgcttgccggtttacctgaaacctcgcatgctgtctcctgtaatctcctcgcttgcgttggcg

SEQ ID NO: 102799 - DNA, 270 bp, Triticum aestivum
  Clone ID: PAT_TA_102799
agagtcagtgagagggagagaggaaggtgcggtcgggagatcgaggcctaatgggagcggggcgaggcaggctgcggtgcggttagctggccaggccggctgtctcctcggccgcctggcctggctagcatgctgggaggggtttcttttttttttttgaattagacaggaaagaaaaacaataaatagagaaataaaatatacttttatataggacatatgtatatcaaaatgatcagagaaataaatcctacaagatgaatatttttc

SEQ ID NO: 102800 - DNA, 390 bp, Triticum aestivum
  Clone ID: PAT_TA_102800
agatcaaggcgttcatcatcgacatcttcactgccgggtcggacacgacagccaccaccgtggagtggatgctggcagatctgctcaaccacccggactgcctgcagaagctgcgggcggagctggatgccgtggtgggcaggtcccgggtggtgggcgagccggacgtggcccagatgccatacctgcaggcggtgctcaaggagaccctgcggctgcggccgccggcggtgttcgcgcagcgggaggcgatcgagcccatacacgtccgtgggtacaccatccctgtcaagacgtcggtcttcttcaacatcttctccatcgggcgcgacgcggcgtactgggaggagccgctcgagttccggccggagcggttcatgcccggcggcg

SEQ ID NO: 102801 - DNA, 289 bp, Triticum aestivum
  Clone ID: PAT_TA_102801
agatatccccacgagttcacgagctaatcactcgagatagtcgatagtcctcttcagctagctcattggtaacttgagctcagtgagggttgcactgacaaaaatgcaaggcctcacggcatcttgcaagatcgtgctcgtgatgtttctgctcggcttaggcttggcaggagccaccgccgacagccgtaggaggcacatctccagcagccctgacgagccctgcaagaagatgacgctctacctccacgacatcctctacaacggtgtcaacaacaccgccaacgcg

SEQ ID NO: 102802 - DNA, 328 bp, Triticum aestivum
  Clone ID: PAT_TA_102802
ggcacgaggaccgaacatattgtgagctcaactcgccgccgtacctacttcaccggcagcgagggagatgtggaggctgaaggtgtcggagggtggcgggccgtggttgcggtcggtgaacaacttccttggcagggcagtgtgggagttcgatcccgaccacggcacgccggaggagcgtgccgaggttgatagagtccgccgggagttcacccagcgccgcttccagaagagggatttacaggatcttcttatgcgcatgcagtacgcaaatcaaaagcaccttcaggcggatcttccggtcgtcaagcttgtagatagtggagaa

SEQ ID NO: 102803 - DNA, 356 bp, Triticum aestivum
  Clone ID: PAT_TA_102803
aggagatcaccaacaaggaggtatatcgtcgtaacctcccccgtcgtcccacctcccgatctcagatctgtgcgtgtgcgtctagggttccgaccgttcgcacgattttgcggccgtttttcctttttcggtcggagattaggggcgtgtggagaggggcctttgtgatctggttcatcccgcgggatgggtggaatcctaggggcgatttggttaggaaccacgaatgttccttgtatggtcttgtcatgggatgcttttgatcatgtcattgttctggtggaatggttgtgctgggtcgcttgttgcgcttgatcctgtgcatgggtgcgcttcagttttgtagtctgcgtgag

SEQ ID NO: 102804 - DNA, 240 bp, Triticum aestivum
  Clone ID: PAT_TA_102804
agaggacctctctcccacggcatagaatctagctagctcaagcagtgcatcgtcttaagctccgggacgaaggcagggatggcggggccactcagcgccacgcggcgcacgcgtccgacgccggcgcagtgcatcgcggcgacgctgttcgcgctgctcgtcgtcgtcgccatcatcgtcatcatctggctggcggtccggcccgggaagctgcacctctccgtcgaccacgcggcggtc

SEQ ID NO: 102805 - DNA, 298 bp, Triticum aestivum
  Clone ID: PAT_TA_102805
tgatgttcttgtctttgacaatgttgagaagaaagtatgtcatccattgggtaagtgtggaccggcatgcatccaccgaggaagcatacaaagatggcaggtctcgattgaagcggttgccgtctttagttcacaatgcaaatgtccccaagctctctccaggatttgtgaagctacatactcggcagttcggtacacccttgaacaaatcgaccatgacaagtgatgagtacaagggtgctgttatgcaggctattgagcatattctggccggtaatattttccagattgttttaag

SEQ ID NO: 102806 - DNA, 325 bp, Triticum aestivum
  Clone ID: PAT_TA_102806
gcacgaggagcccaagaggccctccgacaagcccctgcgtcttccccttcaggacgtgtacaagattggcggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaacgtcggcttcaacgtcaagaatgtggctgtctaggatctcaagcgtgggtacgtcgcttcaactccaaggacgaccctgccaaggaggctgccaacttcaccgccc

SEQ ID NO: 102807 - DNA, 317 bp, Triticum aestivum
  Clone ID: PAT_TA_102807
ttttttttttttttatgacggccctgctttataatgaaagcaaccagtagcaagaaataacaacaacagtacagtatgcaggaaattaattacaaacaaatcgaggctcactgagcaacctgtagggccatcattttgagccaacatgaacatactaggagagccatcatcatggccatgctttataacgaaagcaaccagtagcaactactccctatgtcaccatcttatattattggagacggagagagtattttcaacaacattatattgtgcaggaaatgaaatacaaacacacccataacatagcgcaggtg

SEQ ID NO: 102808 - DNA, 315 bp, Triticum aestivum
  Clone ID: PAT_TA_102808
agaatcatacaggttatgctgaaaccaccaagtgacatgccaatgtatgggaacattgaaaagtcacctcttgacttttcagaagtggatacaagacttccaatgctggtgtacatgtcacgtgagaaacgtccgggatatgatcacaacaagaaagcaggtgccatgaatgcattggtccgtgcatcagccatcatgtccaatggccccttcattcttaatctggactgtgatcactacgtttacaactcaaaggccctcagggagggcatgtgcttcatgatggaccgtggtggtgaccgactctgctatgtg

SEQ ID NO: 102809 - DNA, 131 bp, Triticum aestivum
  Clone ID: PAT_TA_102809
aatgctaacagcagctactggagatccgaagacgacgtgggcatggctgctggcctgggaggcgagacagagtctcacccttacgtctccttcaccataaacttagtctgagggtgttagatgtatataat

SEQ ID NO: 102810 - DNA, 305 bp, Triticum aestivum
  Clone ID: PAT_TA_102810
agccgagctcggcaatggcaaacgcttcgtcaggagctgggatccatgatgactgcaagctgaggttcgtggagctcaagtccaagaggatgcaccgcttcataacctacaggctggagaaccagaaggaggtcattgtggaccaaactggggagcgcgaggccacctatgaggacttcaccaagaccctgcctgagaacgactgccgattcgcagtgtttgacttcgacttcaccaccccggaggatgtgccaaagagcaggatcttctatatcttctggtctcctgacaccgcaaaggtgagg

SEQ ID NO: 102811 - DNA, 196 bp, Triticum aestivum
  Clone ID: PAT_TA_102811
agagaagcttccttgagaggagggcggcggctagcatgaaggatatggatccattggtcgaggggtggatgaagcaggtccgggacttgacctatgatttggaggattgcatcgacgattttgtgtgctcagatgccccaggtaacaccaacagtgtagctcagctgatcaaggtggtaacatggaggcgtcagta

SEQ ID NO: 102812 - DNA, 293 bp, Triticum aestivum
  Clone ID: PAT_TA_102812
aggttccagcccgccaaagagattccagcgtgccgccagcgttcacgcctctctcccctccccgccagccagccagccgccagaggaggaggaggggaaagtggatcgacgatgatgtggggaatagcagccgccgtggcgtccgcggccgccgtcgccgtggcctccggcgcggagctcctcgcgtgcgaccgcgccccgacgccgccgaccgccgccgcggtcgtcgtcggcagatgcgacgggttcctcttccgacagcgggaatcctcgtcgtcgagcggccgggacga

SEQ ID NO: 102813 - DNA, 284 bp, Triticum aestivum
  Clone ID: PAT_TA_102813
agggatgcttggtcgcggaccgaggacccctgcagcgttcgggggaacccagcccggccgcggcgatggcaaggccatgccgaacagggcgaagtacccggtccaggccgacgggagctgctgctgtggatacccgcggctgccgtggtctccgcgcccgccggagtcatagccacgaccgcggccgcgtccgcggccacacccacgggagcgatcaccatgcccatggcggccgccccccgcaccatgagcgccgcgagagccacgatcaggggcgcggtcac

SEQ ID NO: 102814 - DNA, 308 bp, Triticum aestivum
  Clone ID: PAT_TA_102814
aggggaccctatcgaattggtgcgtgtcgcccctctcccctgctcccgtcccagcaccgcgccgcggcagccctcaccggcgtcactgcgcgctccagctcgctgcccgaccacgacccgctcgccttctactgcctctcgggcctcgtcgacccccttcctcccgtccccggccctccttgccgtcgctcgccttcctctccgaaactccgacccgaccagcacctcctcctcctactcctccccgctgccctcctacggcggcgcgcttcgacggccaggtcaggaagccccgtggccggcgcctc

SEQ ID NO: 102815 - DNA, 313 bp, Triticum aestivum
  Clone ID: PAT_TA_102815
agcgacatcgtcgcccttggccgcacgcgacggcacgtttctgctaggcgggccgagctgggcggtgccgctgggccggcgggactcgacgacggcgagcctggcggaggcgaacgccgacctcccagggccgacgctgaacctcgaccagctcatccgcgcgttcgacaagaagcagctgaccccgcgcgacctcacggcgctctccggcgcgcacaccatcggcttctcgcagtgccagttcttccgcgaccacatctacaacggcaccaacatcgacccggccttcgcggcgctgcgccggcagacatgc

SEQ ID NO: 102816 - DNA, 366 bp, Triticum aestivum
  Clone ID: PAT_TA_102816
agaaacgccctcgttctccgagcctcccgcagtctcctgagtcctgatcctcttccaaaaataaacccaccctcgttctccaaaacggatcgaaggtccatcgtcgcctgcttccgctccgatgggtgccaggcgtccgtttgcttccactctgacgggtgccccaggcgttcctctgcttcctctgggatggcggatcagtcggcatgcaacgttcacagtggggcgccaagaattagatggacaagtcatctgtgaagcagcaggtagaaggctacctggcagtgcctccagggattcgctgtacaatacatgtcaccacagctatgtcgatgaagactcaaagtgatgctttcattatatcac

SEQ ID NO: 102817 - DNA, 429 bp, Triticum aestivum
  Clone ID: PAT_TA_102817
agccgagccattgctctggctaccgtgacaccgcgaggaagcctcgcgtcctgttaaggagcttattatctgcttcggtgccacactccccggtggttttcagatctgactgaaactgagattggtctcgatgtaatccgtatggttgatcccagtacaagcaggaccctaaggatttatcccctttttacactgactaaatgggaggttttggattcaactgtaattgtgatttgtgcgaaatttttggtatacattgaagcaaagctaacaaggatgaagtcaaacagctatacctccaatgctttgcttgatactgtgacagtagcaatagtccagaatgatattatttgtgcatccacttctttgattgctggaagcattgaggagggtatgtctggccagagcgccactttaccgtgatcatca

SEQ ID NO: 102818 - DNA, 389 bp, Triticum aestivum
  Clone ID: PAT_TA_102818
aggtcctctctcacaccctacacttatatcaggatggagtctggaggagtgattgctgaagcaggctgggactcgcttggcctgacgtcgcaggccgaggagtcggagatgatggagcagctgcttggcaccttcccctccaacggcgaggaagaacaccaggagctaccttggtctgttcaggccacacatgcatactatgcccactgtaacggtagctctaatgcatacagttccgctagtagcaacagtgttggtagtctcgtccttgatgtgccgtcggattatgggggcttctatttgggcgactcaaatgggatcggctcctgcaccgcagcacttgacctgaacatggttcaggagcaaggtgcggctcagtttatggatgc

SEQ ID NO: 102819 - DNA, 236 bp, Triticum aestivum
  Clone ID: PAT_TA_102819
taatcctttcatgtaatcaatcaaccaatcaatccaatcacggtgaatatatctttgatgagtgtgtgtagatgacacgatgatcacgtagggatcttctttatgtcagcattattagttagcaatgtcgtcgatgaatgtcgggtggtttcttttgcctctgccctctgaagaacaaaacagaacagatgttgtagtaagatgatgtacatgtatgaatgaatgtatcatcattc

SEQ ID NO: 102820 - DNA, 429 bp, Triticum aestivum
  unsure (1)..(429): unsure at all n locations
  Clone ID: PAT_TA_102820
gtttaacggcaagacacacttatctaacatagtgctcacaacttcccagcaaatgctgctcattgagtgcctcctccattcaatgaggaaaagttaactgcttgagaaaaagaagctgtgagttccccacatctactgaacatcgttttggttacttcgtttctcttcctgcagtttttgcatgggctgcggatgtgatgctttgtatgggaacaagactgatatgatttgggtttgctgcatgtacattcgacttagttgtactcgggaatgtttaagaaagtaatttgcaacaacgtggatgtcagatttatcaactactgtcactcttggttttgaaggatttgattatgggagtnttagtatgccctgaccaagtacaatagatgtagacaccattgtcgcttccttatttgtatgtgattcaga

SEQ ID NO: 102821 - DNA, 200 bp, Triticum aestivum
  Clone ID: PAT_TA_102821
tcctgctgctgcgcgcgccttagcctcgccctccctcggtcctggcggaggcctgggagcgctgtgccgcggcggaggctggtcctacgcggccatctggcgctccgaccgtcgcgacccacgtttgctaacgattggagagtgccactgcgaagatgaagcccgaaaagttgttgagaatatgcttaatcaagtccatg

SEQ ID NO: 102822 - DNA, 248 bp, Triticum aestivum
  unsure (1)..(248): unsure at all n locations
  Clone ID: PAT_TA_102822
ggtgcacgacgccgtggaggaagcaatcaaggaggatatcggtgttgtcgccggcctcctccgcgtcatgttccatgactgcttcccacagggctgtgatgcgtcgcttctactgtntgacaagttctggagcgagctgaacatgcctcagaacaatggaatcagaaggaacgcagtgtatctcattgagagcattcgcattaaggttcaagacgcctgcgggcccactgtctcctgcacggacatca

SEQ ID NO: 102823 - DNA, 334 bp, Triticum aestivum
  Clone ID: PAT_TA_102823
tgaatctaatgtcctggagcatacactacttgatgaaagcgtggagctaacgaatctgccgctaggacttttacaacacatcactgaggattttgctgatgcgcgacaaattggtcgtggtggattcggaatcgtttacaagggtgatcttcaaaacgggagcgttgctgttaaaagacttctgaacagccatacaatcgaagaggagtcattttatcgcgaggctactttcctgatcagtgttaaacacaaaaatatagtacggttactaggttactgtgccaatacagagagtaaagcgatgataaatccagaaccaggggaaacaccaaag

SEQ ID NO: 102824 - DNA, 405 bp, Triticum aestivum
  Clone ID: PAT_TA_102824
acgtgctcggcaagaagcgcaagggcgaggagaggcgcacctcccgctcccgctccgacgctatccacaagagggagaacaccctgctcaaggagttcgagcagagcgccaagtcgtcggtcttccatgaccggcgcatcggcgagagggacgagactctgcccgagtacgacaaggccatcctccgtcagcagcgagagcacatggcgaagttgaaacgagcaagcaaattcaatctgtccgatgaggaggatgacgaggattctcacacgcttttgggaaatgatgatttcaatgaagaggtgcctattggtgacgacagtgatgaagaacgtaacacgctctcaaagaagcgcctatctctccaaagtagtgatctcccttcagaaactgacctacctggag

SEQ ID NO: 102825 - DNA, 404 bp, Triticum aestivum
  Clone ID: PAT_TA_102825
agcgcatattggaactccctcgtcgcccgcctccctacgctaccgaactccctcctcctcgtcgccgcctccgatctcctccgccgcctcttggcggtacgcagacgacgacgccgccgccgccgccctgctctcccactccccatctacgatgacgccgcaagctccgcccgggtttctggtgagatgcccaaagcttttgccatcttagaagatatcgtgcagcatactttgtctgatttgcatagcattcagaagagcttactttattggaagtccaaagctgagggaacaaactcacataaaatgtactttatgatgtttgaaagaggtccaagggccttccttgaagcaacatgtcaaacactaactagactcaggagcaatgggagtccatccgagta

SEQ ID NO: 102826 - DNA, 281 bp, Triticum aestivum
  Clone ID: PAT_TA_102826
ccgagggacgggtctaattgagctcgtgttggtctactactttattgcctgcagtgatagtgtttccctattttacttatgaaggatatcattgatagaacctttcttctttcagtggcaaggaaaaggtactggacttcctatatgggctctgcaaatcttatgaaggtcaacatatggttgcttcttctgcggctggtgatacgcttagctctattaaggacaaggtgtatagcttagctgctgagactgcctgccctgttgatgattataaagcatgg

SEQ ID NO: 102827 - DNA, 408 bp, Triticum aestivum
  unsure (1)..(408): unsure at all n locations
  Clone ID: PAT_TA_102827
ggctactgcgcggaagggcctaaacggatgctcgtgtacgagtttgttgagaacggcaacttggagcagtggctgcacggggacgtcggccccgtcagcccgctgacatgggagatccgtctcaagatcgccatcgggacagccaaaggtattgcctacttgcacgaggggctggagcccaaggtggtgcaccgggacatcaagtccagcaacatccttctggacaagaaatggaaccccaaggtgtccgacttcggcatggccaaggtcctcggctccggctccagctacgtgacgacccgtgtgatgggcacgtncgggtacgtggccccggagtacgcgtcgacggggatgctgaacgagagcagcgacatctacagcttcggcgtgctgctgatggagctcatc

SEQ ID NO: 102828 - DNA, 299 bp, Triticum aestivum
  Clone ID: PAT_TA_102828
gtcattggcgtgtaactgcgatgaactctctgcatcagatgggtggtcaatttttgtggattcaaaagatgctagtagtaaggagcttgcaaagaaccagtcctttgatgctgttataatgacagctccactgtccaatgtccagaggatgaagttcacaaaaggtggagctccctttgtgctagactttcttcctaaggtggattatctgccattgtccctcatggtaacagcatttaagaaggaagacgtcaaaagacccctggaaggatttggggtcttgataccctttaaggaac

SEQ ID NO: 102829 - DNA, 417 bp, Triticum aestivum
  Clone ID: PAT_TA_102829
cttctgattactggaccagtggggtgtggaaaatcagccgcagtttttgcttgtgcgagagaacatgggttcaatgtaattgaggtaaatacatctgatatgagaaatggggcgtatgtaaagcaaaagtttgaggaagcaactaaatcacatggccttgaaaagtggtcacaagaggaggtcaccactccaccaagaatagattctttagatccagctttagagacacctgataggactgaatacaagcattcggtatcctgctctacaagaaaagcatctaacgatgatgagcatatgctacctgtattttgctactcaagttcaaagctgagtgatgaagcccctaaacaagttattaacaagacacttatcctatttgaggatgtggatactgtctttgatgaggatcgtgga

SEQ ID NO: 102830 - DNA, 428 bp, Triticum aestivum
  Clone ID: PAT_TA_102830
gaggacgagccggtgctcccagcgccaccaagcagaaggtggaggccgccaagcagtgcatcgagaaccactacaaggcgcagatgaggtcgctccaggagcgcaaggagagacgttggatgctggagaagaagcttgctgatgctgatgtatctgaagaggagcaaaacaatatcctgaaggatttagaaaaaaaggagacagaatacatgcgcctaaggaggcacaaaatgggtgttgatgattttgaattgctgaccattattgggagaggtgcttttggggaggtgagactttgtagagaaaaagctacgtccaatgtgtatgcaatgaattagctcaagaagtctgaaatgttacgaagaggccaggttgagcatgtgagagctgaaaggaacctccttgcagaagttgatagtgcttatata

SEQ ID NO: 102831 - DNA, 439 bp, Triticum aestivum
  Clone ID: PAT_TA_102831
gaaagaaggattatttgaagaaaagacaggaggctaatcagtttgattcaaatgggaatactgtggtaaatggtcagcatgcttctaagaagactaaactgttacatcaagcgccagatatttcattagaggctcttacaccagttggcccactggcttctccggcagcatcacaaatgagtaacatggtaaacccgacgaagattataaagatcatcactaatcgggatcgtggaagaaaaagtaaagcactgaagatgactactggccactctggtcctggaagtccatggtcaattttcgaggatcaggctcttgtggtgcttgtacatgatatgggtcaaaactgggaactagtgagcgacgcactgaatagcattgtccaactgaagtgtatatatagaaggcccgatgagtgtaaggaccgtcacaagcttct

SEQ ID NO: 102832 - DNA, 378 bp, Triticum aestivum
  Clone ID: PAT_TA_102832
agtttgactttaaaaattatttcatttctgcagttccatatagcccaaagtaatgcgcatactcctatccggatatgtcccgcatagtttggttccactccatttagccacctctcaaatagagatcttttacagtaccccgaaataaatatagaccgtacatttctctcgatccagtggacagtattgcttggtactccatcactcatccaacggagtactaagttaaaaagtactggagtaccttgatataaggggcaaaaccgtaatcatatataacattctaatattatttcatattcgtggttcccctcataacctcccatgtattctggcgtcttttttttcaattacaagcaaaacgtagtatattgatat

SEQ ID NO: 102833 - DNA, 431 bp, Triticum aestivum
  Clone ID: PAT_TA_102833
gcaatcccccctctatctttctccagcgcggccgactggctctcagataccggcggcgctcagggtacttctcctcgccggctgttcttggggcacaggcggcgctcagggtacttctcctcgccggctggttcttggggcacaggcggcgctcagggtacttctcctcgccggctggttcttggggcacaggcggcgctaaggacgcgggagcatccatccacatcaggaattcagccccaaattagccagttctctttgttgatatccacgatttggcttctgatttacaaacatggcttgttgccttatgtgtagaaaggacatcaaacagactattgaaggtgaagaagttccaggaggaaataaggtgaaagctttttcttacagtgagctgagaaaagccacacatgattttagtggagccaaca

SEQ ID NO: 102834 - DNA, 190 bp, Triticum aestivum
  Clone ID: PAT_TA_102834
cgaggaaaggcactccgtttcctcgacggagcacttccagatgctaaatacgatgagatctgccatatgatgatgagtgtgccatctgccggggaccaatggctcgagctaaaaagttgccttgcaaccatctatttcatctaccttgcttgcgatcttggttggatcaaggattaatggagggttactc

SEQ ID NO: 102835 - DNA, 367 bp, Triticum aestivum
  Clone ID: PAT_TA_102835
ctcctctctggttgcggtggccaagaagctgcaatccggagggcttcaactaattgtggtccaatgatttctcattatcagctgctttacgagcttgcattgtcattaagtcaaagggaacctaaggatctccatactcttccaagaagctctcgattaagggataagaagaagaaggatgaaggagatacaatggtgaaagaaaaatttgttggaagtgtgattgaaaataacaatttgcttagtatccttctggataagagttcttgtataattgttcctgagactccatttcctcctacatcctttcctacgatgatggaacctgaactcactgttaaacaaagtttgacgggtggtcactgta

SEQ ID NO: 102836 - DNA, 384 bp, Triticum aestivum
  Clone ID: PAT_TA_102836
ggcgggagcggatcagcgagcggatgaggtacctgcaggagctggtgcccggctgcgacaaggtcaccggcaaggccggcatgctcgacgagatcatcaactacgtccagtccctgcagaagcaggtcgagttcctgtccatgaagatcgccgcctccaacccggtggtgaacttcaacatcgtcgacgacctcttcggcggcaggcggatgaaccaggcgtgcggccccgcggcggccctgcccgccatgacgctgccgatgcaccaggggcagctggacccgtcctgccttcagatgagcagcgctaccatgcagcatatgcaacagccggctgctgggttcgggctggacatgctcgtcagcaactcatacccggcggcgc

SEQ ID NO: 102837 - DNA, 820 bp, Triticum aestivum
  unsure (1)..(820): unsure at all n locations
  Clone ID: PAT_TA_102837
cgatgacaagagtncacatgannaaacaaatggcacagnangtncagttccgcacacacaacaaattggggatatgaaaataacggtaacaaaagacaaagcagatgcaagttctaagtcagatgttaagttagatggaagtcaggctccaggagtatcttttgatgagcttgctaagaggaacctgctgaagggaatcactgctgatgagagtgcaacagtacatgatactgctactcttggtgtggttgttgtgaagcattgtgggtatacagctgttgtccaagttccgttggatgctcaactgacaaccgttgttccagcgcagcaggacattcacattgaagaccagccggagggaggtagcaatgctctcaacgtcaacagcttaaggatgctgcttcagaagtcatgtgttcagtcacctggagcagttaagcggttgccagtctgatcctgaagagaacgaggctccacaaattttgtccggaaaataattacagatagcatgcagaatcttgaaggngaggcttcaagagaaacaagaccaatcagatgggagcttggtgcttgctgggtacagcattacagaataaacttntgagaaggctgatggtaaaaaagcacagtctaaggatgttctacagtaaaaggcctgggaaaacaattggtcagttaaggngataagaaaaagtanatgcaagagnggaagagngcgtcccaaaaatgtanttgcaaatcaacgtgcnctttancacctgccgcacaaagggggaaaaaggnttttgnaaaagnctacanagttnttcaaaataaaaat

SEQ ID NO: 102838 - DNA, 793 bp, Triticum aestivum
  unsure (1)..(793): unsure at all n locations
  Clone ID: PAT_TA_102838
ctccgacgaacggaaccaacaaatcccccagccgatctcgtctccggtcgactccagctccccctcctccggtcctcccccaccgccccaagatgcagatctttgtgaagacattgacaggcaagaccatcacccttgaggtggagtcgtctgacaccattgacaacgtcaaggcaaaaatccaggacaaggagggcatccccccggaccagcagcgcctcatcttcgctggcaagcagctggaggacggcaggacccttgctgactacaacatccagaaggagtccaccctccaccttgtcctccgccttcggggaggcatgcagatctttgtcaagaccctcactggcaagacaattacacttgaggtggagtcgtctgacaccatcgacaatgtcaaggcgaaagatccaggacaaggagggcatccccccggaccagcagcgctcatctttgntggcaagcagcttgaggacggnaggacccttgctgctacaacatccanaaggagtccaccctcaccttgtcttcgcttngggaggatgcagatntttgtaagaccttactggcagacatancttgaggggagtcttggcaccatnacaacgtnaggggaaaatcaggacaggaggnatcccccggacancaggcttattttnttggaagaatttgggaggcgaccntnttgataaaatcanaagggtcnccttccttgcctcgtttnggggggtgaaattttggaaacctctgnaaacatnccttnggggngcctnggccntnnaactangggaan

SEQ ID NO: 102839 - DNA, 754 bp, Triticum aestivum
  unsure (1)..(754): unsure at all n locations
  Clone ID: PAT_TA_102839
gagaagcaacacggncactactgctccgcgtcgggccgagcttgccaccgccgccgctctccccgtcgtgctcgttcctcaccaccggccctcgggttgtggaggggcaacgggtagcggtggaagaggagatcgaccaccaactgctgccgccgtcctctgcttcgccatcaacgggaggaggaccggagcgtgtctcaagttcgtgctcctccgggaagagggcaaaccgagagacgagcacgcgatgcgttgctcttctggtgggcttctgacgatttgaatctcagagccaggcaagtgtgggaacaaggagatgagtttcgtggagacggtgagcaggacggaacaaggatggcgacttgatgctcttganaactccttggaggggatttttttntggccttttgttactatatatnatnggatcccaatgcactgtattcggnnggnngtnaactntgnaaggttgtnaagggnnatatancnctactaattaggtaatgaaangttaattgtggacngggccntgggattnaggtatgaatggggngttnggntgntganntttaattnnactaaacttnnttaaaacggnaatggaataaactgtttttnttangaattcgagggggatttttntnttgggantgtgatnggngtangattggnaacgancatannttggttgtttntgaaaggannattggttnaggaantnntttggnnnnncganggnnttggtgntnantnn

SEQ ID NO: 102840 - DNA, 750 bp, Triticum aestivum
  unsure (1)..(750): unsure at all n locations
  Clone ID: PAT_TA_102840
gtcccctgaggtcattgtagccgctggtctgccctgttgtagattggtgcaacatcctggtgaatttgtggtgacgttcccaagggcctaccatgtcgggtttagccatggatttaattgtggagaagctgccaactttgcaactccccagtggctgaagtttgccaaagaggccgcagttcgaagagctgtgatgaattatcttccaatgctttctcatcaacagctactgtatttgctagcagnttcctttatatccagaacccccagagaattattgtatggaattcgaacctctcgtttgagagatcggagaaaagaagaaagggaactactagtcaaacgggagtcttacaagatatgantagtgaaaatgaacttttgtgtgcttttctcaagaagaaaataattgaaaatgctgtctatnggagcctgcctgntggcatcttntactgnttacattnctgctcctctggccaaactctttgaaggtgaggatgttacagatcaagttgtcccaaaagaacagtatntgtgatntgattaaantgggaacacctaatgcatggntttggcanaaatattgtgcntgttgttgccngggcaaactgactgcctngagangggcctctttnttgncatgattggtatgnccggggntggggaantgttcntttggattnacctcaaaaatggaaaatnctntttttaagataannattgaaaaaactnannntcntttctngngnt

SEQ ID NO: 102841 - DNA, 784 bp, Triticum aestivum
  unsure (1)..(784): unsure at all n locations
  Clone ID: PAT_TA_102841
gtctcctcctgctgaggccgggggaagcagacgcggcgtcagaaagcgcgacccgcggctggtgtgcccgaactacctagcggggattgtgccctgcgcgtgccccgagttggatgagatggcggcagccgcggaggtcgaggaggttgccgcggaggcgcttgccggccctaggaagaagcccagggctgccagccggggtagcagcggggctgtagtcaaaattggtggtgctggtggtggcaagtggagtggctggccgtgggggagcagcagaaatgaggtgccaagtgccgggttgtgaggcggatatacgggagctgaaagggtaccacaagcggcaccgggtgtgtcttgcgttgcgcgcattcttttgccgtcatgatcacggcgtncagaagcgctctgcaacagtgcggcaaattcatatattattanattttgatgaaacaaaaggagttgtanaanaaactggagaggcatacaaaagagacgaaggaaacctgattaaaaggccattggaaaagaatagataacaattgatttttcactgatggtagcgcaacggtgaaataaganaaaanaattaaatggcctactgtgnatcttgaaattgtnttacacaaagtttaaaaganaaaccgggggattgaanatccttantntcaacttgaccaactaanttgaaaataccaataaantaggntttgagtttgtnaancccttgncaanagaaagtaantacaattcgggatgannaaagntttttctntcccaaggacct

SEQ ID NO: 102842 - DNA, 791 bp, Triticum aestivum
  unsure (1)..(791): unsure at all n locations
  Clone ID: PAT_TA_102842
tgctcctccgagctctctctctctcttctcttctcctcccgcccgtgtccgcgtcctccgcgggaatcttccaggcatgaggagcggcagagtccctggacgaggaggcggtggcggtggtggtggggagaccgccgcgctcctgtgcggcctcctgctcttgctcggcgccgccgacgcgcagggcatccggcgcccctcttcctacaaaaccctacgaggtgatgctccccttgtgatcgccaaaggtggattttcaggagtatttcctgattccagttatggcgccttttctttcgcattggttgctagtgcacctgatacaagtctgtggtgtgatgtgcaactcacaaaggatggngttggaatttgccttcgggatataaatatgtcaaactgcactaatgctgcacaagtctaccctgcgaaaaataaaaaggaggcaaaatatgttattgatgggcgtgccaaaaactggatacttctctntggacttaccttgctgagattaaacgacttttttttaacacaaggaatttattctcgcactgaaagggttgaaccatgnattctatctttccgggacagntttnagncaagngtacnccgctttcgttgggtgaatgtcacgggaatatttataacaacanggttgacatgaaagtcatagtttcatctaaaaagggccggcaagatattaataccgngtgggttcccaaaggatattaaaaaactggggganaaaaagtgggttgtttctgaaaatttttcnactttaaaacaaataaang

SEQ ID NO: 102843 - DNA, 797 bp, Triticum aestivum
  unsure (1)..(797): unsure at all n locations
  Clone ID: PAT_TA_102843
attatcattgacatgcaattaatgtattttcacaagatactctcttggttaactgcgaatagcattagctgccaactgctagcgctaggttgtgggtagattagatgattcggttatctgagcagctgctgaactgtcgaaccgtgtgtttttatcaccggaacttctgcgagccatgtttctcgcatcccatttgttctgtgcattcctccgatatatgtgatgtgcaacttctataataattctttgaagaggaatgcttgctttggtcaagactgacgtatgaggtcccctgagttgtacttacatgcattatttttgtggtagaattacacatcatttttgnggtaacgttcatttttactaattttgtagtcagactttggcgagctatcaagattttacttttagtcacagagacaggcttcanatgttatctaccttggaaggngattttggtgncttcagctggtatgaatgagcatgtgccaggtcagttagtgataataacacacgcgcangtggagcatgcatagtncccaagtcatgagctaatgatattattatagaggtttcatatttatcaanaggatgatgaanctggcaaggnttatccaaactaataactttgctcaaactgggaagngaagnnaggtttcaaaatgncnnntttagggcccgtgattcnangttcnnaaaannntccaatggntggnnnnnntggggtataacaaacacannnccggacctatttaccnnnggnnnaaacntggnntntaaanaannnncctntnttg

SEQ ID NO: 102844 - DNA, 781 bp, Triticum aestivum
  unsure (1)..(781): unsure at all n locations
  Clone ID: PAT_TA_102844
ccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttcaggcgcccactggcgacggcacccacgaggccgtcctcagctcatacgagtaccgtcagccagggactaagaaagtcgacttcgacaacaccatgggaggcttctacatcgctcctgctttcatggacaagcttgggtgtccatctcttcaagaacttatgaccctggccaaatcaaagatcccactcattttgggtattggggaggaangggtcaaggaaaatcttccagtgtgagcttggcttcgcaagatgggcatcaaccaatatgattaatgccggnantggaaaagtggcaacgccgganagccagccagctcatagcancgnaccgngaggntgaacatgacagaagggaanatgtgctgctnttataaaanatttnccccggcgggtaggatgggcggacacacancaccgtnacaacagatggggacgccccctatgacatgccgtgcccaccaagngcngttcagctgtcacaaggggggaccccggggccatnnnnnntgnaacaatttnnnnggcccccttnnccgggggggngggaantatgg

SEQ ID NO: 102845 - DNA, 758 bp, Triticum aestivum
  unsure (1)..(758): unsure at all n locations
  Clone ID: PAT_TA_102845
gggagcgacggcgggatggcgagcgtgtacataccggtgcaggggacggaggaggaggtgcgggtggcgctggaccacctccccgccgacgcctccgacatcctcgacatcctcaaggccgagcaagctccgctccacctctggctcatcatcgcgagagaatacttcaagcaagggaagctcgaacagttccgacagattttagaggaaggatctggcccagaaatcgatgattattatgctgatgtgaagtatgagcggatagccatccttaatgctttgggtgcttttcatactttcttgggaaaggctgagaaagcaccacagaaggaagtgcatttcaaagatgcactcagtactacaatagggcgtcgaggatagatgaaactgaaccttntcatggatggaagaggcaacttttcgtgccaagggtgagttgcaaatgggatctgactcattaanattgtttggatgangatggggataatttnccanccttnttggcagggcttntgttatttctggngggngacacggacacacccaaaaagnttggaatggtntaaaactcctaaacttttaaanactttngggattncaatggccgcnnttgaagntggatactttttnnaacaaattggnantaaaaggccccaagtttttnnatttacnnnggcctnaacttngcctnnacctcnnactggtttnaaaaaaaantggnaatncaggggngggaaannaaanctttaatttctttt

SEQ ID NO: 102846 - DNA, 779 bp, Triticum aestivum
  unsure (1)..(779): unsure at all n locations
  Clone ID: PAT_TA_102846
gctgaacctaatcaagatttgcctgaggcaacacatacgggtttatctccagtgggtggaatggcgaaagggaaggacctcgctggtacatccggtgacaaatcattgtctgaagtagagcatctgttaatgcggaaaacgttcaccaggaaagaatatgcatattttgtgcttcttgaacttccagttttctactccctctgtaaacgctcttatattgatttacagagggagtactactttttttttttctctcggtaagtatcaaaatatgttaattgttagctgccatggtgaattctgatcccctagtattaatggatgatgtatgccttttgatgccaacttgcttcagaacacagtatatattaatccaagttatttctcatttttttgtttcgcgttccattattttggactgaacattgncactacctgatatcctctgcacattatctcttttcctcctgnttttgacctggtcttgacgatgggatctttgttaaggttgagttgatcgctncaaacttntgngtgcaaaactgtaaagccgctttgctgccaagtgaccncctgnggatanaatgaacaagacccgaattgtggatngaggtccatntatggganggttagacattctccnccgtggtgtctatccggatggtaagnccctnggcctgccanaaatatactcccgtntcggaaactccangagnnntagggccagcctttggacaaagggaaaacacctggtntatggntntgggcncattgtaagn

SEQ ID NO: 102847 - DNA, 771 bp, Triticum aestivum
  unsure (1)..(771): unsure at all n locations
  Clone ID: PAT_TA_102847
gccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttcaggcgcccactggcgacggcacccacgaggccgtcctcagctcatacgagtacgtcagccagggactcaagaaagtcgacttcgacacaccatggggagggcttntacatcgntcttgttttcatggacaagcttgttgnccatntttcaaaaacttnatgaccctgccaaaattaaanatcccactntttgggntttggggngnaagggtnanggaaaanttccagngngagcttgtttcccaaatggcttnaccaatttgatnagtgccggaantgnaaaggggaacccggaaaccanccagntataggangggnccgngggntgaaatgataaaaggnaanaagggtgcttttataaaaatttgcnccgngcggnnggatggnggacccacannaccgnanaacaatggngacgcccctttgaaattgcnngcccncatggnngtccngnttncaaaggggggaacccgggccctnnnnnntggaannttttnntncccccttnnccgggggggggggn

SEQ ID NO: 102848 - DNA, 789 bp, Triticum aestivum
  unsure (1)..(789): unsure at all n locations
  Clone ID: PAT_TA_102848
atcaccagtggtgttatcagttgcactatcaacaagataaggctagttctgctcacatgggtgcattaattatttaatataaagcatctactgttgttatatctgtagccttaactgttatcttgcctttagaagcagtattgtcatggtagttttcttagtagctgattttcttccttatatatttgctcagtttactttcagtaaaagaacaacattagcagcatgtaatgaaacatgcaatccaaaaaaaaaaggacagaataaaagcaaataagagttcttgtatgctaagaaaggcccctgctccagtgccaattaatccgtgttgcctgtaaggatgagtagcagagattacttgcattgcatgaactcatgttggctaaaggggtggttggattggttgntatagactcatagttcgatgcttgnaccgctcttgcacatcactttttagactaggcaacagtttccaagattgatggttgncgggaatgcgcncttacattgattgatgctttttanactaggcancagtttccaaaatttattgttgncgaataggcgcncttgcattgattgatatanactctttacagctttagggaaagtnaacttggttaaaaaaantttaaagggtttttcggaaacaaattnnntttggncnccaaactantgggncctgnccccttttggggggaaacatacngnaaaannccngcnnatttcnttggtnccnnnnnantntngnaaaannnnngnnnggggnggnnannccaaccncnccng

SEQ ID NO: 102849 - DNA, 796 bp, Triticum aestivum
  unsure (1)..(796): unsure at all n locations
  Clone ID: PAT_TA_102849
gagctcccgaagccagccgacgctctcgccgcgagggttttgccgtcgacctcgccgcccaatcctccccccttggtcaccgtcgttcccgcccagcttccccccttccggctggcgccgcccttcctggttcgtcggctcctccgagcgcctgccgggtcttgagactgcccaagttgtgcagctgagatagtgaatggaggatctcccagagccactgcttgcagagatcgtcaagaggattaccaagacaagtgatcttaattctctttcctcgtgtcgaagcagctctgcaccgttgaggcggagcacagggatgctatccgtgttggctgtggactcaacccttctacagaagccttgtatcgttgttctcccggtccccaatttggcgaaagtagagataaactattcggatggtggcccagtaacgggaaccaagttgaacaaccaagcctctgngttctatcatctactgccctactgnccgatttttttaagctttgctttacattggngacctggcttgggtattagctgatgnaaaaattgagttcgntangctgactgngcacaacagtaactttatgggatttttcggggggggtggtgnaggcatttttggttnttaccttgtgattgntggnanaaacanagggngggntggannccttgganaatggntattggnaaaattntnnaaggatnggnnggaanncccnntnncctttaanntngcccngngggaaaanncaaaattnnnttgaannangaantnnggngnngggcnnccccn

SEQ ID NO: 102850 - DNA, 794 bp, Triticum aestivum
  unsure (1)..(794): unsure at all n locations
  Clone ID: PAT_TA_102850
ccctcccattctttctttgnttcttcctttctttcttttttttctctttctttccttcttcccatcctgatctggagcaatggcgacggaagacgaagcgcgagaagcggcagatggggaggaagttcaagtggaagctggggatctggggacaacacatttgcaaatgaacctagatagcaagctttcatctcatgcagagatgaaggacgaggcaagagccatggattcaactgaaggaatgaaggtttcagaggatcaagttttagaaagagcaccctctgtagtcgaaattcctcaagaagatgctccaaatggtacacatgcttctctgaatggtcatatgaaagaagggaagatctcgaatgagaagccacaagaaaatggtcagaaaggtaacgagcaggtagaagctttgccagatggaataagccccgatcggagcagcacaagtaatggcgaagaggcaattgattctttagaccatgttgagaacctacagaaaggaccaccttctaaaacatgataatgaagagccaaggacattgcacgagatgtanaangngctgcatanaaaccaaatggngcacaaagacccctgcanctgacatgatgttgagccacaatgacctcacaaggcncattggaccagcnaatactgggcncncaccccancttcctgtttctgngaaaattnacttaacnccgtgggncaacttttgggctaagggtgaccgccccttcggtaaaggnggacccaaacgtgncccntaaggtaannacnccaaaanaan

SEQ ID NO: 102851 - DNA, 755 bp, Triticum aestivum
  unsure (1)..(755): unsure at all n locations
  Clone ID: PAT_TA_102851
gcaatggatcaagcttgtgcgtgacttggcatacgacattgatgactgcatcgaccgcttcatgcaccgcgtgtcgatggcgcccgtgaccgacgcgggctggatacgtcggaaggctcgccggctgaagacgttgcggcccgtggcaagtttgccgcggagattgttcgtctcaggaagcaatcagaagatgcgtccgagctgagaaagaagtacaccgatctagcatatggacaaggcaagccgcaccgccgccgtctntgagccacaggaagatgaggaagtgccggagacatacacagatagccccgtgggtatggaggcgcttgaggaggagctcacggagctgataagtgaaacgccgcaaggccaacccgagaggctaaggngatctccgncgtggcttcgatggtatcggaaagtctcaacttgcaaacgtgtgtatacacacttgcaagagccaatcccacacganttgggttcggctgcaaanaaagggccanaaaatgtctctaaaatctggaaaacttggaaccctccgcattacggaagtgaacagctcaggacataaaccannttttacttnccaacatcnaaaggcttnaaaaaangtntnnttaatgatactcgaaaantttggncataaaatctttctttgtccgngggggtttatanaggnngnacatnaanaaaannnnnnnngnntttttnannaatttccnanttaaaaatnttnnggantgtgggnnnnnann

SEQ ID NO: 102852 - DNA, 803 bp, Triticum aestivum
  unsure (1)..(803): unsure at all n locations
  Clone ID: PAT_TA_102852
agaataatgatttattatcctaattctgctggtggtggaatgaaagaactattccgtaaggttggtaaccgatctagtgaatttcatcctgatgtcaggagagttaggcgtgagggatcttacatttacgaggaattcatgcctaccggtgggacagatgtgaaagtttacacagttggcccaggatatgcgcatgccgaggcacgcaaatcaccagttgttgatggtgttgttatgaggaatcctgacgggaaagaagtacgctatcctgttcttttaacccctatggagaaacaaatggcaagagatgtctgcaatgcttttagacagatggtttggnggtttttgatctcttaaggtgcgatggaagatnataccgtttgggatgttaatggatggagctttgtaaaaaactttaccaagtattatgacgatgctgcatgcatatgcgaaaaatatttcttgatgcaaaagctcctcattttcatnaccattcctccacccttcttggaaatctaaagcaccagaaggccttacacaaggggaagnggggataattggtcattcggtcatcanaaaactnctgngtcnnttgttgngatccctgggggatcggncncaaacanaaggngactgnaagttnagaggaaaactttcatttgatgttnaatcaaggnggaagcaaaactgaacaactgaaagncanncattccagnttntaatcccaaanacttgtcnccacttgtaggcnggaaangatnnntcttaaatttgnnntntnaaanttncangnaaacanctgg

SEQ ID NO: 102853 - DNA, 776 bp, Triticum aestivum
  unsure (1)..(776): unsure at all n locations
  Clone ID: PAT_TA_102853
cgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacacaccatgggaggcttctacatcgctcctgctttatggacaagcttgttgtccatctctccaagactttatgaccctgcccacatcaagatcccactcatttgggtatctggggaggaaggggtcaaggaaaatcttccagggtgagcttggcttcncaagatggcatnacccatctgattagtnccggaaantggaaagtggcaccccgaaaccagccaagctaataagcagngnaccgggaggntgaacatgatnanaagggaaaaagtgctgctttataacaatnttaccccgngcgggtngatgggggacacacatcaccnnaaacaaatggggacgcncctttgaaattgccgtgccccccaacggcantccagntttcaaaagnggaaacctnnggcctngnncntggaaaatttnaagtgcccccttttccggaggggnnggaanttanggtccccccnaaccgttgggttgagggtttcacn

SEQ ID NO: 102854 - DNA, 815 bp, Triticum aestivum
  unsure (1)..(815): unsure at all n locations
  Clone ID: PAT_TA_102854
gctccgacgaacggaaccaacaaatcccccagccgatctcgtctccggtcgactccagctccccctcctccggtcctcccccaccgccccaaggtacggcgattcccttcccctctccccgtaccgtccggatccacgtttccgtggtagttggaggattattgccgtcgaattttgcccggttatgctccgatctggggttgcgggaacgaagcttgttgtcccgatcaatcgctcatgttagatagctgaagcttcaagcgaattcgtaggaatatgcgtgtatatgaaatcgaggggttatgcctgtagatgtccgtgttctcccaaatctgttcgtcttcggagccaattcatgatgccgnctgatctcatatgcatgttttctctctatagggacgtccgttcctgcttgatagattcgtttaagtcttcatgatcgaatcaagtagtagctttgtggccagatccgcgctcgngatcatgtcttgtcgaccaggatcgnccttaaactccttatagcctangataggattgtggattggtttccttttaaagccaggnttattttnttanaaaatgataatatcccacagctttatgggcctaaataaaagatattggggatttntgnggacatgtntggnanttctnttaataaaataaggaaaaatactgntgccnttggttatttttttgggggaggggaaaagttncaaaaggntnnnnttntangnnngnngntngcnanannnngttnttanannnngnttcnccnnnnnntnntaannnntnnnangnaccnannnnnttgg

SEQ ID NO: 102855 - DNA, 813 bp, Triticum aestivum
  unsure (1)..(813): unsure at all n locations
  Clone ID: PAT_TA_102855
ctcatgcaaccgcatattcagcagcagcaatctttcttgcagccaacacagatgcaatctacacagcaatccatgatgcagatgtcatctggccttcaccctgtgcagtctaccgttccacagacacagccaatgtccaggcagtcagttactcagagtggtattcaacaaaatcaattgaattccgtacaacaatctgttccatcattactccagcaacctcagcaatctgttgggaggcagcaacaacaagcacagccgtccatgcatcaacagccttctctgcagcgtcagcagcccaatattcctttacagcagcagcagcagcagcagcaacagttgatgggacaacaaccaaatttagagcgaaatcagctaattggtcaacagaatggnggctgtggagatgcagcagcaacagaggctccagctcagtcaaataatctttgnatgtgcagcaaacacagcancagatgttgaccancagtctatgcctttgcatcagcacaacaattggctntcagccaactgtnaaggttacagcagcagcaacaaatcaacagcagcagcggatgcatatgctgcagatgaaagctnaacaaaccagcacacagcatctnaacantcacaatggggtttgtgcaccttagtcccaaacaacaatttaacaatngcacacatttatgtncagttcngtccagctatcaattcacagnaatngggtgcgnnnatctcntgccgaaaacttaacttaggngntgttttnacnaaaactggtaacaaagnttnttggccnggggcttaaaatttntt

SEQ ID NO: 102856 - DNA, 809 bp, Triticum aestivum
  unsure (1)..(809): unsure at all n locations
  Clone ID: PAT_TA_102856
cccacgcgtccgatcctgctaaataacatgtctgaagtatttaacagttggattttgccagccagagaacttcctatttactcgatggttgaaaacataaacagcaagatcacagcaaggatatacagcaagcagatggaagttgcagaagataggaaatggagtatgagattgtgcccaaaaattcagaaaaaattggacaagtacactgattgggctgcaaactgcatggtctttggagctggtcagaaggttttcaaggttgtgtcaatgaaccactcctacatagtggacttggaaatggaaacctgtaactgcaagagatgggacttgtctggcattccatgtcaccatgctattgcttgtgctagaaatgagagaattgaccctgcaagcctagtgcatgattggtattcagtagggacatacaaaagggcttatgcttttaatgtaaaaccagtgaggaccaggaacattgactaagatgcatggcattgctgtatatcaccagtgtcactaaggnaatggggagaccaaggaggaatagaaagaaagatccaganganaagttgatgaaagaaggagggaaaaagttgacaaanatggggaaccatccctgttcctttggggaggnccgncccaccaggaanggcncagaagnggggggggccccanaaagctcctaacctnaatgtcnnatnnnaaaaaaaanntnnnnacctccatntttttannncnggccnanngncntccnnnnnggtcnannaaccccgggnntggttttttnnnnnaaangggggggannncct

SEQ ID NO: 102857 - DNA, 788 bp, Triticum aestivum
  unsure (1)..(788): unsure at all n locations
  Clone ID: PAT_TA_102857
cccttgtcgactcctgaaaggaaggcagtacactggatcggatgatggagctttgaacattgtgaaatatgacgatggaagggagttcatcgttgatctcgtgacagatcctggcacagttattccttcagagggtgctgttttgtctacagaatttgaagacagttcctactcagataatcatcagttaagcaaagctgatacggccaatcacttgggatcttctcacagtggagtctcaaattctgcatgtgattcctttgagtatgagctacttgacagaagatcgacatcaagcaacgttggtccttctgatacagatggagctgcgactagtcaaacaagaaatcaacaaaatacgataagttcttttgaaaatttatcggttagcacattcccaagtgaaaataaacctgcatcaatgaaagtagaggcacagaagaagccggtggcccaaagacaaagaaaaccagntggtgcaaataatttntgcaagtcaccttttnccaaaagtggcaacactacnggtttccggagatgaaagtaaaggattctcaaagtacatgattatgctgcngggaaatcccagttgcgcggaaatcatgaggcttacttgaaanggntagggcnccgctgcttgtttcaaaaatcaangngggcnaggattantgnggggagcccctnttcaanngggtaaatgaagggaatgaggggtggtcaggaaatnnnncgggnnggcccnnccgntnntgncngggnnaacnnaaaaannnnccnccggcctttgc

SEQ ID NO: 102858 - DNA, 754 bp, Triticum aestivum
  unsure (1)..(754): unsure at all n locations
  Clone ID: PAT_TA_102858
ctcgaactcgagcagggccagcgctagggttccagcgccgccgccgccggcccgttcctcgccgccgcgggacccactcccgccgcagcccaacttctccacggcccgtctgcacctctgcctctgcgcagccggggcaactggaagccgccgcgcgcccctctgcaccggcgccacggcgcgtccgtcccgaagctgcagatcatccagccctcactcctcacggttaagatgacttgtgcatagatcgagcttaagtctgatggattctgacgacaagaagtttggcaaaggacctagggagctactggtgctgttgatttaataagtcagtacaaattggagctgcaccatgatttcttttgcaagaggcctttgccacttgcaatctcagatcacattaccttcacaatgtagtgggggacactgaaattcggaaaggagaaggaatggagctagataactcgttagaatgcatacttaagggacaagtctgttntattaagccctttntatggaaacactgggnaagcatttaacttnganaactgttcagagattacctntgtgaaaaggatactacattcggcaaccgaaagnggtcaggcaagagaaaacttaagnncaagncanntnggcnggnnntanaagcaacttgctaggtngntaaaaaaacaggcaggtgaaaggtactttgnaaaaagactngggcgggnccgnnctcttaccaaaaagnnntaantnnaacgtgnng

SEQ ID NO: 102859 - DNA, 763 bp, Triticum aestivum
  unsure (1)..(763): unsure at all n locations
  Clone ID: PAT_TA_102859
tagaggctgtgtttgaacatacactttcaggaaacgaagcagcccctatgtcgactggaagtccatttggtgccatggcaagcctctttgcaccaaagctaccaggtggcttggctgcaagcctaactggtgaaagatcacctgccacagataaactaaaacctataaaaagggaaagacaggcagtcagacctcctgtagagcataaatggtctctgcctgaggttgatcaggttgccaagcctccagtgatttttcaacatgagttgattcagagtttctctatcaacatgttctgtaagatacccgcaaccaagttcgtacatacaaagatctgcgcagtgtctgatgaaacggatatttttatctgctctgcctttcgaatcaatacacgatacaagagctcaaatcctcctttacattnagttgactggatcacagngactcaggaagggaaggatgcactgtcctactntacagtaacagctgaccccaaattggaagagngcatcaaagttgtggtatgaggttcgggactaaaagttggggccaatgggaaaaagcccgtntntggtcctgtaaaaaaggacactgctttaagatgaanggtcctantgnactggctnatttggggggagccttgcctatgctggnaattnaggaataanttnttgggttccaaatgccccttaaagggaaaccnggggnaannntnatttttngctttganccanncnccttttnnttttgggggggncaaaag

SEQ ID NO: 102860 - DNA, 765 bp, Triticum aestivum
  unsure (1)..(765): unsure at all n locations
  Clone ID: PAT_TA_102860
ttgagaagcaccttgacctcgccacacaagccaccgctccttagccatcggtcgatggcctggccggtgcactgagttgaggaggaggaggtcgtacgttgatggatgcatctttcttcttgcctgttgtaaccaccactgcgatcgcatcatcgttgccttaattcttattttgctattgcattctcgttccagtcaatacagacatgtgcgatccctttgctcaatacagacatgttcgttctagtcttattttgattggcttgaatgaaggtctatcccatcgttaggcgccgcagcgcgctctgctcgcttccgtcggcgcgctcggcttgtggacagcttttccttgcgtgttcaactgctatatgcatatatatatatgggttgctcgccgttgaggcgaccgcggagcgctctgctcgcgtccttccgtgcgcgctctgcaacggtgggcgtcgcacgacatgtcggggccccctatcatcggttggccgcgcgcgttgcccncatcagtactgcacacatggagtaccccctgaaataaactgcatnaggcctgcgaattctgggcgncggtttccttaattccgggcctttaacctannttttancntttgangggcccaaaccaanagcncccccgtgaccttnangggttgnaacggctcaanggntngnngcttaagggaacaaccngggaacggtntttnggngnccnttncccgccgggggcaaananaaagntnnanttttntnaaaaan

SEQ ID NO: 102861 - DNA, 785 bp, Triticum aestivum
  unsure (1)..(785): unsure at all n locations
  Clone ID: PAT_TA_102861
aactttctcaaatgttctccagttattccccctcttcttcagatctgattaatttggcatgggtacgcatacaatcggaatgagtaagctgcaagccactgttcagcaaatccagggtatctttgaccagtgcttagctgttcatgataagctagagacatcattgcacgatttgtctaggaccggaggcgctaaatcttgcaaagcagctcataaagctgctgatgcacagtttaaggaattagtgaaagagctgaagcggctgttgttatctgtatagtcatcccctcagtcttatcagatatggccaaagctagagggcttggttgcgaaggagagggagatgcaggagaagctcatggcaaggcatgcgaccgggggttgacagctttgagaagaacaaccgtanatatttgttggaggccatgactccatgtcaagtgttcgctccatatgggggaagcttncatgtcaagatccctgtttggaagaaatgnggctaaantactcctgncactggatattcangccttctggtgacaagctntgcactgntgnatgggacctttttggnggcaaaatgnganctttctggggaanaancctttgacaaacaactcaccttgtgggttgnttattgtgggaagcatcncatgggngatggagtcattgctnntaccttcctcccataatantcntggnaaagaaccgcttattttncnntaaaagggtcttggcagtnntntcnaaccannaaccgtttttntgnngtggcttacnctcng

SEQ ID NO: 102862 - DNA, 799 bp, Triticum aestivum
  unsure (1)..(799): unsure at all n locations
  Clone ID: PAT_TA_102862
ctcaccgagccacacgcatgtcatggacccgttccacggcatactcatcgcggcggccatcctcgtgctgttcctcatcttcgtcgtcttcccgctcagcttcctccgctactactacttcagcaccggcgccgccgaggtgcccgcgccgaggggcgtcggcccggagctgctgggctcgctgccggtcacggtgtaccgcacggcggaccacgtcggggtggtggagtgcgcggtgtgcctggccgggctccaggacggggagcaggcgaggttcctgccctgctgcggcacgggttccacgccgggtgcatcagcgtgtggctggcgtcccgntcacctgccgtctgccgggtcacagtcatcggcaagattcccgacgcgcttaggccgacgaagtctcctccacactgcaggagccggcgaattacgccgggaacctgccggcgaagtgtgctgaactgctgatgctcgggatttnaaccaagccacgcttcgcgcggtgaccgtgaccttcgatggagaggcagntccgccttgaacggcagcgaacggtgttggtgattgatattccgggtcaaagtaaggatgngggcgacagtccaagtttcggcatgttcaagagntggggantttnnaggnaagaaccgnngggtcactaggctgttcggggannggattggaaaagnacaaannaanngggagantncttgnttggatgaaccgaagttcgggagnnaaaaaaaccggattgncngtnnccccaaaaaaaaatnnggcaantttnaatttgntgtgg

SEQ ID NO: 102863 - DNA, 788 bp, Triticum aestivum
  unsure (1)..(788): unsure at all n locations
  Clone ID: PAT_TA_102863
atcgcctccccacctagcaattcacgtgccatggccccagccgtgatggcatcgtccgccaccaccgtcgcgcccttccaggggctcaagtcgaccgccggcctccccgtcagccgccgctccggcagcgccggtctcagcagcgtcagcaatggcggaaggatcagatgcatgcaggtatgaacactaattacttcctcggtaatcttaatacaaaacagcaacacttattttgtatcggacagagtattatttttgcgaggtaggacgaacactaagctcacacgaatattcttgtcggcacagttgattaatttatcggatatttcactgtacatagccaaagctatcttaattaggatgtgtaacccacacaccaggccaaagtaaactaagatgggcatcacaatgtatgtagccgtaagcaggttacatgtgtaggaatatttaactcataaactttgtgaacggaaatgattttatcgaatgngactaaataatatcatttttaatgnccganactaccctgaacctgaagcaagactgttgcccttgaccttttggttggggagacccccacaatgttggcagacataagggtaattttgcttatggcaggtnttttttaacaccaagngtganaattgggtcattcattattagggggggcgatgnggcataaaaattnagacctgtttntgcccccttcangnggcctctaagaggnnntactgnccctcagggggcctctngtnaaaggngntttttcggncaaanncccgttttnt

SEQ ID NO: 102864 - DNA, 773 bp, Triticum aestivum
  unsure (1)..(773): unsure at all n locations
  Clone ID: PAT_TA_102864
cggacgcgtgggggnagcagtcattcatcantggatnaccancacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacgcacccacgaggccgtcctcactatacgagtacgtcagccagggactcaagaagtacgactttgacaacaccatgggaggcttctacatcctcctgctttcatggacaagcttggtgtccatctnttcaagaactttatgacctgcccaacatcaagatccactcatttgggtatctggggagcaagggtcaaggaaaatcttccaatgtgacttgtttcccaananggcatnacccaatcataatantgcccgaaactgaaaatggcaacccggaanccanccaactcatagcaagggtncggggggtgcaananaaaaaaaaggtanaagggctgcttttataacaanttacccgngggggtaganggggggaccccataacggnanaaccgtngggaccccn

SEQ ID NO: 102865 - DNA, 787 bp, Triticum aestivum
  unsure (1)..(787): unsure at all n locations
  Clone ID: PAT_TA_102865
ccagcgggcacttctgcgaggaatcccaatgcaacancagcatcactcatgtatggccgcacagagtcttcctcatgtaggcacattgctgccacagccacagcctggctcaagtctttttctgggtattcacctctaagaagagggtctactaactcatggtaccttctcctatctctgataatgggcattgcctgttgatcgaacatgaatttagctcaactgtctgaaagaaatcttgttgcaagcatctttttgaaataattcctaactaagcattctgtatggggaagaagtatatatatgaacagaagacgcatacccagttaaccaagatttgatcgcttgctggtttcgttgaatcgacagctttttttctgnggatcaactcaagtaggaatatcccaaaactgtcacatcaatcttgatagttagctggnctggttttatatattctggagcacagtacccatatgtgcccatcactcgagttgagacgtgcgtnttttcccacaggccaactttgcgagcccnaagtctgagagttangggttgnattcctcatnagaaggatgttggggnttganatcccggaanagancggngggtaaccttctatggnnggatcgagaccttacggttccggggctatttnatcttntatccactaagggattgacagaggggattggacacaccgtcactataagtttatccttanaacaagngtncggccttgaaggagttctgtgctggaaatacatgcnaaaaaggggtttcttntttt

SEQ ID NO: 102866 - DNA, 676 bp, Triticum aestivum
  unsure (1)..(676): unsure at all n locations
  Clone ID: PAT_TA_102866
ggcccatggctaancctagcatcagcccagacaggagcttgcacgagcgtaccgccgccactggataatcctccccgccggccgccgccacagactagagtcgcgtgatccattcatgttttttttcttcttcaatgactctggtccctgttcttgttacgaacggagtggacgatgcttggctggctggaacctagatgatcatttaggacttgaaaagaggcatggaggaaatangcaaccaatggggcagtattctgatctcatctacacatcctatatcatgctttgctttattacttggtattttatatattattattacatatacttgcccgatcgccgattgnttgnttnaaaaataccatatncccnataccgactcgatcggcgattcgtgcnccgatcatgcnccgatcggnnttataggncgncaatccttcnaaaagtgcaataactgtggttngttggttaggngacaggggatntcaaccacanggtnaatctgggntcgaatattctggttatttaggatttcaggatgcctttagnggagngacgtccnnnncantagcnctcgggatttnaaattnaaanaatnccggtnantttaaagnctatagagagggggggcggnntttangggagggnnccnnntttaancttnnttnntnag

SEQ ID NO: 102867 - DNA, 770 bp, Triticum aestivum
  unsure (1)..(770): unsure at all n locations
  Clone ID: PAT_TA_102867
gcagtctgaaacaggtggctnccattcttgnngaagagnttggatgcccttaaacatgcgaagacctctgcaattaggttggctatctccagtggaatatctaaagaccataatcacagaaagagtcccttttttattaattacagcagccatgatggactagagacaggacaaggaactcaaaaatcttcgagtggtggtggaaggctagttttgtggtctggtgacaaaggaaaggaacaattatatcctctcagtgatgaggaattaagaggaaacatgttggcaagaggtgaacatcacaatgtggagggagcatgactggaaaggctgtagctcctcatgataatttaaaagcaaacacatctgctgaatatgttgatagaagaggagtacaaataaggaagtgggttcaaattcatggagagtctgccacatacaacaaattgtccctataatattataccagggacattgatcatcaagggttgnttttgganccttcaaagcttnntttgcttcatcaacatataaaaggtnggggcaccataatcccctaccttgatgnttttttttcgctacnttcggaaanggagaacattggggggcaagaacccttcctnggtaaagggccctggaaaaatccttntttacnacagaattaanttccannattttcttttttccccctggtcatnggnaacnaagggggggnnnntcctaagggggnnaactcccnnanaaacttnnnnantnaaaaanannttttt

SEQ ID NO: 102868 - DNA, 752 bp, Triticum aestivum
  unsure (1)..(752): unsure at all n locations
  Clone ID: PAT_TA_102868
cccacgcgtccggtccccaggccgtctcngggnnggcaatttctccnaggacaaccgatccgggatcaaccactcttgcacaggatcagcgccatccgaaaccgcaaggctaacataatcggtctcacttccgtgtcgggcgagctatatctggcagcgcggagatgatccgtgatctggtggtggggggcggctccatattggtgattggacctcctggagtagggaagaccactctgatcagggaaatagctagggatcttggcagatgagggtaagaaacgtgtgatcatagtggacacatctaatgaaataggaggtgatggggatgtacctcattctggcattgggcgctctaggagaangcaagttctaaagttacgatgcacataacgtgatgattgaggctgttgaaaatcacatccggaattattgtgatcgatgaaatggtacanaacttgaaacaatggcaccacaccattgtcaaaaggggttcaacttttggnacngctatggggtgacaatgacacataattaaaaccctncctgcaanctntttgggggatgaaaatggactnttgggataaaagcaaaaaacgnaaattcaaaaacaatnttggaaaaagggccccacatttctttctgtgaaanggnnnaaacnnaagtnnngctacaagtnaaannacntgnnnnttttttnggaacccccaatttaactnntnnnnnnannaaaccccnnnngngntttttnn

SEQ ID NO: 102869 - DNA, 769 bp, Triticum aestivum
  unsure (1)..(769): unsure at all n locations
  Clone ID: PAT_TA_102869
cgcgtcgcctatntcgctnggcggccagacccttngggttggnnttcaaccagggaagccgcgtcgtctacctcgctccgccagatccgttccatatacgttctcagtgccatttctcaggtttaccagatccccgctcgaccaggagttcagcagttcttccgcgatctccaggtttgaacacccctccccccgctcgccttcccaataagccggaacctgcttccgttgattttcgctgctgttctttttttcccgaaaaaaaataccagaccacagctaatctgggctatgaccatgttagaggttcatcatgcgaacaaagtcacctaggactgtctgtccacggttggatgcctgaatatttcgttttgaggaatctaaggcagaccaagttcatncctccttaaatttggccctccatncataaatacttgggtgatttcctttgaggataatcgaaatgtttctgaacaatncaaatagncaggnatntaaaatgatgatttcattgggaaaaanaaacttatagcagccataactgctatagggctgatcccancaaaatngcactntaaccggggagaaatagttgaacatttatccctntttttaagtntttcccanataaaaataatagtnttagggttggcaaaaaaggccnaaaaaaatttggtttttngccggngaatcnaanttaccaagngntggggcccgggtnttcatanggctacnnnccctttnaaatggaaganaaacccgggagtnn

SEQ ID NO: 102870 - DNA, 793 bp, Triticum aestivum
  unsure (1)..(793): unsure at all n locations
  Clone ID: PAT_TA_102870
ctctcaggtccangggccaattatgttggaacacagggtggaactataccattttcaaccaacagtggagcctttgagtttcaaggtgctaatggcgtgataccgaattggagacccaggccttctactcggatcagcataactaggactttctctaagaaggatattaggagcattttgattgacaagatgaagagcgatttgatggagaatctaaaggagataagaagtaaaccactccaagttacagttaatggaaaagctagcgagaaacatgtggttaacgaacatgttgagggtaatgaaactcttgcatcagatgattctactgcaaacaaagatgtctgtgctgatccagaggagaaaggttctgctaatagtgcagatgctgaaaatgaagatgacaacactttctcctatactggtctgatcctgatttccatgattttgcaaggatcgtctgaggaatcttttnagagngatcaaatttggcttcatatgatgatgaagatggtatgccccgttntacccatacttcaaaaggtatctccttgactcatttaaggcaaaataagtttnttcatcgaggacaaatagggaatttggccattgactggcttnttccggttnataaaaactgcggggattnangattggnaatacaaacccganatatataacatgtctntaccaaataaatggagaaaggccncgngggngggaaaatttcccggaagggatttggccttgncnaaatggccctgntggaaggganctcctntaaggcttatgt

SEQ ID NO: 102871 - DNA, 752 bp, Triticum aestivum
  unsure (1)..(752): unsure at all n locations
  Clone ID: PAT_TA_102871
cccacgcgtccggtcatggataggggacnggggaggcaacnactggcggttgttctatttacacctagagtggttgacaggctagggagcaggcgatttttcactcgtacttggtcaccgatggagatgagttcaggggaaatgtggctaggagtttgtacaggtcatttttttgtcctcgctatgttatccatttacactgatcagtaactgtttttttaagcaggaaatagtgtagcgtacacgaacataaaaattatagaaggcaaggaggacaatctgagcaaaaacattatatttttttagaaaacgaccaatattatgttgagtattgagatgtagagccaccttaccgacatcacgcgcaccttttgtgacctccacaagcgcgccctgaggtcacccacacaagcagncaagaaattccacgatatnccccgttcttaccaacgacataaggnggcatggatgaagctctgtcctcttaaagagcttgccagaccccatcatcnaagttgccgagtcaaaaaaaaacaagacctacccgtgtctaanaaatcccaaatgaccagttggtccgacggcaaantaataattgcacaaaactggataactagacggcaacaggcacaggaaactgggggggcggcggccttgttnaaaaacacncaaacaccttgaaattttagggggtttnaacaaatgtangaacaccnttngtnttaccnnncaaattttntttccgnaanaaa

SEQ ID NO: 102872 - DNA, 747 bp, Triticum aestivum
  unsure (1)..(747): unsure at all n locations
  Clone ID: PAT_TA_102872
gcacggtcattgntcgctgntcaccagngggggcgggcatccaccttgctancaaggtcnaccaagcacaccgagatgctgctgccttctcctccaccgtcggtgccccgcttntacccgaccaactttctttggaagaactcaaaaacaggtgacctcgccgtgaactaccatgcaagactccaagccaacaggttcacagtcatggcagcggaaaacatcgacgagaagagnaacacagacaatggaagggtcttgctacnatatcttcgacgaccacagnacatcaccagagggaaggcattgtggacttcctttttcaagcgccacgggnaacggaccacaagggcgtcttaagttctacaataccttaagcaaggactnaaaaaatacnaanttnacaacacnatggaggnttttacattgttcttnttttatggcaactttnttttcatttttcaaaantttttaaccttcccaaataaaaaaccnctatttttgtntttgggngggangggcaaggaaaacttccangggggttttnttntccaaaagggcatnaacccaaattntaatnccccaaaanttnaaaggnaacccccaaaacccccaaattataancanggnncccnggggttaaanataanaaaaagnaaaaaggtttnttttataanaaatttaanccgggnggggggngggggggccccaannacccnaaaaacaaatgngaaccccccttttaaattn

SEQ ID NO: 102873 - DNA, 759 bp, Triticum aestivum
  unsure (1)..(759): unsure at all n locations
  Clone ID: PAT_TA_102873
cggncattcatnggtgatcaccagcacaggggngnatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaaggagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctnttccaggcgcccacgggcgacggcacccacgaggccgtcctcagctctacaagtacgttagccagggactaaaaagtaccactttgacaacacctgggaggcttctacatgctcctgctttatggacaacttggtgtccatntttcaanaacttnatgaccctgnccaaatnaanaacccactatttgggtatttggggagcaagggtcaagnaaatcttccangngacttgttttncaananggcatnaaccaatataanaatgccgaaaacgnaaatggnaccccnaaaaccaccancttatnaggagggnncgggggtggaaaaataanaaaagggaaaagngttgcnttttnnaaaattttacccgngnggtggnnggggggacccaaaanancggaaanacaangggaanccccctttnaaatn

SEQ ID NO: 102874 - DNA, 734 bp, Triticum aestivum
  unsure (1)..(734): unsure at all n locations
  Clone ID: PAT_TA_102874
aaaggaacgggggccccnngcccgnaaggncacnancccatccctcctttccaaagggtcagagatgcggaccgtgctaaccaccctctgtcatgcanaatttggtggacagttccaccttgcctccacttctctganggtgttcgtgctcgcaacatctgcccttctgtgccatcctatgagangcgcttcaccacaagcagctacatgactcanaaccttggcatcagtgtcccaatgatgtcatcttctccattgtttgccaatgcaccccctgagaagaaangtgtcaagaactttgcgattgacttcctcatggaggagtgtcagtgcagtttccaaactgctgcactcctatgagcgtgttaagctgcttatccagaaccaggatgagatgatcaagctggcagctctcnanccatacaaggtattggtgactgctttggcgcccatcaagganaaagctttgctcatgtggaaagaaacactgttaacgtattcgttacttccactcagcttnaactttcattcaggatacttcagaggatgttcacttnaaaagacaagatgttatggaatgttnggggnaactttttttgggggcangggcttctnctgttttnggnncnccttnatanctagncaaggtggcaatnaccaaggntcnagggggggngnaggnnntaaangnnnntnnnttnnccnaaaattnaanaaannnttngggnttnccn

SEQ ID NO: 102875 - DNA, 764 bp, Triticum aestivum
  unsure (1)..(764): unsure at all n locations
  Clone ID: PAT_TA_102875
cccacgcgtccgtccagaacggaacgaacgaaaaatccccaaccaatctcgtcgccgatcaaccctaggctcgtcgaatcctcctcccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttcgctggcaagcagcttgaggatggcaggacccttgctgactacaacatccagaaggagtccacccttcaccttgtctccgcttcgtggaggcatgcagatttngtcaagacattgactggcaagacatacccttgaggnggagtcgtctgacaccatcgacaacgtcaaggccaagatccaggacaaggagggcattcttccggaccaacagcgcttatntttgccggaagcactggaggatggncgcacccttgttgctacaacatccagaaggggtccccctgacctttgtctccgcttaggganggtgcaaattttgtnaagaccttacggaagacattacactgaggggaatcttcgacncattgaaacgtaaggccaaatcaaganaggggggtttttcggccanaangcttttttncggaagaattgagatggcccttttgttttacacatcanagggncncctanccgggctcccttcgggggaaaatgcctcntggaccnnntttaanctgggttnnnggg

SEQ ID NO: 102876 - DNA, 829 bp, Triticum aestivum
  unsure (1)..(829): unsure at all n locations
  Clone ID: PAT_TA_102876
gcggcgactgaacgcatgctgatctaggggcggcgccagattcgactgttgtctccgggtttggcccttgcggaggtcttaacaatgttgtcgagggcatttggtggttacaagagcagtttctcggcagatctctccgtgcaggccttacaccgcgcgtttggtacccttttgcagttcgataggaatcatcaggctcaccagctacatggtcatccagtctcacctgatggttttccccaagagcatagcaggggcgttccgtcagcctgtatgtttgaaccaactggtactgtttgtgggaagctttgatcaaaaagttggccacactgaggagcattggggattgtgtcaagtgaatatactnaatgtgctgttgaaaaaaatacctgtcctggttgttatgttnggnggggaaccctnccctggatgcatataacagggggatctaatgacaanaatggtaataagaagggtaagctngttnnaaagttaactattntggagaattggttgcttcaatgacccttaaanacatgaaggtggtnggnntctaaataatantcaactatggccggatantttgaggtttgaaagcattggataccttgnggggtgagggcgnccantgncgataaanaattnnaaaaaaaaaactggccttcaagggtnttcaaaaaancnactnnccaanaaaaantgttttnngttatcataaaaanccacntcnttganggaanttnnnctttttncnnaaaattnnnnntnaaaannatnttttnnnagnngntttttttnaaangggnntnnttttnnnnnnaaaannggg

SEQ ID NO: 102877 - DNA, 806 bp, Triticum aestivum
  unsure (1)..(806): unsure at all n locations
  Clone ID: PAT_TA_102877
gccgcggntaactggtgctacgcaaccgtagtcgcgccccgtgcccgctcctccaccatcgtcgccagcctcggacccccgcgccctccaactcctcctccttccgccccaagctcatcaggaacacccccgtccaggccgccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgtttcgcgtgcgccgattcccggngtgtgccccttgggtcaccctgggcctggagccnggngagggcttcacattcgcaacatcgccacatggtccctctactgnaaaaacaagacgccggtgtttggatcggcattcgaaccccggtctgtgttcaaggtganggatngggggggattggcacagcgttnggngggataaagnttttgttantttaagatggggaaaaaatcttccntttgtgnnctgggtaaagatcggttccggcaaaaaaaggggaaatgagtgcgctcatcttttntgaacagggaccgctttaaagngggagggaaagtgtcttcaaactctactancggttnaggngggggngncaaagaacctaagttgggggggactaaaattttttcgggaagttnaaatggaaanngaanttccannggttaatcnattnannnnangnaannnncatttnannnnnnncnccgccnnggnannanccnggggggntnnnnttnaannngggnnng

SEQ ID NO: 102878 - DNA, 760 bp, Triticum aestivum
  unsure (1)..(760): unsure at all n locations
  Clone ID: PAT_TA_102878
atctctcccggccatcttcgtcctcgtgctcctggtttgttcctgtaactccgatgaccggctaacgcccactaagccgctctcgcccggcgacgagctcatctccagcaatggcatcttcacccttggcttcttctccctgcaaggctccgccgccaacacatatttaggcatatggtaccacaacatctcggagcgaacatacgtgtgggtggccaaccgcgacagcccgatcacgggcagtttgccgggaagctggtcgtgagcaacacctctgacctcgtcttgtccacctccgacggccgtgtcgtctgggcaaaccaagacgggcaacgtcgccaccaccggatcaggtgacgcccggtgcgggggcgggctgttggacaccggcaactttgtcgtgcagtcgctgaacggcacggagatatggcagggntacnatcagccgaccgacgcctttttccgggattaagctgnggggngaactacaaaacccacgtacggggcgcatcgggnggggaagggccccacnacccnccacggcgagttnntttgggggggaaaaaagacggcctcaaaatttgacccgncttttgcnggggatgtttattcaacggaggaaatcttctggattnaagngtttattggaaggaaacttncnantggggaaaagtgntttcagggacncctntttttggtgggcggganggaanantttgaanaacaaaaaaaaaaagggggccttnngnttaaaaatncc

SEQ ID NO: 102879 - DNA, 814 bp, Triticum aestivum
  unsure (1)..(814): unsure at all n locations
  Clone ID: PAT_TA_102879
atgattcttctgaatcaatctcgattgaaatagcttccacatctccgttattgctgatcctgtttttggttatgaaactggtatgcttgaatgttgcaaggagacccccaagcacaaaaagaatagcagttcctccaaagaacacaccgaatgtaatttccataatggatttcttgctccagtgttttctgaagcccgaaggtccttcagttgaatcacaactgcgatgaagaatatggccacacaactttggattcccctcaaagctagaatttgagaaatgtacttagctggactccatctgggaatttttccttcgaggtcattgtgggaaaatgttgaatgctgaaagggaagtgccaggttcttcattgccgatgggatatacctgtgagatgattgctagataaagtccagcacccgcagattatcaagttgcagantgcccggggtatctctctgataagctattgactggaagttcaatatacaggcgagtcactgaccaatctctaagggaccaccngggacttatatttctaaatcaatattttgggaaacactggtntcccatttnnncggtgggagttgataacgggaagttaaggcttttgggccaacgggccaatttattgaattaacatggctttcttaaggntggggaattccggnnggtntnttggntttnaaaggaaanactttggttttnacnccnggnttggcnctgntggtnttttnaaaaaanntncnnttccctttanncaagggtntttcnacatgggantnttttaaaacnnnntttaaccnnnttttt

SEQ ID NO: 102880 - DNA, 753 bp, Triticum aestivum
  unsure (1)..(753): unsure at all n locations
  Clone ID: PAT_TA_102880
cgtcttcgtactcgcctctctccgcgcaacccgagccttcgccctcgtcctccccatttcgccagcggcgcagcccaccaaccacccccacccgccgncatgagggagtgcatctcgatccacatcggccaggcccggcatccaggtcgggaacgcgtgctgggagctctactggctngagcatggnattcaacctgatggccagatgcccggtgacaagaaccgttgggggaggtgatgatgctttcaacaccttnttnacgagactggtgctgggaagcacgtccccgtgctgtcttcgtagatctcgacccactgtgattgatgaggngaggactggncttaccgcagnttttcaccctgagcagnttattaagnggaaggggggatgcaccaacaactttgcccggggnattacaccattggaaggagatgtnanctntccttgatcgnntaaggaanntttaaacaantgncttgtttgganggattntttttttaacctttggnggnggaacnggtttngncttngttnnttntcngggnnggntttttntnatntngaanaanncnannttgggttnaannttanccntttcccnngnnnncttttgnngngnncntnnannngnnnnnnccccnntnnttttnnnnanannnnnntttttnttttnnnnngggnnnntnnnnnnncnnnnnnntnnntnnnnnncnnnannnnnnnnnnnnnnnnnnnnnnnnnnnnnnnnnnnn

SEQ ID NO: 102881 - DNA, 767 bp, Triticum aestivum
  unsure (1)..(767): unsure at all n locations
  Clone ID: PAT_TA_102881
gcatcgcctgagctgcctcaggacatcttgatgggtatatttgccaccctcgagatccctgacctccttcgtgccggctcagtctgctcctcctggcgctccgcgtactccaggctccgcagccctgggcactacacgcgtccccagacgccgtgcctcctctacacctctgaatctgccggcgagagcgttgcttgcctctacagcctcgcggagaagaggacgtacaagctagctctgccagggccacccatcagaaataggcatctgattggggtcctcgcaaggtttgcttgttacagttgatgacagatcagagatgcaccttgtcaatcccatactggtgaacagattaatctcctttcggtgataccgtgagcatgtgaaacccatctataatgattntgggctcttaccagaccgagtctcataccactccgcaaaaatggttacggccgcatcaatttggctcttggagagctgaggaacaagcttnccataaagttttggngtttttgatacatgcaatggaacaatggggngctcatacacaatcagcttggcagttttnatttgaagggcaggggngatanttggatatggctgcnccatacccactntgatgattggtttacaaaaanggcctggtggcccagnncttttttgggaaaatacctttcattaagnaccctgtntccaagaaaatataccagacttgacctgggncggttttnaaattaattgccaactccnggggattttttagg

SEQ ID NO: 102882 - DNA, 813 bp, Triticum aestivum
  unsure (1)..(813): unsure at all n locations
  Clone ID: PAT_TA_102882
gtgcactctgctgagctcagtggcaccacctggttcaacctctcttctctgcagctagggcttgtggccagtggttcactttatggtgctcttggtgggtccattcttgcataccgcattgcagattttctaggaagaagaatagagttgatgacagcagctgcattatatatttctggtgctttgaccactggattagctcctaattttgtagtcctgatcataggtcgtctcctttatggcgttggcattggtttggcaatgcatggtgctcccctttatattgcagagacttgtccttcacaaatacgtgggacattgatatcttttaaggagctgtttattgtaggaggaatactgtttggatccctcgtagggagctatgaaatcgatgttgtaggaggatggcggaccatgtttgggttttaagtgctccactgctgctatatggctgntggtatgngggaggctaccaccttcactanatggctacttntaggcacagccaggaaaagccctgggananacaacaaaaanaggcantaaatccctganaacactgagggcccttcacagcacaagggtttnacaganaaatnnaaanaattttcttaataaggttntaccaaacanctgaagaannttttnaagttttnngggacancttnaancttnatnttggggaganngttnttcanaaaaacggcncnnggntttttttgcaccnnttgaanggnggttaaaatgttngggtnaaaggnaatttnangnttnaattnnnnanggnnngntaaannnnattnnaanncntnn

SEQ ID NO: 102883 - DNA, 828 bp, Triticum aestivum
  unsure (1)..(828): unsure at all n locations
  Clone ID: PAT_TA_102883
acttcatcgagttaggtggcgggcaggaggcagcttcatttcaacgtacggcgcctgcccgtataaaatcccacaggctgcatatggctctccgtccatagccgcagaggtgtagagtgtttggggttaggggtagtgatcgatagctcagctctgctagtccagcgaagatgtggaggctgaaggtgtccgagggtggcggcccgtggttgcggtcggtgaacaacttctcggcagggcggtgtgggaattcgaccccgactacggcacgccggaggagcgcccnaggtggaaaggggtgcgccgggaagttcacggccgccgtttcgagaagaaggagtcnaaggatcttctgatgccatgccagtatgcaaaacaaaacatnttaggnggggatcttccggncatcaacttnagacagtgcacaagtacaagaagagctttataacatcattgaggcgatccttaccagcattctgntntacaacacacgatgggcactggccgggactttngnggaaatttggtcattatgctatttganattntntacatgtacngggatcactnatactgtctatcaacaaanttggggngagaattgcgttnntttacaacattaaataaatgggnggttggnncccaaatgttgggcccacccatgttnggatatcttaactttgtaccttaaggttttggnagggggaaaagagnctaacagggcgncttggnttttngggaaagcacnnnataccaaggggaaattgnttngggtgnttntaaggnngnaaaatnacntccngttggtngccaattttnnntntnnna

SEQ ID NO: 102884 - DNA, 818 bp, Triticum aestivum
  unsure (1)..(818): unsure at all n locations
  Clone ID: PAT_TA_102884
cggacgcatgggtgaagggggtgctgaactacattggtagtgtagatgtaagtccagagtcatgctacctacatcacgagcttctgaacttgatgctagtccttatgtcgactcaattatgttctggaccatctccagaaccaaaagatgtgcatccattcattgatgcggctatgcttcaggacagttccatagtagcttcggttgttcaaaagttactacttaattttgtaaggcgaccacaaattccttcaaatggttcacaccctgttttctctgatgacggtggcctgggtgttctgcaaccgagttggctcagcagctgcaaattttgtactactgccatattatactttcaactattttgtaagtgcaagcgctgaaggtgcgacaagtcaattgggcagataacagctaacttgtctgcttattctgatccactacccgaaaatgcatatcaatgaatgagtccattccaaccgacaggtgctcattgaagtgattcaaatccaaggcaanggatgcaccacttttattgaaacccttactgnaaggcctaacaatgctaaagacattaatttgactnccgatgtgagggaaanctcaaangacccgttgtaggctggcttttntcgtgttgagctntggccatgcttaaaanataagctantttgtgctttttntggcatggacggnatttagganatgtttggtnacaatggatcttgntatcctttttgaaagcttaatgctangaaattcancnacacgcggggaatntcngactannaaataacttaggtnggnncaatgngttn

SEQ ID NO: 102885 - DNA, 767 bp, Triticum aestivum
  unsure (1)..(767): unsure at all n locations
  Clone ID: PAT_TA_102885
gcgtgtgttatgttggcatgttgatgcatgcatgccagtttaatgtgtattgatgtatgcatgtggcttggccagcatgatgtgcgtacatgctttggattagaagctcgctggctgatatgtgcgtgtgtactgatgcgatgagcacctagaaaacaataggtagacccgtccgtcgtcttgagccccaccctaccgcaagcgcgaccagctccagccatcagtgccaccgccggtgtctttttgttttgcaaaaaagttttaccgagcgcaacactcggcaaaacattgacacctggcaagctggctgatttcctcctttttggtggtctttaagtttttttttattnnnnanannnnnnnnnnnnnnnnnnnnnnnnnnnnnnnnnnnnnnnnnnnnnnnnnnnnnnnnnnnnnnnnnnggggggccgtttaaaatttctttnngggccaaagttacccnacccanttttttgacaaaggggcctntggggggnnnttaaaactaggnctgccggngtttaaacnnnggactggnaaactgttcttgggatttttgnaagaacctnntttgggggggaaatatggncaaccnctcccgagattaaggtttagggaaaaaaaantttaaggtaangggnaaaaacnnntttcttgcggtggaggttttttccggnttnttttnaaaattttcccgggcnngggnttnattgtnggttttaaannnanccngggtttttngncccnnnnnnnnnnnntttttaaan

SEQ ID NO: 102886 - DNA, 713 bp, Triticum aestivum
  unsure (1)..(713): unsure at all n locations
  Clone ID: PAT_TA_102886
gccccagccgccggccgcacacagacagagacgctcgtcgctccgacttacgccctcgacctccgccaccgaccccagcctccggacggcgagcgtcgcttcgattcggccatgcctctggaggtgtccgatgttaacctggaccaaccagacctttcggaggtaccatgggagacgaggctcgctctggctgaacggcttgtcgttggtggngaaccccgaacagagggcccttattgagccagctatgaaaaattagacaagtatatgggaagaaatcagagagtttggaagaaaatccgatgagctaaatgcaacccttctgaaaggggncaagtcttnactggttctattaccncnnatgtccaaaacagttcttttnacgtactaccgcttntgcattggacaaaacnatcacttccttaaaggaaanantaaagggcaaaaagatcccggattgnttctcaaatttataaaatgtgcatttgggggaaanantctaattngnttatgttcngnggnngnatngtgncatctttaatgctaanggaggccnaatcncggtcngcttngtantttntggggactttaggngtntttgncncnaggnagnanggnngcnctnagntnnntannngggnnnaannaaannatnnnggnnnnnnannngnttnnnnnnnnnnnnnnntnntnttnnnnnnnnnnnnnnnnnn

SEQ ID NO: 102887 - DNA, 757 bp, Triticum aestivum
  unsure (1)..(757): unsure at all n locations
  Clone ID: PAT_TA_102887
gattcgccggtggccatatgactggggtcttgtatctttggatgctagaagagataagtttaggtcccgtggttaccccttaccagttttggaggatgatgccaagcgtctgcgttatagttttgaggaggagtttagtgaagatatctggaacaaactctcagaaagagtagcttcaaatatgtcccgagttgttgtagcactcgcttcattcaatggagaagcgagactttttgcttgcacaggtgtattcatagactgcaatggggttcaccacaagagttctaacctcgggaagtttggttagaagtaatgacgatgaaagcaaggttgctgataacttaaagattgaaggcaccttccagataaacgaccgtgtcacagggattttgcaacattccgatctgcattataatgncgctgcatcatcatcaaaaacatcggttgtnctcggacagcaattatcaacataagggtgaactggcnctcctcgcaggtntaactgaggggcgtgttattaatangcaaattaatgcagcagngggatggggatcaacatgaaagtaacctcnttgcaaagacttaggatccccttggaaaacctaagntgggatgggggcctntattgatttgggggactttttggatgactttntggttggaaaacccctacttccncggataaatgggaactttgggaatttggcnaanggctgttttttccaantctcccaanaangctnccaaacatttgggg

SEQ ID NO: 102888 - DNA, 773 bp, Triticum aestivum
  unsure (1)..(773): unsure at all n locations
  Clone ID: PAT_TA_102888
cacatcacaagagatacaagacctgttcctgatttacgaaagacaaaacttgacactggtacatcactgggcagtgtgttaaactttgctatttcatatacatggaaaatttcattcagatctgagttgcaatcatgccatgtatgcaaagtggtttttttcttcaaatttcaaagcacacacatgtatttattttgtacccgttgcaacgcacgggcatttttgctagttatagacaaaccgtctaatttgcatagtagtccttgttgacacacggtaaggtatgtctccgagagcattattataagttggctaaattaaacaaactgggaagctgaattcaacacacgaatactgaaacccgaagcaaatttgctttaggcagatggcttgagcaggaaggtaggcaattatagtaggngtgttctcacgattgngccctgcaaagaacatgcaccaaaatccaagttagatcatgccanccttgaaaaagngggacacggactttaatctangactgccttaccttaaatatttccaaagcaaaatatgttgnttgggctgctgcataanccaanttntgnttattnttgaaaatttgaataaaatttcatactggggggttatgagtctcnaaaaacttttttgaaggnattataaatttatcgcaaatacatttgtttactgaaaggaaaaanncctccttgganaatgttgtgacaacacaacccaaccctncttgatannggaaaagctnaaaaaaanaaggttcn

SEQ ID NO: 102889 - DNA, 762 bp, Triticum aestivum
  unsure (1)..(762): unsure at all n locations
  Clone ID: PAT_TA_102889
cccacgcgtccggggaagggaagggaagggaagacacgagtcaacgacccctccccctcctctctctcactccagcccagcccaggccaagccggcggcgatggtgaggggcgggagcatgcgccggccctcgctggcggcggtctcggagttcaccctgtcggcggacgactacaggctcatggaggaggtgggcttcggcgccaacgccgtcgtctaccgcgccatcttctccccgcaaccgcaccatcgccgtcaagtgcctccatctcgaccgaatcagcagtaacctcacctcgcaatggtacctgatatctataggtcccttcaggatgatgttcgcaaggaggctcagattatgaagttgatagatcatcctaatgtcatcaaggcttattgctatttgttgtcgatcacaacctttgggtcataatgccattatggcaganggttcattgtttacacctaatgaangncgcacatcctgatggcctggangagcctgttatctgtntattnttaaagaaacactcaaggntntgnttacttctggccaagggnatatcaccgagatgttaaggggcatatcttgttatancctggngaangaacttggggacttggggatctgttgtttgttaaaaagggaangcaaaaacaaaatcctttggggaacccggttgatggtcnaggtttccnctggaccggtttattnaaantgaatatggntttgaaaacngnttggnttgcaaggcccctctt

SEQ ID NO: 102890 - DNA, 801 bp, Triticum aestivum
  unsure (1)..(801): unsure at all n locations
  Clone ID: PAT_TA_102890
ctctgctcttgcagcaggttgggccatgaagactcctcccacatgaggtgaacaaatgatagtcatatctactccctctgtttcaaaatgtaggtcgtttaagcgattgtagtgtaattttcctcacgttacgaaattcttccacttccccattttgccctcccgcatcgctcgctcactgcagttcgtccgcactgctctgagctctctcactcgcaccgctagctactagctctccccatcactctccagctctccgcaccgcggcggcccgcgtccccagcccatcncaggcctccctctgccaccccccttngatgccggcctctcctctgcctctctttngnacgtcgcggcctctaccaccacccccttttcccaccacccgatgcgcccggnngagtcgacgggaaaagatcgatttttttgngctggggatgagctttatnacggaaagcgtgcgcgcgttggatctatgncgccgnnctntatgtnacnangaagggttnaatgtgaacggnggacctgancgcgncagggcngnattggacaacnacgccgntggaccttttttttcaaacaagcccgccggttggccccgtttttnctttcggnnncggggagacgnnngntnaacttcttcttnttaagggngggnnanattttcaccangcngggngcccagggggnnnaaaaaaacccnccccttgcctnggggtttttttcaaaaaatnaaggttgggggnggggnngnnngcncnntnnantttngggggnnnangggncnccngnaaaaanntt

SEQ ID NO: 102891 - DNA, 823 bp, Triticum aestivum
  unsure (1)..(823): unsure at all n locations
  Clone ID: PAT_TA_102891
ctcctctccttccccgcgcctccggcctcctccctcctccctcctccctcttcctccctcctctctcgttcctcatcacagtagaccatctcccgtcacgtaggccccatggtggcagccgcatcggggtggaggcgcagcaggtgttggtggagcggaggatgtgggcgggctcccgtcgctgctccatgatggcggccagttcaatttgtagcggcagaaacccgtggcgaactcgggagaggagaggaaggcgacggtctagcccgcgggcgttcggcagagagtgattgggacggcggcgctgggcaaagagagatggcggcgaagatggcggtggtgctgagtagagagagatgatgtcggcggcagaagcaactggtctctcctcttacatcatagatgagggcgcggctacaggaacgcgaggattggaaaccttttctcataatcttaccgaggtgctncacactcgacaaggagacaacctgcatgagcactgaagtgtgggaagaataaaaagtaantaatcgtangngnattgtcagatgagtcttctgtntcaaggggatcgaacactggactggaaccatgaaaccgccgagaaaaggtgcagcgaaggtgntncatgaaacaatgaaanccnggngaanaggntcctnggncncccttccagatanccaccnacnatccgntttttattctncttaancatggntnttttggntgnngnttngcctttttttttttggggngnccncaannaccnngngatnngccaaataaantnggggggttaaaaaaannngntggggnntntttt

SEQ ID NO: 102892 - DNA, 785 bp, Triticum aestivum
  unsure (1)..(785): unsure at all n locations
  Clone ID: PAT_TA_102892
gtggagcaccgaccacggatccttcttcactcctggattgcgcctggtctcgttctcaaaaagcattgcttccatgggagctttcgtgaacggcctcgccgtagcggcagtgggctggtggcttgctccggtcatcaccttcctgctgaataaacttctggcctacctctatgatgcatctcaagacttcatagatatgaggtctgggactatgccaagactcaggttcacgcttggggaagtcatggagcagaggatgctgattaaattatcaaagaaagaatccgatgtgaccaccaaactcagcggctggacagcttgctgaagaagctcaaggatgctctgtacgaactgaagacatcctcgacctcgtcgactataccgaattgagaaggaggttgggaaagctgggtcttncacctgctgcagnggngttggcaacgcctctgtgacatacccgagaaaaatnacctggctgttgaacgggcaaacanagcttggcttgttngggggatgnttacacatcgccggagaacattgctccntgtcaanggtcanaaaaggttgtggttgggccngggtccggtnnccgacaaaaaaattccttttnaatgcaaaaagcttgctggttgggatcnnatgaccggggantatacattgttcngcctnattntgggaaggataangggtgnnngnatccngtaaacaaanaccggnagngggccctataccnatgcttgnnatngttncnttaangtnntngaaaatnnttaggcctttttttn

SEQ ID NO: 102893 - DNA, 775 bp, Triticum aestivum
  unsure (1)..(775): unsure at all n locations
  Clone ID: PAT_TA_102893
tccgcctcgaattccccgatccagcagcgcggncagncatctcctctgctcccatccttcctccctcctccacgcccagatccctctcgctcccttccccacacagaaccagcggtaccccaccaccacccccgccttcctgccaggtaaccgccgctccctctcctcgcccccctccctccctccctcggccctgaccggatctggatgttctcccgggcgacttaggccgtccgacgcccaattcgagttcatcaagcgttcgattaggagcgtgcgggagggaattggcggttcgtcgccggaatcgcgcgcataggttgtgtcgatccggtcgaattggccgtgccatgaggaggaggaatcggggtctgttcccgcccgcgcgcgagacctacgacagccgggggatcgtcntttgtaccgatntggtttnggttcncataanggaatccggtacttttgtgctggagattcgctgtctggctcgataacgccagatgccgggaatttgtatgcctgtntntctttaccagttattggtaatattggncatatgtaaaaattgggtatgangannnnnnccacatagtaaatgnngggcnctttagggaaatactttgggtnggtaanccccaaatgaggcngtnatanaggtnnaaccttntttatttnttntttncanagggggnnnggnncnttttnggnnnaanntntnntntgggggnnnnnacnggcnnnnnaaanannannnantnnnnnttngnannnnnnc

SEQ ID NO: 102894 - DNA, 797 bp, Triticum aestivum
  unsure (1)..(797): unsure at all n locations
  Clone ID: PAT_TA_102894
ccgtcccgtcccgtncccagccaacctcccatctcngtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggncactggaagcacagtgacatcaagctcaaggacgacaagactctgctctttggcgagaagccagttaccgtcttcgggcgtcaggaaccctgaggagatcccgggggtgaggctggtgcccattaccttgtgggagtcccggtgtcttcattgacaaggacaaggccgntgtnacttnaggggggtgcaagaaggggggcatntttcccaacaaaaatccctatgtttgtggttggngnaacangacaantaccctaaacgttaacattgnttaaatgttnntggncaataactgcttgttcctagtaanacattaagacacttnggntattgggggtttagacccttgtattcccttattgccacaaaaacgtnntggccttnacaagntggaaagggganggccnannttaanatnttccanannttgggtttaaggtnnggnaggttttttgnntaaggnagntncggntntttcnggnccctggnnggnnnnnntcncttaaacnanggngttnttatnntaaagnttangttnttgggnannngggnttnttnnggntt

SEQ ID NO: 102895 - DNA, 753 bp, Triticum aestivum
  unsure (1)..(753): unsure at all n locations
  Clone ID: PAT_TA_102895
agatctcttaaaaacagagtttggacaagagattgacgctcatgatgctgtcttccgagacaatgaggcacctgtcaataagaaatatgcaaaatatgttgggctgaaaagggacttccgcttggttgtcaggggtgctgctcgaaatatggcaccaatactgaagggttcatctgatgaggcgcttattataaaaagtctgacacataaagaaataaatgcagtgataaaggaacttccgaatcccgtttacctttttcaaggcatagtcctaagaagaggtgctaaaggactggttgaagtccgtaaaaattggccctttcattgtgtgatattgtgacattatggtttacgggtggatctggctacaaagaatggccagatcttttagccctaggaaaggcacanccattgcaaggccgacttattccactntggagtgctcggataatcggatcattcccatgagagccacngtggaaattgtcggatgtccagcgagtnanatcaaaagcgctctgcacttttcgttgaaaggcgtgacggtcaacantaacgggcattacaatgnaaggntgggacagtgnccacttggccgntaggactnaattncnaccggggatcactcncaggggggtgtncctcaaccgaangggtangaccncccangggggnttttcaaggcggacantnatcttttggggcactnttgtaaagnccnattcnnnaannnntncctnnganntnnngtnn

SEQ ID NO: 102896 - DNA, 778 bp, Triticum aestivum
  unsure (1)..(778): unsure at all n locations
  Clone ID: PAT_TA_102896
cggacgccgtgggctcgcgttccctnttnnnnnggaccggcaccgcacaaagcgcgcgcggtcganagagatggcgtacgcggcgagctcgccggcggtgccggactggctgaacaagggcgacaacgcgtggcagctgacggcggcgacgttcgtgggcatccagtccatgccgggcctggtggtcctctacggcagcatcgtgaagaagaagtgggccgtcaactccgccttcatggcgctctacgcctacgcctctcgctctggtgtgggtgctggtcngggttcccatgggggttcggcgagcggntgctgccttctgggcaaggcgggncgtggcgcttacccaagantacttcgtcggccgcgccaagctgtcggcgaacaaagcgcgggagcacccgntggtgggagcccttctacccggaggcacgcttgtgatgtttcagtttnaagttcgccgccatacgctnatcttgntggcggcttccgtgctggccgatgaacataaggctggatggccttncccgtntggttatcttttacacgtngngcttagcttgggggggggttcttacatggggngtattantatcgnggtactnatcacttctcgnattncggttacgcnaattggtggcccagnttaaaacacgacggttcccacanatcttatatcccgngggttttnatggtggcggtaangggnnctacccaatanggtcggcggtaaacaatnggggnnanctnnctgctntnanntttttnacgcnntngc

SEQ ID NO: 102897 - DNA, 807 bp, Triticum aestivum
  unsure (1)..(807): unsure at all n locations
  Clone ID: PAT_TA_102897
atctcatagctgggcctctatactttgagcagcagcagtcattcatcaccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtttgcgtacgatatctccgacgaccagcaggacataccagaggggaaggggattngtggactcgctcttcaggcgcccacgggcgacggcacccacnagggccgtcctcagctctaccagtacntcagccaggnctaaanaagtacgactttnacacacatgggangnttntacatcntctgtttatgggcaagcttggtggncatctttcaaaactttatgacctgccactcaagatccactatttgggtattgggaggaagggtaaggaaatatttcagtgcngctttgnttcncaaatggcataaccatatgataatgccgaantgnaagggcaccccgaaaccaccaactatagnanggnccggaggttgaaaataacaaaaggaaaatggtgctttttaanaatttagtgggnggngnngggggncnncnnnaccgnaaacnnngggancccttnaaannnnngnccccnanggnnnncnnnnnnnaanggggnaaccnnngccn

SEQ ID NO: 102898 - DNA, 809 bp, Triticum aestivum
  unsure (1)..(809): unsure at all n locations
  Clone ID: PAT_TA_102898
tccagtagttggaaccagtggtagcacagaaacttgcacagccggcaactgctaaggaagccagttagttttgttgctgttggtacaatggatttatttttatttggcagatcatagatgggtttaaagtgttaccttctgcaagcaggtcatcatggtgacttgaattgcacatagctgttgctggacttgaatcccaaagtggtggatttcctgccatggcatcggatgcaaagtcaatacatggtaaatgagcatgaagatgaaaattagatagtgtatcactttcgagaagtgcattgtaaatagtcaaggtgatgatgcacctgaagccatgggcgtttgtgtcgttgctgcatcttgcatggtagggtcaagtgatggagaatttgcaggaatttgtggcatgatggcttgtggtcactgcagcgatggatggaattntgggggtgcctgcattttttgttagttcaagctcggtaatctgagtttacagtgcagtatagttgcacaattaaacaaactgctcanagtctttcctaganggaaagnaacctcaactgntgatcaagtanacacaaatgcctntggagcgtctcaccttgttgcactcacatctttgntttanaatcttgaagcccggtcaaaccnagtanacttngtatgnnnnaacttaaattgnaccggaacntcccnnttnacttgttacnaaaantttnanancattgnatttcnannnnnnnnnangggcnntnnntttnngccnnngggggggnnnnnanntttnttttnncctnntttnnncncct

SEQ ID NO: 102899 - DNA, 842 bp, Triticum aestivum
  unsure (1)..(842): unsure at all n locations
  Clone ID: PAT_TA_102899
cggacgcgtgggcggacgcgtgggttttttttgaaaatcaaaagaaagaatataatccacaaccattctcaacactacagaataaggacaatcgccctgcggctgcatcaaaccctaactgtaagcccaatgatacaaaagaaaagactggtgtatgcaccaaaatttaatacagcagggaaatcctgtgagataaaccccatatatcatccacaacactccacaggacgcatcatccatggcaacaagggacgacaatttcttttcagacaaaactatacagccaaaagaaaaaaggatttgcacttctgggatttatttcctatttattgcttgngtttgcccccttactgcttttgtaatgcgcttttcaagtgcagcatcatgtccgacctagacaaacaaaatagtccgacttggaaatgtaaccccgctgtacatacatggtccatctatacgggatatctgnccggnggcaaacagacaatcccttcaatcgattctccggcaatacaagcagtttttgnttcggcctggnctaattgaagggggnggncttgggggggtaaccatgccgccaantttgggtcttcggnantatttcctgccttcaacacttanagcccggatgatntagntatagtgggatctatccacattgggacctggcacataggaatgagcgattggnnaaaggcccctcttgacatcatacttcctnaagatgggngggnaaaaatatangntaaaaangctnactnactgatgncgtggganataattganttttnacccanggtnattggggcggtaaaanntttnaannnnnnaatgggaanaan

SEQ ID NO: 102900 - DNA, 824 bp, Triticum aestivum
  unsure (1)..(824): unsure at all n locations
  Clone ID: PAT_TA_102900
cttgatctctctctctctcagccgccacgaaccctagccccttttcctacgatcccgcggtcgctgcccttgctccatccgacctccctcgtcagccgccgccgctatggctcctccgtcctccgactatgtctccgcaattcatcctccatccctttctgctcgaggtgctcatcggcccaggtcgtgaggaagccgcgtgaggaggagcccaggtcgcgaagccgcgtgaggaggagagacctcgcccgagaagctgtgggaggagggcctcaaccagagaggagcggctgcagccatgtagtcggctcagctcncgccgtcttgggcgtcggccgcggcagaccctagcgccatcttagggagtcttcacgactccaggtgcgcattttaaggatttaataatgagttatcttgggcttattggacaaatgatctacctggagcaatgatcagnatacaatgcncaggttctactgnaaacagtacacatacaaaagtntgaggagaaggtggtcagaaaaagagtatacatgtgccaggtcttgaattgaagatnccggtgcgacaggaacactctnatatggttctgtanatgaactaaggagaagcgcttattcctggccaagaacatgtaaaaaggggggantttccgtngtttcnagtggntnntcatatanacattaattgataacttacatggggggagcgcnaccgggagttgntatgtaacacngagtggtaatcaaaaanaaaaaaaataaaacnttcngntggntnttatattnncnttnancnntnnttttttttgnnggnttccccaa

SEQ ID NO: 102901 - DNA, 797 bp, Triticum aestivum
  unsure (1)..(797): unsure at all n locations
  Clone ID: PAT_TA_102901
ctgtgattccgtctctcggactttggtttcctcccttcgcgccgactttggtttcccccttcgcgccagctgattcaaacacgggtcggtattttgagatagagcgggatctcttacccgaccgcgcccccccctcccccccttaaattggaggtagcgcggagtgagagtcccgttcaacaaaaaagtaacgcagggagagagagagagagacagagagcgggagagggggagggagggagaagaagttgaacatcgtcgaatcatggggctgatggcgctgaatcggctcatctccaggcagcgggagcagaagcagaagcgaaatcgtggccgtattgaagccaataatgggatgggcttgcttcatcattagctaaaagaaacaagatcgccctgcacaggatgttaattctcatggtggcaaaaaagtaagatatccaggncnagatttcagaggacattggngtcatatacatttctactggcaatgcaagatctgcccggctgctgnatnttnantcttttnaactctggaaanctatccaatttacttccttatgaacaatgnctcaaagaaattgggtaaanacacgntcaatgtttagagctccacaccaatgcntttttaaaaccctagnccngnggaaaaatgngnttgatctntttttctttgggcaaacgntnttattncnntggtcaatgggtcncngggtgacaancccttctttccggggnncttaattctcngnnnttnnaangngggtttannntncntnnatggntnnnccnntnan

SEQ ID NO: 102902 - DNA, 768 bp, Triticum aestivum
  unsure (1)..(768): unsure at all n locations
  Clone ID: PAT_TA_102902
ctcctccctcttgtcttttcctcctcgtttgttcgcccggtatagcatgcattcgattcgtatcctccgcctcacgctacgctgccgcccgattagcaggaacaaagcaatagcataaaaaaatacagtatcatcggaaaccagaacaaattagtaagatggcttcacccctccctcgggagtaggagtaggagtaggaagtaggagtaggaagtaggggtagggctgaccgtaaagaatctgccgtggtgcgcggtgatgatggtggctttggggcgagaggaaagggacgttcatatgcgtctcgcttgcggcggaagcgagaggtgcatggccaaatctcggaggcagcggccaccgagtcgttaagccgtccctccgctttcatgatggtcgggtttggacgcttttgttaaagcccctttgccccttccttgccttccattcccgcacgcnatatttccaatttctgttccgtttcggggctgcaggtacgggtttcctacgtacagnactattttccttttnttacaatttctgncggtacctattttttttgctggacatangatgagatattggcgataaggcatgtacaatggaagaccggaggggganctccatcctttcattaaataaaggttgaggaaccatagtctnaaaacaaccccangncttagnttgcttacgggggcacagntttntttttatcnatggaagagagttgcctgggttaaccatcaacnaantttttantttttcnccttt

SEQ ID NO: 102903 - DNA, 835 bp, Triticum aestivum
  unsure (1)..(835): unsure at all n locations
  Clone ID: PAT_TA_102903
cggacgcgtgggctgaatgcatttaaaatatgcatggtttgaagaagaaaatagtcttgtctggccttatgaacagccatgccatctcatttcatgacacataatgcacctgcatttatgctgtagtgcagactatagttgcgcttcctcaaaatagctattcatcgttgcgctgacctgatgctcaagatcttgataatgtattaggggtacaaaatttgtgttctgctttgtttatagtacacgagtaatctggtcatgactttttagagtcacataccatggagagagcatccatgttgtttctatcaaagtggaattaattgtgagataactctaaatttgtaaaacctgnatgaataataattcattggcagcaaatgccatatttgatggnattaatgnaataactaccaaatgtggcaggcttttgtgaaagttttcaatggcaatgatgctgantgtctctactagaatcttgaccaactttcaaaattcaagcaatagaatttgntagttgcangaacgttactaattctgatatgagtttgtttcaaacccgatgctttcactaattatattattatttattcaaacgtggaaaatgtaggtactcttaacctgcatgcagatggacttactttgctttacttnttncgnccatctatataagtaaaatgttgnggtccctaaatatgagnatggccgtggaggtaataactcctttttaactnaaaggttcaactgggggaataataaantccattnttgtgntatttgatgnaaagcccaatnnggngggaagttngntnataaaagccgaanccctnnngga

SEQ ID NO: 102904 - DNA, 796 bp, Triticum aestivum
  unsure (1)..(796): unsure at all n locations
  Clone ID: PAT_TA_102904
ctatctcctcactaataaggnttctggcactaagtacgttacagccaacaccttcttggaagatattgctgatgtacattttatgttgggtgaatggagtgatcatgtgatttgtggtgatgatgaaatatttaagtgcatgactaccaagatgaaaaccaagtatgagaagtactggggtgatcctgaaaagatgaacaagtatatattcattgccgccatccttgatccaaggaccaaggaatctcatttctttaaagacatgattgaagacacctatggcagtataataggtaatagaatcttgacatcttcccaatgaatttgctctctttttggagaatatagagaattatatggaaccagtactctagccgcctagggaattagcatcacaagctcgcctagtgcaaatgcttctgaaaattctctagtgaggncacgatacaccagaaaagaatgaaaagtttgcggagagggcagcactacacaaatccagaactggattagccagtnctttctgagacacagaaaagtgctgntgaattgacctnttgatgggggaagggcaagctctcntttccttctttaaaaagggtnggantacaacatcccactttnggtggtttgaaaantttacctaggggcgattttaagcttnaaactttacncacgnctgancgtnttcccaaatggtggttaaggtnaagtnactnnttnnntncccctggngaaangggccttnttaanaanggccatnnnnggtgntttccggnnggggaaatntcnnncccan

SEQ ID NO: 102905 - DNA, 835 bp, Triticum aestivum
  unsure (1)..(835): unsure at all n locations
  Clone ID: PAT_TA_102905
gacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggaanagtgggcaacgccggagagccagccaagctcataagnaagcggaccgtgaggctgagacatgatcaaaaaggnaagaatgtgcttgctcttatnaccaanttgngccgncggggtcggatgggcggacccacagtacaccgtcaacaacagatggngaacgccaccctnatgaacattgccatgccccacaacgggcagttccagcatgtncacaggaggagaccttngtgtccatngncgcnctggaacgatntnacnntgtccccctntatccggaggcgatgggaantttntgggttcnccccnnnncnntnggnntnnngggnttttnnnncnaannnnnnnnnnnnnnnnnnnnnnnnnnnnnnnnnnnnnnnnnnnnnnnntttnnnnnnnnnnnnnnnnnnnnnnnnnnnnnnnnnnnnnnnnnnnnnnnnnnannnnnnnnnnnn

SEQ ID NO: 102906 - DNA, 833 bp, Triticum aestivum
  unsure (1)..(833): unsure at all n locations
  Clone ID: PAT_TA_102906
gataaagttgtgcgtgatgagcagaacaaagttaaagaggagctggcagaactatgtttctcggatccaatggacctccataagaggcttgaccgcgaaattctggaaactgagtctgactcgtttaaattaaagcttcagaaagttgtggcaagtcgtttggttttgccagatatttgcagatcatatattgatatcatcgaaaggcagcttgaaatcagtgatttatccatgtcttcacgtgtgctgttaatgcatcaagttacagtttgggagttaattagggtcctgttctcagagagagaagctggcaaccagttggaattttgtggtgatgagggatcaggagggcatgattttggataagaaagaaggttctgtgaacattgaccctgaagcacttctttggttaggagagcagactttagcaattggttacaggacagtgtttgcatcgggtacaaggagaggnggggttctttaagtgatgccagatccttggacatattgtctgcatttnctggtcgcaattggcacagccacagaaatgctgcttcaagggcgatgtccgttgcagtctgctaancagcaggggatcgatgttaatcntcggatgttctcacantggactgnggaaataatggctggacttcatttnttggggagcgggtaaagattaccaattgttctggaacataaagggcttnttgntaccaacgntggaaaggncttggttaatatggggntantgnaccnaacnnnttgnnttnattngggttnccactnttgggggnaantcnaantgtctntnntntnagnccnngggancttng

SEQ ID NO: 102907 - DNA, 777 bp, Triticum aestivum
  unsure (1)..(777): unsure at all n locations
  Clone ID: PAT_TA_102907
gtcattcatcgctgatcaccagcacagcccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatngtgggactccctctttcaggcgcccacggccgacggcacccacaaggcccgtcctcagctctacgagtcgtcagcaggnctaanaagtcgatttnacacacatgggaggnttntacatcntctgtttatggcaanttggtggncattttcaanacttattgacctgccaaattaaaatccatantttggtnttgggagnaagggcaaggaaacttccnnngnggttgtttnccaaanggctaaccaatttataagccgnagctgaangggaacccgaaacnncaacttttaggnnggncccgnggtgnananaaaaaaggaaaaggtngnntttaaaaantttnccgggggggngnggggggccacnanccnnnaaccanggggancccttnaaannnnngccccnnggnntnnngtnnaaaagggnaacnnggcctnnnnngnaanttnannnncccnnt

SEQ ID NO: 102908 - DNA, 788 bp, Triticum aestivum
  unsure (1)..(788): unsure at all n locations
  Clone ID: PAT_TA_102908
cagattcagaaagagatattgcagtcgggacctggcccgtccgggtcgggcaaccaaaaagacaagatgctggcaatgttggttgaagatgagccgaggcggaagaagtcgctgaagctgcctggtgggcctaagaagaagtcgccgacgcgtcggatgaaaaccgtcacctatgatgacgacgacgacttcgatgcagtgctcgatggagcttctgcggggttcatggagactgaaagggaagagctgatcaggaaggggtttgctaacacccgtttacaagttgaagggctttgagaagcgggttgaaagccctggaacttctacaggcaaaatgactttcagaacaagccgaggaaaccatggaacttcacttgttaaagttgctaagcaatgcagaacatggnacaaagccgccactcccaattgttgtgcgggnntnttgctaacttnntcaccntggtccgtttaaagttggggtactttaaaccctgcttccanttaaacaggggaaacaaaggtnnnngtanaccaanncctttctgcanaanggttaanccnttaaaagggtnttttntttttnatnntnggnaaaancncttcttncttnattcaatnngttnggnaaacnntnnttacttttnnttnaanaaaanaggaaaaangnttnnggnnccncnnntctttnnggggtnaaaatnnggnnantncccnntntnnnnccaaanggnngnnngnttngnntcnttnnanggtnggnaantgnnnaaaggttnaaaaccnnnntt

SEQ ID NO: 102909 - DNA, 817 bp, Triticum aestivum
  unsure (1)..(817): unsure at all n locations
  Clone ID: PAT_TA_102909
gccacccattcaaatacgagtccattggcctcagcgaggcagagaggatagctagcaccttgagcttgaggtcagtggcaggcaggcaagcaagaaaggaagaagaagaaaaaaggacatggcatctgctactctcctcaagtcctccttcctccccaagaaggccgaatggggcgtcgcgcgccaggtcgccgccccgagggtgtccatggtcgtccgcgccggcgcctacgacgatgagctcgtcaagaccgcgaaaaccatngcgtcgccggggcgcggcatcctggccatggaccgagtccaacgccacctgcgggaagcgcctcacttcgatcggctggagaacacagaggcgaaccgnaggcgttcgcacgctgctggtcttcgtccttggctnggcaaccacatctccggcgccatccttttngaggagacgctttancaatccaccgtcacggaagaanaatcgtcgacatccttgtggacagggcatngtcccgggatcaangnggacaaggcctggtgccgttaccggntcacgacnagttttgtgccagggcttnacggctcnctccgggaggccgctactacananggcgccgttngccaangngaccggggnaagatcccaacggccctccactgccgaaggagcnctgggcttccctacccncattnnagaaaggntgnccntnnggaccgnatctttgangggncnggattanccncttnaggggncaaaggggggcgnncttacnaggccaanannntntngggnntnnnaaccnnnggncccngncngggaggnnggcnc

SEQ ID NO: 102910 - DNA, 787 bp, Triticum aestivum
  unsure (1)..(787): unsure at all n locations
  Clone ID: PAT_TA_102910
ctcctctcctcctggtcacagcacacgcacacgcctncatccccacgcggccacgcgacatatcttcccctccatcctcctccacttcctctctccccctctcaccggcctgccgccgctcaccccctcgccacccaccaacgacccgcacgtctccgtcgccgtcgtcttgattccggccaccgccgtcctacccctcctctccccgcacctcctcgcagcacgcagcacctccgccgccgtccggctaccgacctcctgttgtacggtgacgacagatttgagcgcagcaacaccttctcgcccnnnnnnnnnccccnttttgacnaagtagcaagcccgaccaaacacactnttaatctcgaacgcctccgcaccgcaagaagcgcgttaggaaggaggatccgntattgttctnttcggcacgctcgcagaagcaagacgcccacagaccaccggagcatgagtatntangcgaggncccgacnaaggctttacgggaggaggttttattgacgagcaggacatatcaggaaaacacttgcnggaagatctccnncttacattatacaggncatnggaaacaaaaatggtgngtggggannttactatgctttatgggataaaanaggnttgtggtggggagccngaaangatattttgnttggggaaaanaannggtttttgngnggnttaangnttagannnnggnntgnaacggggcntnntttantaaaggaanngggtgggantggngnaaaaantngnnntnccgnnnttggnnnng

SEQ ID NO: 102911 - DNA, 842 bp, Triticum aestivum
  unsure (1)..(842): unsure at all n locations
  Clone ID: PAT_TA_102911
nnngnannntttttncccctgctcgaaattaaccctactaaagggaacaaaagctggagctccaccgcggtggcggccgctctagaactagtggatcccccgggctgcaggaattcggcacgagcaaatcccaacaccttccggcggcgaagcaacccacccacccttctctccctcccgaagcagcgatggcccccaaggcggagaagaagccggcggcgaagaagcccgcggaggaggagcccgcggcggagaaggccgagaaggccccggcggcgaagaagcccaaggccgagaagcggctgccagccggcaagaccgcctccaaggagggcggcgagaagaagggcaagaagaagagcaagaagagcgtcgagacctacaaaatctacatcttcaaggtgctgaagcaggtgcaccccgacatcggcatctcctccaaggccatgtccatcatgaactccttcatcaacgacatcttcgagaaagcttcggccgggganggccttccaaagcttcgcccgcttacaaacaagaaagccccacccatcacctcccgggggaggatcccaagacctccgtcccgcccttcgtccttcccccggggggaggcttcgcccaaggcancgcccggtcttcttgaaggggccacccaaagggcccgtcaacccaaagtttcaacccttccttctttaaaaattggcggttcgcccctggtantcntaagttaagccaaaatggcaggtttccctttccttgttngggntttaagtggccttggtcttgggggacctctnggnttattttgcnaaaaananaanannnnnnnnaacctcggnggg

SEQ ID NO: 102912 - DNA, 753 bp, Triticum aestivum
  unsure (1)..(753): unsure at all n locations
  Clone ID: PAT_TA_102912
gnggnagnntttgattcccctgctcgaaattaaccctactaaagggaacaaaagctggagctccaccgcggtggcggccgctctagaactagtggatcccccgggctgcaggaattcggcaccagnataagtagagcgcatcatttaagccaagcaagctgtggtcaatacaaatccaccatgaagacatttctcatccttgccctccttgctatcgtggcgaccaccgccacaaatgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccattttcgcagccgnaactaccatattcgcagccacaaccatttcgaccacaacaaccatatccacaaccgcaaccacagtatttcgcaaccacaacaaccaatttcacagcagcagcagcagcagcaacaacaacaacaacaacaacaacaacnacaacaagaacaacaaatccttcaacaaattttgcaacaacaactgattccatgcatggatgttgtattgcagcaacacaacataacgcgtggaagatcacaagttttgcaacaaagtacttaccagctgttgcaaagaattgngttgcagcacctatggcagatccctgagaagttgca

SEQ ID NO: 102913 - DNA, 858 bp, Triticum aestivum
  unsure (1)..(858): unsure at all n locations
  Clone ID: PAT_TA_102913
aanaaaatttaactctttcncgaaccaaccctactaaagggaacaaaagctggagctccaccgcggtggcggccgctctagaactagtggatcccccgggctgcaggaattcggcaccagnantgntnnnntncnttctttnnctannnccntctcnnacncttgtntancnannnnnnnaggcctttntctttttctanngcaacaanncgtnnnanaanaacaccatgattganngancnaatcncngccacagnctcngctncttttcnangnaataagagctgcncnacaaantnattnnacgnattacnaccnncnnncaaaanntctttgccagccaatngaancnnntcanngccctctnagtgnntaatnangatgcatgtanntcnttacaggtnctaatgaangatcacctttgtcanatnatnatantataacncgncncatgganactatcatttccttacattaaaatnnattcntttgtagaantttgatntgaataattncctttaaccnataacgngggttntgtccctngtannccttcaaatcttccntnnccattagnatccnagaccntctntcanntattttgtaccatattnnngaaganaatccttnaaaatntaancnttcgctncanttnttanaaaannnctnngaattcnatntttttaaccctangtgnttttacanncaagcanacanncttttttntcnagttancacaaatngccnggggttatcntttacctaaaagggntaanaanacagcttgactctgnantangcncccnnntctttatcgttntaanaaaacangatgncgcanataaanacctttggggg

SEQ ID NO: 102914 - DNA, 755 bp, Triticum aestivum
  unsure (1)..(755): unsure at all n locations
  Clone ID: PAT_TA_102914
gngnnnnnttgatncgcctgctcgaaattaaccctactaaagggaacaaaagctggagctccaccgcggtggcggccgctctagaactagtggatcccccgggctgcaggaattcggcacgagcacaacaaccatatctgcagctgcaaccatttccacagccgcaactatcatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagctcacaagttttgcaagaaagtacttaccagctggtgcaacaattgtgttgtcagcagctgtggcagatccccgagcagtcgcggtgccaagccatccacaatggtggtcatgctattattctgcatcaacaacaccaccaccaccaacaacaacaacaacaacaacaacaacaaccgttgagccaagtcttcttncaacagctcagcaacaatatccatcaggccagggcttcttncaaccatctcagcaaaacccacangcccanggcttnttttcagcctcaacaactggcccagtttgangnaattaaggaaccttagcgcttcagacgcttccttgcaatgngcaatgngtatatccttccatattgg

SEQ ID NO: 102915 - DNA, 747 bp, Triticum aestivum
  unsure (1)..(747): unsure at all n locations
  Clone ID: PAT_TA_102915
ncgnagnnttgatncccctgctcgaaatnaaccctactaaagggaacaaaagctggagctccacccgcggtggcggccgctctagaactagtggatcccccgggctgcaggaattcggcaccagcggggaacaccccaagggatcggtgctgcaaggagctttacgacgcctcgcagcattgccggtgcgaggcagtgcgctacttcatagggcggaggtctgatcccaattccagcgtgctcaaggacctccccggatgccccagggagccccagagggacttcgccaaggtgctcgttacgccggggcactgcaacgtgatgaccgttcacaacgccccatactgcctcggtttggacatataaagatagatagatccgtcgcccatgaatgaataagcatgctccgtccgtggatgtgtggcatgcatatatgcatatgtgagctcccgttgctcaacatttgctttactaataaagagaatcattttgtggttcttaaatttcaactcaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggccgcaccgatcgccttccaacagttgccacctgaatggcgaatggcaaattgnn

SEQ ID NO: 102916 - DNA, 790 bp, Triticum aestivum
  unsure (1)..(790): unsure at all n locations
  Clone ID: PAT_TA_102916
nngnanntttgatcccctgctcgaaattaaccctactaaagggaacaaaagctggagctccaccgcggtggcggccgctctagaactagtggatcccccgggctgcaggaattcggcaccagggnggancnnccaanannnncagagntnaacngatnttgangnactntttcaacnnnaangagctcnggnagagcattantcctnatgaagctggtgtctaccganntgccgngcncnctnnnancntcanngntgnngnnaacaanannntncngnancttctactgcnctatgtnnccccactgnctgttgnnntnnaaactgntncaaganncantactgtnntnattancacatanaccnnnatatcnancnngaaggnannantgtnttccacntantccnacnaccatnctggggntntantncngcatatggaagntganaggacnnagcntntggtctactaacctgctcgannagtttgagcttttttnaatttcancttgcacccaaggggtgttccccactcacnggggtggcttcgacatnnatgccaacgtatatnctgaatgtntctgntgacagacaagaccacttggcncanaagaacananatcacaatcccctacganaagggnactntntagcantngacgacatntganaantatgngtcccagntacgccataataaagttacaaaaggctncagggaccgaangagcccctttgcaaananaggttggaccccccaatnaactggccttggaaggaaactacggcc

SEQ ID NO: 102917 - DNA, 730 bp, Triticum aestivum
  unsure (1)..(730): unsure at all n locations
  Clone ID: PAT_TA_102917
nnnnnatatnagnagtttgatacccctgctcgaaattaaccctactaaagggaacaaaagctggagctccaccgcggtggcggccgctctagaactagtggatcccccgggctgcaggaattcggcacgagctggctctctccatcccaatcccgacctaccgtcctctctcgcacgccatggacgccacggccaccggcgccaaggggaagaagggtgcggccgggcgcaaggccggcggccccaggaagaagtcggtgacgcggtccgtgaaggccgggctccagttccctgtcggccgcatcgggcgctacctcaagaagggccgctacgcccagcgcgtcggcaccggtgcccccgtctacctcgccgccgtcctcgagtacctcgccgccgagctgctggagctcgccgggaacgccgcgaaggacaacaagaagagccgcatcatcccccgccacctgctgctcgccgtcaggaacgacgaggagctcggcaagctgctggccggcgtcaccatcgcgcacggcggcgtgatccccaatatcaacccggtgcttctccccaagaagacggcggagaaggagggcaaggcgcccaagtcccccaagaaggccgccaaagtcgcccaagaagggcgccacccccgaanaaggcttaaagaaaagatgcgatctgtatcggtttaaggctgtgtnctgtggtagtggttcnatntgaataggcaaga

SEQ ID NO: 102918 - DNA, 1101 bp, Triticum aestivum
  unsure (1)..(1101): unsure at all n locations
  Clone ID: PAT_TA_102918
aanaagggccgnnaaaaggaaggagaanganaaagggttttngtgaaaaaaanccnccctttttgggaaaaaaaagngaancccgggatgnatntgggggnattttgnggagggagaaattaggggaaatnttcnngnaaanaataggngnannaanggtgtatnaagggttggncgagntnaangaaatatnggganntaatnaaagnanattgngtgnaggaanaggangnntatttgttgaaaaatggtgaagatangggnnaananagngaaaanatggganaatnggggangngggggggngatanggnggaaattngnagatagagggaanangggggaatgggnaatngggnaaangggggataatggggatatngggnataggngattgggnnnnggggatgtgggnannnggngaangggnantggganatgggaatnggatttgganacggaaatnggntgggaatgnaaatgggatngggaatggnanngnttgggaatggaatggganggnncgnatgaanngatgggatggattggaatgggatgaaacgnatgngatgantggaatcgaatgnatgnatggatgnatggatggancgaaggatgaatggaaggangganagatgganggnatgnaacgatgntagaatggaatggatngnaggatgnntganntgangaaanaanngagnaacnaannatgaacgaaagaaangaaaggntgaaatnantnaatnaacanaggatgnaatgaangaannagtaagnatgnatgnaanaaanntatanatggannnnatggatgnangntttgannggaanngnatggnaaangnnaggtnaggganggnnnggnnaanatggngngangaatgaaatgnngggnaatgagtatggtgatgtggagagtganggatgaanantannntganntgattangnagngnangntannnaagnaaaagtgataanggaaagnngngattggggattgngatgcggnaatgggaannanagntngggaantggatatagggtancgggaangggataggngatcggagatatgggangnnggnattatgagag

SEQ ID NO: 102919 - DNA, 708 bp, Triticum aestivum
  unsure (1)..(708): unsure at all n locations
  Clone ID: PAT_TA_102919
antagntttgattacccctgctcgaaattaaccctcactaaagggaacaaaagctggagctccaccgcggtggcggccgctctagaactagtggatcccccgggctgcaggaattcggcacgaggcagatcccagagcgaatccggtgccatgccatccacagcgtggtagaggctatcatgcaacaacaatcccaacaacaatggcaggagcgccaacagcaagcacaacataagagcatgaggatgttgcttgagaacctatcattgatgtgcaacatctatgtcccggtacaatgccagcagcaacaacaaatggggcaacaacaacaacaacaacagttgcaggagcagttgacaccgtgtgcgacattcctccaacatcagtgtagcccagtgacagtgccattcccccagataccggtggatcagcctaccagctgccagaatgtgcagcaccaatgttgccgacagctatcacagatcccggagcaatttcgttgccaagccatccataacgtggctgaggctatcaggcaacaacaaccccaacaacaatggcagggtatgtaccagccgcagcagccagcacaacatgagagcattcggatgtcgcttcaagccctgcggtcgatgtgcaacatctacataccggtcaatgccccggccccaccgnctacaacattcccatggtggctcctgcactagt

SEQ ID NO: 102920 - DNA, 728 bp, Triticum aestivum
  unsure (1)..(728): unsure at all n locations
  Clone ID: PAT_TA_102920
cccccccncngtnggagtttgattaccccctgctcgaaattaaccctcactaaagggaacaaaagctggagctccaccgcggtggcggccgctctagaactagtggatcccccgggctgcaggaattcggcaccaganncatttaccnatcctnancanncnttnccccattaancacnacaacaggttccctagtctanntaancncancaaccattnctncattcnnaacaaggnattntnncnncaantacaacnannattccnnctnnnttaacnncnacaanaancattnanccatcaaccagatcaaccattctnccagactnaanaacctcancaaccattttnccatcnaccanntcaacnnttnnnncaggactctcacctggagcagncatttgaccngctanngcaanccacancaaccttttnnnagagccncnacaacnattgccgnngccccgacanccgcaanaatnnttnntccnacancancggacattnatncaaccatctctacatcaacagttgaacccatgcaagaatatcctcttgcaannatgcaaacctgcgtcattggtgtcanncctntggtcantaatntggncacaaagcgattgccaagtgatgcggtacaatgctgcnatcaactagnacagattctcaacanctcagtgcgcattcatccatagcgtcgngcatttccatcatnatgcagnagcanc

SEQ ID NO: 102921 - DNA, 846 bp, Triticum aestivum
  unsure (1)..(846): unsure at all n locations
  Clone ID: PAT_TA_102921
nnnnaaanantagtttatacccctgctcgaaantaaccctcactaaagggaacaaaagctggagctccaccgcggtggcggccgctctagaactagtggatcccccgggctgcaggaattcggcaccaggcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcangccttcagccagtacggcgagatcctcgacgccaanatcatcaacgaccgcgagacggggaggtcccgtgggttcggcttcgtcacgttcngcagcgaggagtcgatgcgccaggccatctnaggagatgaacggcaaggagctcgacgggcgcnacatcaccgtcnacgaggcccattccnnncgttcctggcggtgggggcggnggnggtngctactctggccaatncgncggtggnngnatgctactggnngntggcangtngnnngtttaccntcgngcnccttggntttgnggttnnntntnaccnngatncatgcgntcnagctcgnatgnttcancnnctnantnntnccatnngngnttagtncntggatnnnncttnnnncnatcnntgcncctnntatnattntnttangtgtcctgcttnnttnttntntnnnnncanctnnncnntntntatancnnntnttntggatcntctcanttannttnanatntctcnaangtntttnnntcgattttnggnncncgn

SEQ ID NO: 102922 - DNA, 810 bp, Triticum aestivum
  unsure (1)..(810): unsure at all n locations
  Clone ID: PAT_TA_102922
nngggnganncnnntncngntgnggttaanggntntgntcnggnnnnnannnnngnttgnntnnnnnncnnnnnncnncnncccaaaggnagtttgatcccctgctcgaantaaccctcactaangggaacaaaactggagctccaccgcggtggcggccgntctagaactagtggatcccccgggctgcaggaattcggcaccaggncgnaacaaccaccaccagcaacacacacacacagagaagcgaagatgtctggccgcggcaagggagggaagggtctcggcaagggcggcgccaagcgccaccggaaggtgctccgtgacaacatccagggcatnaccaagccggccatccgtcngtctcgctcggaggggcggcgtgaagcgcatctcggggctcatctacgaggagacccgcggagtgctcaagatcttcctggagaacgtcatccgngacgccgtcacctacaccgagcacgcccgtcgcaagaccgtcaccgccatggacgtcgtctacgcgctcaagcgccaggggcgaaccctctacggcttcngcggctaggcctgcncccgctgctccagtctccgtngactctgactctgctaactgctgttctggtgctatgcgtttngtttctgaatgcgtgcgtgcgtgcgttgctngttccatcggtctgtgtaagntagnggatgggcggatggatctgaatgcaggnnagtttcgntcagagnggccgaaaaaaaanaaaaaaaaaaaaacttngagggggggggncccggtancccaaattngccctantnnngagn

SEQ ID NO: 102923 - DNA, 759 bp, Triticum aestivum
  unsure (1)..(759): unsure at all n locations
  Clone ID: PAT_TA_102923
tagnnatataagnagttgatcccctgctcgaaattaaccctcactaaagggaacaaaagctggagctccaccgcggtggcggccgctctagaactagtggatcccccgggctgcaggaattcggcacgaggccgcctcccgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccagcacgctcacgatcgtcgacaggcggcattggcatgaccaaagtccgaccttcgtcaacaaccttcggaccattcgncaggtcgggggaccaaaggagttcatggaggcacttcgcttgccggcgcctgacgtntccattgattgggcagttcgggngttggggttctacttccgcctacctcgtcgccgagagggtcgtccgtnaccnacccaaggcaccaacgnccacgaagcagttcnntggtggggaagtcnttaangccgggtgggnttnctttcacccggncaacntcgtggatnccgttttgggggaagccncntngggcnngggggtacccaaagattggngc

SEQ ID NO: 102924 - DNA, 715 bp, Triticum aestivum
  unsure (1)..(715): unsure at all n locations
  Clone ID: PAT_TA_102924
cccngnagtagttttgatcccccntgctcgaaantaaccctcactaaagggaacaaaagctggagctccaccgcggtggcggccgctctagaactagtggatcccccgggctgcaggaattcggcaccagcaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactgtttcagctcgttcagggtcagggcatcatccaacctcaacaaccagctcaattggaggtgatcaggtcattggtattgagaactcttccaaccatgtgcaacgtgtatgtctcacctgactgctccaccatcaacgcaccatttgccaacatagtcgtcggcattggtggccaatgaaaaatgcaagagttatgctaataggtagatggatcatcgttgcttagctgatgcaccaatcgttgtagcgatgacaaataaagtgggcgtcgccatcatgtgtgacccccgaccagtggctagttaagcttgggaaataaaaagacaaaccaaagttttggtttgctaaaa

SEQ ID NO: 102925 - DNA, 1176 bp, Triticum aestivum
  unsure (1)..(1176): unsure at all n locations
  Clone ID: PAT_TA_102925
ccanncaatnnagtagtnttaaacncttttangaaccnaccctcactaaagggaacaaangctggagctncaccgnggtggcggccgctctagaactagtggatccccngggctgcaggaattcggcncgagaagcgngacncgccgnaccganttgnctttntatncgtgcntctntttagcttaattaggataggataggagagganaggataggngctccggtacaagngaacgatancaaatncttnngaanccatcngtttnatcgnngcnttncgcgnctnatacnanaaacaacaggaancaagtatgttntaggctntntcatctatnnntnctcnnaccgctcnatngnnntgntctnaacacgnacccctnttcncaanttcnnnntctntcntataacttacctcatnctcntccggtttgtatttctnnntttannttttnnngtantatcnttnttttctccctattcngttncgnntcgcattntcnnanacgtcacncaactncgctagtgttccatcatntgcannctnnatnnnntnactcgnnatatcantgcntcntngnatatctgctatntctactngtctggnnactnacgcgacttngnctanactcgttntcctanattattactatcacttnatatntgtcgnnanctnanatatcnctcactctnntnnnntaatatccnnatcatcgtttttcnatctatttgtcattanttcgntnaatatnngttctcattctnctcctgnntntctnncttattcntnactctctactgnggtctatntgtntntttntccgntatctatgcgcgctctatcantntacatntnntgattntntnttcntcgcatnncatnnntactacnttntgnntnttcgantatnantnctatacntnatattntnccacntctcgttccctnactgtcacacgcnctctncacgtctcncnatatcgnnctctatntntancgacanctntctntttntgncacattctncnaaatnnnnnnntcttnagtctctctntntctcttggtntctcgnnnnctcngtatctcacnttntctctnntcngngantntgtagaatctnggntnttngggnntntcganagtntcggtantctcgnataccntntatcnanatacn

SEQ ID NO: 102926 - DNA, 1144 bp, Triticum aestivum
  unsure (1)..(1144): unsure at all n locations
  Clone ID: PAT_TA_102926
cccncccannagtagtttaaacccctttcanganccaaccctcactaaagggaacaanngctggagctccaccgcggtggcggccgctctagaactagtggatcccccgggctgcaggaattcatgcacgaggagggtttntttcttttttttttttnttttcataccaatctcccataagnttnnnngttcgctctncataanaanaggcnangtnggangcntttggccnanccatgtcctacatgggccttccttngcttattccgagccnancnnaatactccaccnntttnnntctttanaaaanncggnntaaccantccnntttccnaannaatgnacagaanaggatccggnncanntcanatnnnannnagaatgttaancgcgaaccnaattctnttnngagggagaccnnnacnnaanattnaatccattttntgnttcccccaanttgatccnaaataggaanaanaattttnancnncttttgggnacnntgcgnnccngnaattctgattatntcgngcacgaaanaanatnccctattcntntnggccntggtatccgggccnacggngnnaattcnccaaaaanccganaaatttncgtntccgnttttctntcgnnaaantgnnnntccccntgtgtaaaaatcngcctntttgggnnnnncccagaaaaanacccanaaantntcgnacantntcgnnnttatttgggnaaatatctngtattccntncggaagnacnncatatatgtngaanaantantcgtgcncccnccggcaaattagggncttttgggaaaanatcccncaaatattcccccccttggngngttnntnncccngatagngggaantcccccaanntccgaaaantcttncacaanagaaanttccccttntgggggacntnccanncgcgggnncnnanagtggcnactccnaaatttggcntccggaaaaccccaaantgggatggngngnntcntaaaatccnantntcccnngggtaaaagaagaatangnnncccgcnatgcggnacttnntttgnanncctatntctcttatcgcgnctctcgtattncttntataggnccccaacnttnntatgggggattcnnctctnggttcg

SEQ ID NO: 102927 - DNA, 809 bp, Triticum aestivum
  unsure (1)..(809): unsure at all n locations
  Clone ID: PAT_TA_102927
tnngannnnnnnnnntcnnnnntnnnanatncnnnnnngnnnnnnntnnnnnnnnnnctnnantnnngnncnnnncnccncnncnnnccaccnaaggggagttttgaataccctnctcgaantaaccctcactaaagggaacaaaagctggagctccaccgcggtggcggccgctctagaactagtggatcccccgggctgcaggaattcggcacgagatcaaatccaagtaagtagnatttaacgaaaatccaccatgaagaccttactcatcctaacaatccttgcgatggcaacaacaatcgccactgccaatatgcaggtcgaccctagcagccgagtacaatggccacaagaacaaccacccccccagtcccaacaaccattctcccancaancacaacaaatatttncccaaccccaacaaacattcccccatcaaccacaacaagcatttntncaacctnaacaaacattcccccgtcgccacaacaacaatttncccagccccagcaaccacaacanccatntcctcagccccnacaaccccaactaccattnncccaacaaccacaacaaccattcccccagnctcaacaaccccaacaaccattttcncagtcacagcaaccacaacaaccttttccccagccccaacaacaatttccgcagccccaacaaccacaacaatgcattccccccaacaacaacaatggangattcagncatttctacaacaacagatgaacccctgcaagaattttcctcttggnncaatgcaacccntgtgncattgggtgtaactctng

SEQ ID NO: 102928 - DNA, 889 bp, Triticum aestivum
  unsure (1)..(889): unsure at all n locations
  Clone ID: PAT_TA_102928
nnnncngnaggncncncngngnnttnnntnnanncngnnannatanntncnantannntcgnannnncgcgannnntcnnnnnnctccnnntntnnctncnnctnnnnnnnnnccnnnnnnnnnnnnnnncnnnccnaancagaaganagtttnaatacccctgctcgcaaactaaccctcactaaagggnaacaaaagctggagctccaccgcggnggcggccgctctagaactagtggatcccccgggctgnangaattcggcacgagcatttncccaacaaccccaacaaccattcccccagcctcagcaaccccaacaaccatttccccagtcacaacaaccacaacaaccttttccccagccccaacaacaatttcccgnagccccaacaaccacaacaatcattcccccaacaacaacaaccaggcgattcantcatttgtacaacaacagatgaacccctgcatgaatttgccttctngcagcaatgcaaccatgtgtcattggtgtcanctctcgngtcaataattttgncacgaagtgattgccatngtgatgcagcaacaatgttgtcaacaactagnacaaattnctnaacagcgtncagtgngcagncatacacagggtcgcgccattccatcatcnatgcaacaangaacaacaacaaggcngtgacngatcctgcggccactatttcanctcgcccanggtctgngtatcatncaaccttaacaaccagcttcaanttggaaggggatcagngtcattggtatngaaaacttcttccaaccattgtngcaacgcgggtanagtgcccanctnacgtgcnccaccnttcaancggaccataatgncaancataanaccgcntggcattgggtggcc

SEQ ID NO: 102929 - DNA, 809 bp, Triticum aestivum
  unsure (1)..(809): unsure at all n locations
  Clone ID: PAT_TA_102929
cncgnanaataantagtttgatacccttgctcgaaactaaccctcactaaagggaacaaaagctggagctccaccgcggtggcggccgctctagaactagtggatcccccgggctgcaggaattcggcaccagnanangaattcctacnaccccnaccgtntagncnncgncaccacagctagataagaaaaaaagagagagcagaactcgttgggagtgctcgagatctgtttngggagagggggaattcttgagatcggaatcggaacaangcgggcncgctcggnatctngggttaccatacaatttttcccaggaaccttttntgaatgttctaatggagtnaaagggtngcnaaaagtctagcagtatgtaatgtccctgatgttcgaagctcccctcggntacagcattgaanacgtncnaccttctggaggnccaaaaaattctntgnttnattnttnaactnggcgaaanaancccntncnctntaatnnggtttttgggattcccctttnccgcnnnnttananatttttttttncnanttttatttttgaacccttttttttttccancccnanttttttttttgctcnttttttttnntnngaatattttcggacncagtttntttttagttttatacctcccccttcntgtgtnncttntcttgcttnttgcnttttcttggcttcaaaaanctngcaaantattnggctttggcccctcnnaccctnttagcaatttcgggnttttgaggggcttacntaanaaggcccccttngganaantcaccctntttcccg

SEQ ID NO: 102930 - DNA, 733 bp, Triticum aestivum
  unsure (1)..(733): unsure at all n locations
  Clone ID: PAT_TA_102930
ccctcccatattngcagtttgatcccctgctcgaaattaaccctcactaaagggaacaaaagctggagctccaccgcggtggcggccgctctagaactagtggatcccccgggctgcaggaattcggcacgaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctctttacagcaatgcaaccctgtgtcattggtgtcatccctcgtgtcaatgatcttgccacgaagtgattgccagggtgatgcaggaacaatggttgccaacaactagcacagattnctcngccagcttcagtgtgcaagccatccatagcgtcnntgcatttcatcgtcatgcagcnagaacaacaaccangg

SEQ ID NO: 102931 - DNA, 962 bp, Triticum aestivum
  unsure (1)..(962): unsure at all n locations
  Clone ID: PAT_TA_102931
ggngnggnntttnaannnttananttaaataaaccntccttttttcttaacggaaaaattttttaaanaccctcccactttttaaagggggggnaaaccaaaaaaagnccttgggggaanggcccttcccaaaccccggccggggttgggggccgggggcccccgctttcnttaaaaaaaaccttaaagnngggggaaattcccccccccccngggggcctttgggnaaaggggaaaaatttttcgggggnnaaccggnaaagccccccaaacaaccccaaaaaactttttttncccccccggtnccttggggnctttttttctttttctttcnggggcggggganngggccgaaaacccggaaaccnaaaaacccccttaaacccccgnccccgaangggaaaacgccccaaaaagaatcccccaaanggcccgggcggaacgaattgggcccggcggtttcggtgccccggccgaaggaaggcttcggcggntnttttgctcaacgaaccangcgggggtcgcggaggaaggaccctgtcgcccaagaagtnatgcctccgcantctcacaaggctcgggangatcnaggtggcgacgacacctctgaccaggcagctatcctccgcagttcgggagatgtcgaacatcagaagaaagaggatgactgtgggcggggtcaatgagacctaagaggtgacgactcaaaaaaagaanaaaccaagtgcttaaacaccatgatatcatcgaccggcgttgagagttgtctatgatctttcaagggacagtgntatgtggtgtgtactgttttctngagtgggctagaagcgtanccaancgtaccaaggaaaacgtgtgaagaacaaggtggaaaaatgagaaccaaagatggccgnccaacttggtttatgtttaattattgaccccctgaagtttggctagctagcactatgcttcgtacg

SEQ ID NO: 102932 - DNA, 807 bp, Triticum aestivum
  unsure (1)..(807): unsure at all n locations
  Clone ID: PAT_TA_102932
gagtgttaagnnaggatactctttnnngaatngnacaccctttgntcgaancaaccctcactaaagggaacaaangctggagctccaccgcggtggcggccgctctagaactagtggatcccccgggctgcaggaattcggcacgagtagagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattcccccaacaaccccaactaccattttcccaacaaccccaacaaccattcccccagcctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgngtcaataatttgccacgaagtgattggcangtgatgcagcaaca

SEQ ID NO: 102933 - DNA, 785 bp, Triticum aestivum
  unsure (1)..(785): unsure at all n locations
  Clone ID: PAT_TA_102933
aaaaaaaantttanaaccctttctcgaanttancctcccttaagggaacaaaagctggagctccaccgcggtggcggccgctctagaactagtggatcccccgggctgcaggaattcggcaccagaacaactccagtgcgcagccatccacaacgtcgcgcattccatcatcatgcagcaagaacaacaacgaggcgtgcagatcctgcggccactatttcagctcgcccagggtctgggtatcatccaacctcaacaaccagctcaattggaggggatcaggtcattggtattgaaaactcttccaaccatgtgcaacgtgtatgtcccacctgactgctccaccatcaacgtgccatatgccagcatagacgctgtcattggtggccaatgaaaaattcaagagttatgctaataggtagatgaatcatcgttgcttagcttatgcaccgatcgttgtaacgatgacaaataaagtggcgtgcaccatcgtgtgtgaccccgacatgtgctagttcaagcttgggaataaaagacaaataaagttctagtttgctaaaaaaaaaaaaaaaaaactcgagggggggcccggtcccaattcgccctatagtgagtcgnattacaattcactggcccgcgntttacaacgtcgtgactgggaaaaccctgcgttcccaacttaatcgccttgcagcacatncccctttcgccagcttgcgtaatagcgaanaggccgcaccgtcgccctttccaacagttgcgcaacctgatgggnatggnaaatt

SEQ ID NO: 102934 - DNA, 1346 bp, Triticum aestivum
  unsure (1)..(1346): unsure at all n locations
  Clone ID: PAT_TA_102934
ntgngttnantntatacccttctcaatttnctccttaggnanaaagctggagctcaccgcggtggcggccgcttataactagtggatcccccgggctgcaggaattcngcacgaggtaatttccagctccccggaggaantagaaagaaaatggccgnaatgtagggacnaanccggattaangtgggtnacgctgtcnatgantgcccgaggtgnagntccacccttttcccnnattngatatcntaccttnanggaaacggngncgtttacgccaccaaggtcggtccgganttacggggttaccccnccccattattatcccttcgacctnacccggtcacctttgnaaagtaacccctaaaantcnggcctttaaaaaggtgcgcctaggggaattcattttgggtcggggccnanaaanaaccttgggganccagattgggaaccgaaaacaggagggaaaaggaaaccccccagccnaanttacaatttgaacgnggggccgncccccaattcccttgggcatttgcccnttcnttaancccnaattnggccggggganaaaacgggaaccccccaatgnnnaantggccntttnggggggcttaaantngccctttgggcatttacngggcccccggaagcctttttttggaaccccccaantttngggaatccncccaatcggggggcaaanggggccgcttaanaaanttttcccccccnaaaaagcnaaattncctnaaaatcnttttaccccggtnggnccntttttaattttcnccnnccccaaaaaaaaaaaaanactttncccccccgcccntttttttgggaacccaanttcccnaaaaaanaaaannnggaaangggggccncnaaaatttttgccnccccccccaaaanggaaaaaccaaaaggggaacccnnttcccttnaccccattaagnttgnccncnccacnaatttttaaaatgaaaaagnggttgngggcaaaanancctanaangggaaggttaatgnaaaatttncccccgcnaattaanacnaattaaggccccttaattcnccaaggttgtnttgggaaantccgatttcnccantttntccttgnaatggggancnanaacaacacaagcgacgttctttttntggaactaatttntaacnaatcnaaattaaattattcttgccacnaatttttnttgnggangggaaatggggtttaaattcaatggccaattcattttcaaaaatcnttgnttgnnccnnaaattttggaancattaaancttgtggcngggttttaataacttaaaaagcngggntnnctncaacttnntaan

SEQ ID NO: 102935 - DNA, 793 bp, Triticum aestivum
  unsure (1)..(793): unsure at all n locations
  Clone ID: PAT_TA_102935
gngggnnnnnntttantcccnttgnannnttgatacccctgctcgaaattaaccctcactaaagggaacaaaagctggagctccacccgcggtggcggccgctctagaactagtggatcccccgggctgcaggaattcgggcacgagagcaaccagttacattcttcagggaggttcttgcactttgtgatcatccagacctgttgaaaaaggaggaaatcaaaacattgttcaagtgctgattctatttctcgagcaaagcagattcttgccttgatacctggaagagcaacaggagcatacagtcatagccagggtataaaaggacttcgtgatgcaattgcttctgggatcgcttcacgagatggattccctgctaatgctgatgacatttttcttacagatggagcaagccctggggtgcacctgatgatgcaattactgataaggaatgagaaagatggcattcttgtcccgattcctcagtaccctttgtactcggcttctatagctctttatngcngatctcttgncccatactatctcaatgaatcgacgggctggggtttggaaatctctgatgttaaaaaacaactcgaagatgctcgctcaagaagcattgacgttagggcttttggtgggtatcaatccangaaatcctactggacangtcttgctgaggaaaaccaatatgacataagtgaagtctgcaaaaatganggcttgtcttctggctgacgagtatccaagaaaacatctacgctgcaacaagaaattcactctttcaagaaaa

SEQ ID NO: 102936 - DNA, 788 bp, Triticum aestivum
  unsure (1)..(788): unsure at all n locations
  Clone ID: PAT_TA_102936
naaaaaaaaatttaaaccctnctngaattnacctcctttgggaaccaaagctggagctccaccgcggtggcggccgctctagaactagtggatcccccgggctgcaggaattcggcaccagatgtcatcttgcaacaacacaacatagcgcatgcaagctcacaagttttgcaacaaagtacttaccagttgttgcaacaattgtgttgtcagcagctgtggcagatccccgagcagtcgcggtgccaagccatccagaatgttgttcatgctattattctgcatcaacaacaacaacgacaacaacaacaacaacaacaacaacaacaacaacaacaacaacaacaacaacaacaacaacaacaacaacaacaacaacaacagcagcaacaaccgtcgagccaggtctccttccaacagcctcagcaacaatatccatcaggccagggctccttccagccatctcagcaaaacccacaggcccagagctntgtccaacatcaacaactaccccaatttgaggaaataaggaacctagcactgcagacgctccagcagtgtgcaatgtctacatccctccatattgctcgaccaccattgcgccatttggcatcttcggtactaactgagaagagaagaactctagtactagatatatgaaacactggtttcttagtccatggtttggtcattgtagcggtgagaaaataaagtgacatgcactatcatgtaagaacccgaactatactagtcaaacttggggaatnaaagacaacacangtttgnct

SEQ ID NO: 102937 - DNA, 1368 bp, Triticum aestivum
  unsure (1)..(1368): unsure at all n locations
  Clone ID: PAT_TA_102937
gtgngaaaaatgnganacttgaaaaatgtatcacttnaaaaaccaccccggatcaaannncnacngaggnnnntctanaactagnggatcctcggnctgcaggaatctttcaccngntnagagaanatngnntnnanggggagaagggcagnangntgaacncntaannncatnntngtacacnctanactcatncaaanatantccncgnagacngggnnatatggctnattnngntcannngcccantaattgntannntcnacncctnnagcgggncctangntncanaaannncgcatcnaanctagacnttccnagtttntcnctnccagaggaacgtccnatntcatancnacnatngtgtcttttcgcangngtgaatactctgnctanaccgtcntgatncnactttatgtgctctcgcannaatcccctcnngatatccaaaantagcnaattgttngcatcngccgccnatnccntnaaccccctccnaaaatcntgancnnttnttcnnttngtgnnnccccaagagnacncntncaggatngatanccncccntccanttcatataacaaatatngnnggngnttgcnactattgcgccgnctcgatattcananacnggngagntganatcgggggggtgtgaatnanancgcnnnnnnnaggttagnntccnntatataagntggcgcgaggncannacaaccctatctggtgnannnntacgtnctgcttttngcgntcnngtcntntnaanactttctnnaanctannnagngcctcnaanaggnngngatngcgcncatntnttnctccncccacngattgtatnttccgngnnggtataaccncntcancgagaagaataagnnttcgtgnttgtgagtgctacctatgggngccnctaatccngttgngnnaattttnnccntcgggtngnngngcctccctctanngcangatangtccatccacnccgnntnttntaaattgtcncgcncctctnatatccgtaacgaanncncncanantgcngncgaggaantttcgtaaaacannnaatntgantcgtngcgaaaancnaanaccatgngtgggnnanaaccncnccnttgccantaggtaaatnttgtatcgtnnctttngcncaaccnaattgggcgaannaacnctgntgtgtcancttntgagtnggtcaatnancnnttcngggnacnaaaatgngatcctttgnncnancncaaanacagnttatgccnntnaggngtganngcngggnntatccnatnggngtgcgcatacntacnnnngagncaagatttaccttaaancannntccaanngngggaaatcnatcc

SEQ ID NO: 102938 - DNA, 917 bp, Triticum aestivum
  unsure (1)..(917): unsure at all n locations
  Clone ID: PAT_TA_102938
gtgngtgnttaaagtccggatctctttctcgaatnnaccctcactttaagggaacaaaagctggagctccacccgcggtggcggccgctctngaactagtggatcccccgggctgcaggaattcggcacgagcccctcccccccttnnnnnttcttcttcccccccgncgncgntcccnnattccncnncatntcnacnganaanaancannttaaccccatgcgggatatnaangtgcanannctcgtncttaacntcttccntcngtgagagcggagatcgcttacccnngcctttcaaggtgctggagcanctganccggacagtcaccnttgttctcanngctangtcactntcangtcgttcggtattangcgtaatgagaagattgcgtgcttcgtgnctatcangngtnagaaggcgatcnctgctggagagtggcctgaanngtnaaaggagtacnanctnnttcaanganngaactttatncgaccnccggcttgnttttgnntttnggtattncaatganncacaattcnnttcttcnggcnttgaaagtnttgatccanttttacccggcattntaccggtattggncctttcttttgtngtgcttcgagccgttcctnnggtacccgcgtttttcccgnccncccgcattgttgcanatgccccgncnttcggttnttccacccnnaanggttcancccannngganggaaccgcccattgaaanntgggtttnccanggntccaangttnccgaangggntgntcattccctttaaaacaaanntccccatttccnaagccttaaanaaaagggattnntnnccttttttngtttaanaaccctttnaanttttaatttaaaatttccaacccttnggtttnncnttggnattatttntttttn

SEQ ID NO: 102939 - DNA, 812 bp, Triticum aestivum
  unsure (1)..(812): unsure at all n locations
  Clone ID: PAT_TA_102939
anaaaaaaaaagntttgaaaccctttgtannntntnattacccntgctcgaaattaaccctcactaaagggaacaaaagctggagctccaccgcggtggcggccgctctagaactagtggatcccccgggctgcaggaattcggcacgaggccaagtacaatggctncaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagcttcagcaaccacaacaaccttttcccagccccaacaacaatggccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattggcaagttgatgccggnaacaatgctggcaacaactagcacagattnctcaacagcttcagtgcgcaaccatncatagcgtcggtgctttcatcatnatgcagcagcaggg

SEQ ID NO: 102940 - DNA, 965 bp, Triticum aestivum
  unsure (1)..(965): unsure at all n locations
  Clone ID: PAT_TA_102940
aaaaaaaaaagtggnntcnctntctcgaatctncnncctttagggaaccaaagctggagctccaccgcggtggcggccgctctagaactagtggatcccccgggctgcaggaattcggcacgagagagagagagagagagagagagagagagagagagagagagagagagagagagagagagaganngcagggcncnnccgtctctncnctncnttntcgcnttntnngatctttcccncncctcgccccgaaagattntnaaannngttntacgccnntgngttttttngatccnnntganctgtnangnccttnnnccgnctncnntgtngccttcnngnggaacctacttttttttcacnnanncngatttnntantacaatnngcaccaacttttttaatcattntnttntannttanaanccccttcattgttttanctaattgannngcnatttnnagttcgcctctcnnnagtnntcnttttctctcttttttnggcnnaatttnttttataaatnttntngnnncaanaggnntcatttcaaaatttttnntnncccgnatttnccttnntttnaattanagggtngttttncctantaataatncnttatnnatntnttggnnanttttggnnanncccccaatttttncntnngnncnnatttnttntnttttnnntgncaatttngngnnnnnatttcctatatnntttannttnggananaattctttttcntacttatttnttctttnnaannaaatnttnctcnntcntgnctattntttgnctgntttttntnanggngtttcacatttttatntnattnatntcntttntttgtntntnngtgctncccccntntaantgngttttnnntttaaanacnntttgttttntttttttttntnaccnttttctnatanttacnccntnttctctctttgnaaannnttnnc

SEQ ID NO: 102941 - DNA, 864 bp, Triticum aestivum
  unsure (1)..(864): unsure at all n locations
  Clone ID: PAT_TA_102941
naaaaaaattaaaaacccttntannnntttattacccntgctcgaaatnaaccctcactaaagggaacaaaagctggagctccacccgcggtggcggccgctctagaactagtggatcccccgggctgcaggaattcggcaccagtagcgccggcgcctccacttctctgctccctcctctcctcgcgcgcagggcccggcgaaagggaagcaagatgtacaccgccaggaagaagatccagaaggacaagggcgtcgagccctccgagttcgaggacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgtggtctttgttgcaacaagaaagattgtgaaggccaccccaagaaagggttctggttgtttcaacgccctcgcaccaagaaccccttgacagctggtcattgaatgggtattcnttggaaggaatgtncgtgtaccccagcttgaagaattgtgggggaaagccgtgtcaanataacccgttttgggaatgggtgcccaaagggtcantcaaagaatcttacnttgggaccccaaaaggaagccgccaaccaacacttggaantacaaagcctgggaagaccctttttcttgcaagtctacccgcaagcntttgtggggaaaagacgtttgtcnttttgagtaccctgtgacttgnaaaccgccctgaaaan

SEQ ID NO: 102942 - DNA, 1243 bp, Triticum aestivum
  unsure (1)..(1243): unsure at all n locations
  Clone ID: PAT_TA_102942
nggnnagnnnnnnnnnnngnttttttgaaaaaancccccnttntgaaaaaaaaaaatttttgaaaactcccccttttaaggggggaaaccacaaaaagnctnggggaagtcctcccaacccgnccgggtggggcccgggcaccggcttcnttangnaaacgtaaggtgggggaatccccccccgggggccttggcaagggaaaatttccggggcnacccaaggcntttcccctttcccctttcccctttttccctttttcccccgcccttttggtccctctttctttccaacctcgggggccggaaattgggctttttggcccaagaaccaagaacaccggcccgangaatggggaaggggggagggggtgcttggcngnnnccaancgnnggaacgcttgggcgggaccaagctggnccggcggtgggggccccggcccggccggncggngcccggcgggggnaagnccgggcttcctggaaaccttnccggngaancttncntnaaagcttggngccgaacgaagggaacgacgggncgggccggggcccggccggngggtcacccttcaccttnccgncaatggcaagggcccgaaccggnccggggccctccttnctttnggncggnccttnccttccaagcggcccggnccgtcggntttggnccggnccggccgnggccggggaacggcttgnttcggaacaatcaaatcccggnggaanggaaccaagncccngggntttccccccccnggccnttnggnaacggccccggngggggncttnccggnaaaacnggggccgggtnngggcgnaaccccggtttcggtncccggccggcggccggggngggtccccttgcccggggnccccccgggggcccccgggngggttnggacntaagaaaccccggtgggggcccggnngcccngggnggaacaacccttnccggggaaggggcggtnnggnccngnncnttaaaancccggnccggaacnggggaatcaaagggcggggnngggaagggaaaagaaaggaagggaancnanggggggggaanccggggnnggnnncccntnaaatgggggngnctnggnnngggnaacnaanaacngggaanaaagggcnaannnggggaaancgccccnggnnnncnnaaangggnnacnaannnaangggannccnagggaancangggnaaccccnggggngggnnnnnncccnnngnnnnnggnaanc

SEQ ID NO: 102943 - DNA, 704 bp, Triticum aestivum
  unsure (1)..(704): unsure at all n locations
  Clone ID: PAT_TA_102943
aaaaaaaatttaaaaccnttctcgaantttacctccctttgggaacanaagctggagctccaccgcggtggcngccgctctagaactagtggatcccccgggctncaggaattcggcaccannaacatttgaccctgtcccctgcngcccttatccctacnccncanattcgggggctaccaannaaagccccgattcncagaatanttgnngcccnaggtcgcgnggggtgccaattgnaancatcgactggcttccanccccaaaagtggcagctncggnaatccctttgctgnactgtgtaaggcataaacgtaacagcnnaaatgttncgcagntnatactttggntnttctataatgatggaagcngggcaacnttccccgggataattgntgccagnaagcnccaggacggtgntgtcaactnttncgacatgnnatactaccanangctnggggagggctncacatgtncatngatngccttatnatcatgctaaccatantgccggcggttcataatgtgtgannacaacattngtgtgactctctgctngctactgaatcttaccatctaccacatctgctgtntgcntatntctggtggacanatntacnntncaattctatgctgctgtatcttgccatnttgtgaataatccctgnactaagtatatggtnacntgttgcactnctgtattn

SEQ ID NO: 102944 - DNA, 836 bp, Triticum aestivum
  unsure (1)..(836): unsure at all n locations
  Clone ID: PAT_TA_102944
aaaaaaaatttaaanccctnctcgaaactttaacncccntgcnngacantaaccctnactaaagggaacaaaagctggagctccaccgcggtggcggccgctctagaactagtggatcccccgggctgcaggaattcggcacnagnnncaaacngcnncngcctcctcttcttccatctttnnccntnnttggannnttagccttgnnnannganaagactcanatgaannngggnggcattgnccatgncgactntnnnanntgnancnccactgnncatnnannctncaannntgnacntannnacangnaccnnatngngaggnnngngaangaaccccntgntatnaacnatnggncnntgatgnacccctgnggnctngannngntncaggnngatcaccaaagnggtanaaananngntantgnccnnnggnangantggaccnncnnaacctacngnnnngnacttaangcncntgntgaccntgantncttcnagnanangattnctnntnnctctcacaatgaccggcttnttntgnttantgactacanncnttgtggatgcccatnggtggctntatctnatgattgaccaaaccncttttggacaatcatacttgctttccntattggaggtgaaaacnttatnatctgatactcccaacatgatacaattccntcacancccccaaagnantctgacggaccccatatgaatggaatttcgagaanagaaaggggncctttaaanacctggaaaaagngcnnggttgcnaaagacttgaacaangngttgcttttggcccncatnacatgggnnttaccngtn

SEQ ID NO: 102945 - DNA, 780 bp, Triticum aestivum
  unsure (1)..(780): unsure at all n locations
  Clone ID: PAT_TA_102945
gcggagnnnntttantcccctnctcgaaacatttcntcaccnangggaacaanagctggagctccacccgcggtggcggccgctctagaactagtggatcccccgggctgcaggaattcggcacgagggccacacctcgactcgctccctcgagtagatcatctgttccatccttttgaggcgagatggcggctaccttcaatgttaacgctgaggcaggccttaaaaagcttgatggctaccttctgtctcgcagttacatctctggataccaagcttccaaggatgacttggctgtgtattctgaattctcagttgctccaccatcaacttgcaccaatgttgcaaggtggtacaatcacattgatgcactcctgaagctgagtggagttactgcccctggtcaaggtgtgaaggttctgtcatcagttgtccctgagacctcaactactgatgtggctgaggctcctgcagctgatgatgacgatgacagcgatgttgacctttttggagaggaaaccgaagaggagaagaaggcagctgaagagcgtgctgccaaagctaaggcttctaccaagaagaaagaatctggcaagtcatcagttttgcttgatgttaagccatgggacgatgagactgacatggtcaagctggaggaagctgtccgaacatcaagatgganggccttctgtggggtgcttccaagcttcatgccagttggatatggcatcaagaagctcngattntgatgncnntttttggacctcgtttttgcgacac

SEQ ID NO: 102946 - DNA, 973 bp, Triticum aestivum
  unsure (1)..(973): unsure at all n locations
  Clone ID: PAT_TA_102946
gnggagnnnntttaaacccctnctcgaaanatttgatacccatgggaacaaaagctggagctccaccgcggtggcggccgctctagaactagtggatcccccgggctgcaggaattcggcaccagaatntancanngggntnncccattnnnnnanancacnngncaaanancnnnntnttgtgcnnanggtgccnncatgggtccgnntantnctgccncnggggntgntaggccttgctancnatnnntnaancngnctnntgnntcncnannnngttacaganatagacncanttttnntcctgaagagcggcttacgtgatgtaacggcatattgaagacctcntccnngttgtggtgnncnntggngcttggttcttcatgacttgccacgacgnccaatgctatgnaacgccntaggntggcttactgaacttgtgatggancgactgtacncgacgacctntggcataactgggaccggcntccaaaanattgcggggccaatttggnttggacanaccccacttttttntnccggaanccggnggtctnccctaaannngaaaacttggggttttggggcctttntttacccaatcncnaggganttgaaattgccccgggaatttctaattncccccaacaaaactagaacgttttattgccngcggncctccgtggggttcnccccacctctttcatnggggacccctgtgtctttaagcccactagtgacctcgtgccgatgggcnttattcntttggcacaaaacaaanggcnggcncccctagtttccaaagaanagangcctttgcactttgccnccttggcacccttttgganggggaaatatnaaaaattggcccggnaagccnttnccagncttaaatnggaaatcnccgccngtcgnngngccccaattgggaattaatcttggnattcccggaaccgaagggtttaaactttgg

SEQ ID NO: 102947 - DNA, 793 bp, Triticum aestivum
  unsure (1)..(793): unsure at all n locations
  Clone ID: PAT_TA_102947
gnggtgnnntntanacccctttcnngnnnccntntgattacccctgctcgaaattaaccctcactaaagggaacaaaagctggagctccacccgcggtggcggccgctctagaactagtggatcccccgggctgcagggaattcggcaccagtgacactcatcttggtggggaggactttgacaacccgtatggtgaaccactttgtccaagagttcaagaggaagcacaagaaggatatcagtggaaaccccaggtctttgagaaggctcaggacttcttgtgagagggcgaagaggaccctttcttccactgcccaaaccaccattgagatcgattcactctttgagggagttgatttctattccaccatcaccagggccaggtttgaggagctcaacatggacctcttcaggaagtgcatggagccagtggagaagtgcctgagggatgccaagatggacaagagcactatccatgatgtcgtgcttgttggtgggtccaccaggatcccaaaagttaagaactgctgcaggacttcttcaacgggaaggagctctgcaagagcatcaaccctgatgaagctgttgcctacggtgctgccgtgcaggctgcaatcctcagcggtgaggggaacgaaaaggtgcangaccttcttcttctcgatgtgaccccactgtctcttggtcttgagactgctggaggagtcatgactgtgctcatcaccaggaacaccaccatccccaccaagaaggagcaggtcttcttcacctactccgacaaccagcctggtg

SEQ ID NO: 102948 - DNA, 1239 bp, Triticum aestivum
  unsure (1)..(1239): unsure at all n locations
  Clone ID: PAT_TA_102948
aggagnggagaggtnnaannnnagttgnnngaaaaagccccccgnttngggaaaannnncccttagnnaaaaaaacncccttngggnnaanggaaaaancccaaacncctncaactttaaaaanggagaagnnnngnnnnnngngngggnnnannnaaanaannnngggggggggnannanangnntngnnnngnagnnnagagnaaannnnnggattnnnnaagnngnggggggnaagnngnnngnnanagnggggggggggggggnnnagaannngagaggngnnanannanggangnaggnngnggnggnnananangngggnnaganagngnggggngnggggngggnnanganggaagggcananggnggnnanangaaaggganngangnnggngganangaaggaggnancaggaggnaggagnagnggagggnngggggagaaananaaagggaggnngncgngagngaggaganaanaaanggggnanggnnanngngaaaganganagnanngaggnaggaggggnnaaananaaganacgngnnnaanaaggnagggggnaagggannannggagaggccaananaanagngagnnnggaganaggnaagggngnnggnggnnacnaggnagaaagnanggaagaggaaggggnanagnnnngnggaaaagagaaggggaggngangnangngagagngagcnaanggnaggagagggngnnngagagnnnagaaaaananagggnnagnagngggngnganaagganganngggngagggngaganaggggggncnancngggncggggggggngaannnnanannaaanggagngggnaggggngcncaananangcaggnggnggggngnnnaaannnggnnnnanagganangagggggngaagggaagagggnggganacgnaggnaganganaaaanagnanagangcannnnnanaannggnngaaagganggggggggnganngggggggagagnacgccgnaaannggaggngagnaanagggngnnaagggnagangaannganngggngnnangnngnggagangggnangagngannacaaaagnanacgnggaaancggggggngnngagangaaagngagangagagangnangngangnngnggggggcgcgagaagaganangaagangaaagngagagnagngaaggggaanacncggagagngnngangg

SEQ ID NO: 102949 - DNA, 1017 bp, Triticum aestivum
  unsure (1)..(1017): unsure at all n locations
  Clone ID: PAT_TA_102949
gaggngtanntaaatgacttnttnaaaaaactttnacncccnttgggaacaacnngctggagctccaccgcggtggcggccgctctagaactagtggatccctcgggctgcaggaattcggnncgagagaaatctcttncctcgcccaaaccctngccgccgccatggncgccgccacctcccccgccgnnnnattntccggngccgccgccgncgccgccgncatgcccaagcccgcccgccagcctctnccgcgccaccanaccgcctngngcngtgcgctncccgtccgtgtantaggtgctgcgccgtagcncntccgntgatgtnanntttcatcgtgctccccnananctaanttttgtncttganngcctnncnnagncccccgnaaaggnntcctaanagtaatttgttnnangcannntttgagnctctnnaggtnattcagttnaannttaatangnctncnatccccctngtngngagtcgttctcntnggnatnatatcnnncaaaagngggcgtggatnagcnggttaatatctcgtntgnaattcaaantcatacntcaccctcnatnttnccgtncancntaagnantngactggaangnncggnttnngctagggnnanatccagtgaataancnncaaccgnaggctnttccncctnccanatnntnttgcaanatcttngcttcaanantcganttttncatngncttcgggngggngcancactaatactttntttnttattccgatacttggggtttgaantggcgttttnctcncttngttncantttancgtangggnnctcncaattnacnngggcntccaagngngatctccccgcgtnnactnatagatattcgtgnctcttgnatacngncgnatntccgtggtacnancanncncaatttntgngtagnntntanngttntcttntcatctncttattnagnnnagactatnctttgtntctctttnntncgtagttacnnnnatttnnt

SEQ ID NO: 102950 - DNA, 779 bp, Triticum aestivum
  unsure (1)..(779): unsure at all n locations
  Clone ID: PAT_TA_102950
gnnnnttganaccctttnngnncnttgatacccctgctcgaatnaccctactaaggnacaaagctggagctcnccgcggtggcggncgctctagaactagtggatcccccgggctgcaggaattcggcacgagccgccggcgctnctcctcctnctctcggntccttctccttccttccagtttcagccatgggtaaggagaagactcacatcaacatcgtggtcattggccatgtcgactctggcaagtcgaccaccactggccatctgatctacaaagcttggaggtatcgacaaagccgtgtgatcgaaaggttcgagaaggaagcccgcttgagatgaacaagaggtccttcaagtacgcctgggtgcttgacaagctgaaggccgagcgcgagaggggtatcaccattgatattgccctgtggaagtttgagaccaccaagtactactgcaccgtcattgatgcccctggtcaccgtgacttcatcaagaacatgatcaccggtacctcccaggctgactgtgctgtgctcatcatcgactccaccactggtggttttgaggctggtatctcgaaggacggccagacccgtgagcacgccctccttgctttcactcttggagtgaagcaaatgatctgctgctgcaacaagatggatgccaccactcccaagtactcgaangcccgttatgaggaaatcgtcaaggaagtctcttcgtacctgaagaaggtcgggtcaaccctgagaaggttccttcgttccatcttggggttg

SEQ ID NO: 102951 - DNA, 835 bp, Triticum aestivum
  unsure (1)..(835): unsure at all n locations
  Clone ID: PAT_TA_102951
gnggnngnnttttaaaccccntnctcgaaanaatttttacccnttggaacaaaagctggagctccaccgcggtggcggcccgctctagaactagtggatcccccgggctgcaggaattcggcaccaggtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggntatgggttggtggattcccagganggaaggaatggaaaggaaggatgttatgaccaaaaatgtttcaatctacaaagctnaagcatttgctcttgaagctcatgccgnccccaattgccaagggttttgtttgttggcnaccccanccaacaccaaatggttnttanttctggaaggaggtttggttccattctattnccttgnggaaanaacaatcaatttggtttggaccccgccctaanaaccaccaacaagggccaccttcggtcaanattttcttgagaaaactttgggtggtnccaagtttcttgacgtggaaagaatgcttatttatcttgggggtaaattactcgtcccagtcagtaccctggatggttaacccacncnn

SEQ ID NO: 102952 - DNA, 1021 bp, Triticum aestivum
  unsure (1)..(1021): unsure at all n locations
  Clone ID: PAT_TA_102952
gatgtntccnttagctcgaanttaaccctactaaagggaacaaaagctggagctccaccgcggtggcggccgctctagaactagtggatcccccgggctgcaggaattcggcacgagcgaccgctccctcgacccgcatccgctcgcagctcgaaccaaacagagatcgtcagccatgtncgggcgcggcaagggaggcaaggggctcggcaagggcggcgccaagcgccacaggaaggtgctgcgcgacaacatccaaggcatcaccaanccggcgatccggaggctcgctcggaggggcggcgtgaagcgcatctcggggctcatntacgaggagacccccggcgtgctcaaaatcttttctcganaacgtcatttcgngacgcccgttacccttncanncgagcacgccccgcccgccaangaaacgngnanccggccattgggaccgttnnnntttcttccccctttnaaaancccnaagggggccgngacccctctttnaangggttttttttnggggntttagannnnnnaaaaaattttttcgtgccggcaaaaacccgggngggnctttctttnnncccttttttggccaaaaaaaaaatttcccncccccccnncccgnggggggttggcaaaacccttgccnaaaaccncccgnagnaaaaaaactgggggcaataattctttttttcgggttcanaattnaaancttggtaagnccccggggaaacaaaaaatgggtttggncccttgttttttaacncccaaatnttttgttgcttattttcggcnanaaaaaaggggccttcnttaaggggttnaccccttttgttaaagcctttcccattggaaggcccccaagtccattggaannaatncggnaatnnttnttntttcgggctttttccccggnggcncccnnannaaaaaanttntnnntannttnccccttccnnangggggggggggggccccccgggnttnccccccaaattttttncnccccctatttant

SEQ ID NO: 102953 - DNA, 881 bp, Triticum aestivum
  unsure (1)..(881): unsure at all n locations
  Clone ID: PAT_TA_102953
gagncnccctttngatcgancttaaccctcactaaagggaacaaaagctggagctccaccgcggtggcggcccgctctagaactagtggatcccccgggctgcaggaattcggcacgaggaaggagtccaccctccacctggttctcaggctccgtggtggtatgcagatatttgtcaagaccctcactggcaagaccatcaccctggaggttgagtcctcagacaccattgacaatgtgaaggccaagatccaggacaaggagggtatcccaccggatcagcagcgtctcatctttgccggcaagcagcttgaggatggccgcacccttgcagactacaacatccagaaggagtccactctccacttggtgctcaagctccgtggtggtatgcanatcttcgtcaagaccctcacaggcaagancatnaccctggaagntgagttctttgacaccatnttccaacgtttaaggccaanattccccgacaanggngggggttttccccggaccaacaancggnttttttttttnnccggcaaacaacttgagggattgggccgcaccctttgcnggatttacaaacatttcaaaaaaggnattccaccccttncacctttgtnccttccgnccttcgtgggnggggcattgccaaaatctttttggtcnaaagaaaccctttaanccgggcnaaaaaancaatcaaccccttgggaanggtttggaaattcccttcaagaacaacccaatttggaccaaaatggtnggaaangggnccaaagaattcccaaggnacaaangggaagggggcaattnccccccccgggaanccaaaccaaaacgcccttggaattnttttttgcccngggnaaagcaanntt

SEQ ID NO: 102954 - DNA, 777 bp, Triticum aestivum
  unsure (1)..(777): unsure at all n locations
  Clone ID: PAT_TA_102954
gaganncccttgctcgaanntaaccctcactaaagggaacaaaagctggagctccaccgcggtggcggccgctctagaactagtggatcccccgggctgcaggaattcggcaccagatcaaaaccaagcaatactagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgnaacaaccaccattttngcaggaacaacaaccaggtnttncacaanaaacaccatttttttttnnaccncnaccaccnccnccnccacnaccaccnttttttggaggnaacaacnaccaagntnttccacaacaaccaccatttttacaaacaacaacaaccaccatttttcgcaggaagcaacaaaccatntttacaacaaccacctttttcacaaacaacaccaacaggtttcacaacaacaaatncctggtggtcaaccatccgttttgnagcagcttaacccatgcanggngttccttcaacaacagtggaancatgtngnaatggtcgcaacgtcttgnttaggcacaaatgtggnaacagang

SEQ ID NO: 102955 - DNA, 935 bp, Triticum aestivum
  unsure (1)..(935): unsure at all n locations
  Clone ID: PAT_TA_102955
ganannnccntagctcgaanttaaccctactaaagggaacaaaagctggagctccaccgcggtggcggccgctctagaactagtggatcccccgggctgcaggaattcggcaccagaccggnnttncaccgacntctngcctaggnggagtacaaccaccgtcaccnccaagaccaagatgggctcgnggtacgaggtggangtgaccgtggnctccnnccnngacctgaanaacntgaactggcgcaacngcngnctcnanccctacgccgtgctctggatcgacncnngcncgcgctgntncanccgngtngacctctacnncggagacaaccccagctgngacnagaaggtcgnnnncccnctgccccccnccagccgctggaggacgccgtgctctacatcgacgtcnttcacgccaacgcccgtcgaanggtgtcaagnncgntcctngggttnngcacnggttggcttttcagaaacgtaanttnaangacgncgggggttcnaggggcnaanngtggttgaaannaaatnntnaaaggcttgaaagcagggcccttnccgggccnggnnccccanggngcanagcnttggaacaatcccttcggttctccnctttgcaaaaggnaaacncccggcnccaacgggttaccttaancggaactttcccaanacggtttncccctttgggtnngggaattaaccccccgggcnttccccccggaacagggaatttaccngggntttacctttnccccgggggaattgcctnttttccgggngggnnggagcgtaattggggttgncccggnagnattgggtttnccntnaacggggggctttgaataagantggggggcttganaaanantttccagggggctnttacccncgggtccaaggggatnctctttncggtnggggggtaaccn

SEQ ID NO: 102956 - DNA, 667 bp, Triticum aestivum
  unsure (1)..(667): unsure at all n locations
  Clone ID: PAT_TA_102956
gangnncccttnctcgaantcaaccctactaaagggaacaaaagctggagctccaccgcggtggcggccgctctagaactagtggatcccccgggctgcaggaattcggcaccagtgtacattntgnggttngagtagatcnanagctggncnatttcnatccgtgtagggngcaacangatgccggcntatgcgcggatcatgctccggtgcttgcactggcgctgctcgtgcagagtcttcataagccagncccctgcntgtnngcnatcacgttgntgtgtnctacccatcattcggaaacaacacttccgctcgccgatncgacagtggntcaagttctacaaantgtnggngatnaccaacatgcacgtntactcaatccaattncaggccctctnaacgctaccggggttcngattacnctcaantgngaccaccnacnanganntggccgtctancaaaaacttttgtcgtcncgctggngcngcaacncangcctatacggcctntggngtgantcattcgtagaacgacttgcaacacccgccacatctgtgcatgagaacnnacacnctgcgcgagnctggagccgnacnnatatggtcacnntagtgcgtatacactntncgctcncgcggtgcanctntgcnatgctgtntgcna

SEQ ID NO: 102957 - DNA, 843 bp, Triticum aestivum
  unsure (1)..(843): unsure at all n locations
  Clone ID: PAT_TA_102957
gagcacccttgctcgactnaaccctactaaagggaacaaaagctggagctccaccgcggtggcggccgctctagaactagtggatcccccgggctgcaggaattcggcaccagcccccgtcgaccacaacaacaatttccccagccccagcaaccacaacaaccatttcctcagccccaacaaccccaactaccatttccccaacaaccacaacaaccattcccccagcctcaacaaccccaacaaccatttccccagtcacagcaaccacaacaaccttttccccagccccaacaacaatttncgcagncccaacaaccacaacaatcattcccccaacaacaacaatggatgattcagtcatttctacaacaacaagatgaacccctgcaagaatttccttttgcagcaatggaancctgtgtattggggggatctttcngngggaataatttttngcnncaaaaggattgccaccntgnttngcaancnacaantgtttggnnaaaaactnangganaaantttncttnaannaaatnccannngngggaggncatttcacaaacngtggggggcattttccattnttnatggcnagncaaggaaacaaacaaacnaagggggtgccagaatnctggcggggccactttttttnancttcggcccaaaggntttggggntntaattccaaaccttaaaaaaccannttnaatttgggagggggatcaagggcattggggattggaaaaattttttcaanccattgttgcaacggggntttgtccccaacttgaattgggttcaaccattnaaaggngggcattnttggccaagcataagg

SEQ ID NO: 102958 - DNA, 702 bp, Triticum aestivum
  unsure (1)..(702): unsure at all n locations
  Clone ID: PAT_TA_102958
ganacncccgttagctcgaanttaaccctactaaagggaacaaaagctggagctccaccgcggtggcggccgctctagaactagtggatcccccgggctgcaggaattcggcaccagctngacttanacactngantggtagcnactngtaattcacttgcttgggttctcgngccaccgaactatttcncgccaanatgtnganggtganncctgcntacctggancagaggctcggcgcggtcaagcgctcctgcagagaggccgctatggcgggagccaaggtcgtggtcgtcgcaccgtcttctgcgtaatccccaccctggcgagcgtgatcgatgctgcncntgggccgatagncgcacctcaaaccaaccgggcaggcgctcatcatcttcancgtcgacgggatggcctacttcattggnccgacaanaccatcctctaanggccacgaaggnctactttgaagagccncacanaaccttaanaaaantcttcactatgagactggaatacagancattgcagcgcgcatnactgttgcccagccgcnatgctgatgaaatgggngaacgtanactncccgagctgaaacagcatgtgtggatntgtcttcttnatcnngactgctgacantatatatgttgcancatatcttgatatatactcnatttgacaaaaaaanaaaaaatgangggg

SEQ ID NO: 102959 - DNA, 729 bp, Triticum aestivum
  unsure (1)..(729): unsure at all n locations
  Clone ID: PAT_TA_102959
gantncccttgctcgaannaccctcactaaagggaacaaaagctggagctccaccgcggtggcggcccgctctagaactagtggatcccccgggctgcaggaattcggcaccagatggaaacaagaagcttgatgctgcttatcaagaagctcaggcaaagggctctagctgccctatattcttgtttttctcggtgaatacaagtggacagtttgttggtgttgctgaaatgactggtcctgttgattttgaaaaaactctagagtactggcaacaagacaagtggaatggttcattctctgtcaagtggcacattgtcaaggatgttcccaacaacattctcaagcacatcgtccttgagaacaacgagggcaagccagtcacaaacagccgtgacacacangatatcaaccttgagcaaggtatccagatgcttaagatattcaaagagcatgtcaacaagacctctattctggaagactttgccttctatgagaaccgccagaaagttgatgcnngagaaagagaattaaacaacngccgatcccaaagcaggtgtgggacaacanggcttcgaaccctgttgctggagagaaacacaggaagtcgccaccggaagccaangttntgtccgacgggncatggagaaacagangatgccgcatgggaancaagcgctgggcgatgngtacgggatcnaggtccgnaganaagccgtgcacgtgtct

SEQ ID NO: 102960 - DNA, 744 bp, Triticum aestivum
  unsure (1)..(744): unsure at all n locations
  Clone ID: PAT_TA_102960
gannnccctttgctcgaaccaaccctactaaagggaacaaaagctggagctccaccgcggtggcggccgctctagaactatgtggatcccccgggctgcaggaattcggcacgagccaatctctctggcctgcttcacgataatcgaccagttctctagtcttactccctctgttcctctctgctctgctttctgactcaaactgcaacaatggctgccccgacctctgcaatcgggttcgagggctacgagaagcgcctcgagatcaccttctccgaggcatcgatctttgccgaccctcatggtcgtggcctgcgcgccctctctagggcccagattgactctgttcttgatcttgcacggngcaccattgtgtccgagctctccaacaaggacttcgactcgtatgtgctatctgagtccagcctgttcatctattctcaaaagaatgggatcaagacctgtgggactaccatgctnctgctcaccattcctaagattcttgagcttgctgaaanctgtgcatgccgttgctgncgcaagtactctcgtgggatgttatnttcccggggcacaagctgctcccaaagagcttctctgaggaggtgatgtcctgnaccgttcttcggcacctgaagctgggtgnaatgcttatgtgatcggagaccagcgaanctggcagaaatggcacatntactntgccaccgnccaacctgacaagccatggncacctggaaaatgtgg

SEQ ID NO: 102961 - DNA, 944 bp, Triticum aestivum
  unsure (1)..(944): unsure at all n locations
  Clone ID: PAT_TA_102961
gantnncctttgntcgacttaaccctcactaaagggaacaaaagctggagctccaccgcggtggcggccgctctagaactagtggatcccccgggctgcaggaattcggcacnaggagaaactannanngnnggctngncnccatgaangtnttnnttcgggatannatngcnntnntggaatcaanatacatggntttaaacggaaacancatntntccancactngggncannnncaanannnacnacnnccngggaanncnnancannngctanaantntacnnaaangcggcattagnttancannagcntatcncnctgnaaangannnttcngcnnacnnaattcnnatttcnnnagaggtgccacntcgnnccatnccnatnctgcnnnattnnggagggcattnccaancnnaatcccggaggcntgcattcnacattnggggaaangnagggctttggaantcttttaannngaattcccaaccattnaanttttanaggccttcctcganccaanatttcccccngnggaattaaagaaaccatttanggggngnngnngggccattggnatnaaacccttanaaanacgcnnttgtttccaaaacaananaaactggtgggccctgngncaaaantggaccncnncccancccattggaattgnnaccttggggggggnnaatctttccnaanccccncccatccnnggatttttgaatngnaagggaangaangggacaatcgnggnggccttcaanacaattttaantttttttccaaanccccttggngaaccancctttttttaccanggggcccattntccncaccgcttttnccccntaangtttcaacccctttgcnaatanttttccaannattttggccaagggacaattggtttgaatgatgngcnctttaaaacaatttccn

SEQ ID NO: 102962 - DNA, 918 bp, Triticum aestivum
  unsure (1)..(918): unsure at all n locations
  Clone ID: PAT_TA_102962
ganntgcccttgctcgaaatnaccctactaaagggaacaaaagctggagctccacccgcggtggcggccgctctagaactatgtggatcccccgggctgcaggaattcggcaccaggctacgttnncactccnccnaatncnatacctgatntgggattnaccggngcnncncnnccanncnnttaggcnntcccnggnncctgctccccnacgcttcaaccatggcaggaatggcaccngaaggttcccaggttgacgctnagaactatnattctaanattcaacgagctgctgatccaaggcgagactgacgagttcttcaccttctntgatgaagttnatganagntnngntgacntgngtntgnannagaaccttntcaanggaatngatgcnnatnggttnganaagccntatgccatccatgaaaggggtatcggtgctttcttccaanggggattgatattatncatgcangcncaattcngngaacacgganaagnctgcttacccttctggatcttggnaatgccttggaacaaanttggacctttttngggttagggccagaaggngnccccnagccccntngggttccctttgganttcccaacaacggttgaatcctttggcnaaaagccaaaaanttnggaacnaatngggtttaattggccgggggccaacttttngggggggaaccctttccttttgggggggggccggnaaatngggcctttaatggaccaatngngggnttggggaaagggnaaacccnttnaaattgncnggtggaagggaacccnaaaangaattnccttggccatgggggggngtgccaatgtttccctttgtngggttccctcccnggaaaccnggggggttttgnnatttttaccctntgggcaaaactcttggnn

SEQ ID NO: 102963 - DNA, 874 bp, Triticum aestivum
  unsure (1)..(874): unsure at all n locations
  Clone ID: PAT_TA_102963
gagncnccctttgntcgacttaaccctactaaagggaacaaaagctggagctccaccgcggtggcggccgctctagaactagtggatcccccgggctgcaggaattcggcaccagcaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttncaagcaatgcaaccctgtgtcattggggncatncctcgtgtcaatgatcttgccacgaaagtgattgccaggtgatgcaagcaacaatgttgccaacaactagcacaagattccttgccaggctncagtgtgcagccatncattaggcgtcgtgcatttccattcgncattgcagcaanggaaccaaccaaccaaggggcanttacaagaatcccttcccgggcccacttgggttttcaagcctttggttcccaaanggggcaangggggcaatttnatttcccnaaancctttnaaaacaaaaacccaagggtttaaaaattattggaanggggggnaatcaaaggggtcaaatttgggggtaanttgggaaagaaaaacccccctttttnccnaaaaana

SEQ ID NO: 102964 - DNA, 765 bp, Triticum aestivum
  unsure (1)..(765): unsure at all n locations
  Clone ID: PAT_TA_102964
gnnatnctctttgctcgaatnaaccctactaaagggaacaaaagctggagctccacccgcggtggcggccgctctagaactagtggatcccccgggctgcaggaattcggcaccagcccacctttcccctccagcaaactcacacaacccaccaccgaagctcccaaccccacccgaagcggcagccatggcccccaaggcagacaagaagccggcggccgagaacaaggtggagaaggcggcggagaagacccccgcggggaagaagcccaaggccgagaagcggctgccggcgggcaagacggcgtccaaggaggccggcggcgaggggaagacccggggcaggaagaagggcagcaaggcgaagaagggcgtggagacgtacaagatctacatcttcaangtgctgaagcangtgcaccccgacatcggcattttccttcaanggcatgtncattnatgaactncttcatcaacgacatctttnaaaaactcgncggggagtcgggcaaactcgcccgcttcaacaagaagcccaccatcaccttcagggagatccaaaccttcgtncgctngttcttcccngggagctngccaagcacgccgtcttcgaaggcaccaanggcgtcaacaagttacattcttctaaaattgacgngtgcaantnggttcttnatttggatttggctcttgactnttnttatttatttntttgcnantantgggggggggagaaaacccttgcttgngaatgccaccnttttt

SEQ ID NO: 102965 - DNA, 770 bp, Triticum aestivum
  unsure (1)..(770): unsure at all n locations
  Clone ID: PAT_TA_102965
gannacgccctttngctcgactnaaccctactaaagggaacaaaagctggagctccaccgcggtggcggccgctctagaactagtggatcccccgggctgcaggaattcggcaccagcagcaactaaaagcgatccccangcagtcaagatgcnaggccatccacaacgtcgngcacgccattattttgcaacaacaacaacaattggtacaagctacttncacccaacctcagcagcagcaacaacaaggtcaacaacaacaacagggtctgggttctagccagccacaacaacaaacacaactggatcagggttggattgcggtgatagggacatgggtgattcanaccatcccggcaatgtgcgacntgcatgttccaccatactgctacaccaccatatcaccatccagtgacgtcactacccgacatgggcggntactgagaagacgagagttctagtatccgaaaaatggccaccaatggttagtcaatggncccgatccatgtagcgggngaaaaataaaagngccatgcattatcatgtgtggactanactggcactagttcaaacttgggaataaaaggcaaactaagntattttctgcagactttatgnaactnnagtcgaaaaaactcgagggggggcccggtacccaattcccctatagtgagtcgtattacaattcactggncgtcgttttacaacgtcaagactgggaaaaccctggcgttacccaacttaatcgcttgcacaaatccccctttng

SEQ ID NO: 102966 - DNA, 774 bp, Triticum aestivum
  unsure (1)..(774): unsure at all n locations
  Clone ID: PAT_TA_102966
gannggcccttngctcgaanttaaccctactaaagggaacaaaagctggagctccaccgcggtggcggccgctctagaactagtggatcccccgggctgcaggaattcggcacgagccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacagattcctcagcagctccagtgcgcagccatccatggcatcgtgcattccatcatcatgcagcaagaacaacaacaacaacaacaacaacaacaacaacaacaacancaacaaggcatacagatcatgcggccactatttcagttcgtccagggtcaaggcattattcaacctcaacaaacaagntaaattggaggggatcaggtnatg

SEQ ID NO: 102967 - DNA, 680 bp, Triticum aestivum
  unsure (1)..(680): unsure at all n locations
  Clone ID: PAT_TA_102967
gnnntttgttcgccagcttgaaattaaccctcactaaagggaacaaaagctggagctccaccgcggtggcggccgctctagaactagtggatcccccgggctgcaggaattcggcaccaggagagagagagagagagagagagagagagagagagagagagggagggagagtttgtgtganagtgagggatcnagtgangtnntggnggntnngcggncntggntggaatgcntganatggnnatnttntactnacaggancgcannttnttncaccgntggtgcncnacctnngcnnganaaggancncatgangtgggtgatcnnnctntggctntggttnnaggncnatgggaacnacaagttnatgcnccnngcggcgnnctnccngccccgtnntgctnncttnntnnacnaggcnctngnntnctnnnccnctnnncngncgnntctnnncngnnccnnacnctnctnnntgnaccaacncgctctaacaagnccatnnacnacntacctacttnnacnagcccnnnacacatatgccccnnntnaagttctgtcaanaccgtntgncnngtnnnncttnnannacnnctnnnccttcnacaacnncnnnttnttttccannnnggannnnnnnncnnnttcnnnccnngcgccattnngnnnttccntgnttn

SEQ ID NO: 102968 - DNA, 698 bp, Triticum aestivum
  unsure (1)..(698): unsure at all n locations
  Clone ID: PAT_TA_102968
gngngnntttgntccgccagcttgaaattaaccctcactaaagggaacaaaagctggagctccaccgcggtggcggccgctctagaactagtggatcccccgggctgcaggaattcggcacnagcctntgcccacaaaaccctancngncncctcacagctngncnccgacncaacnagctcttcctccaccgccgcaaccatggcnanccatatcagnaagaagaagaantttgtgagcgatggngttttctacgccnagctgancganatgctgacccgggagcttgccnaggacngntactcnggcgtngaggtacgcgtgacgccgatncncacggagatcatcatnagggncacncngacncataacgtgcttngngagaagggccgcangatcanggagctcacctccgtcgtgcatnatcgcttngacttcnctganaacngcgttnanctttacgccnngaangtcntnaaccntggcctntgngccatcnaccacgccgngtnacttcgctacaagctcctcttggccttgccnccgcanggcatgctatggtgttcttcgctttgttatgggagagtggtgctaaaggttgtgaggacattgtgagccncantctcaaggnccaatagagccaagtcnatgaaattcaaagactgntaccatgatcctatnatggttatcccgttaac

SEQ ID NO: 102969 - DNA, 697 bp, Triticum aestivum
  unsure (1)..(697): unsure at all n locations
  Clone ID: PAT_TA_102969
gngnnnttnanncccttngcttganattaaccctcactaaagggaacaaaagctggagctccaccgcggtggcggccgctctagaactagtggatcccccgggctgcaggaattcggcacgagagagctcacctctcccctcgcttcctcgcgaaaatgtcgactgaagtggctgccgctgacatcccggtgcctcaggtggaggtagccgccgacgccgccgttgacacaccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggataagcacaaggcgcacctcccggccaacttccgcaagatcctgctgacccagatcaagaagctcgtcgccgccggcaagctgaccaaggtcaagggctcctacaagctcgccaaggcccccgccgccgtcaagcccaagacggcgaccaagaagaagcccgccgccaagcccaaggccaaggcgccagccaagaagacggccgccaagtccccggccaagaangccgccgcgaagcccaaggccaangccccaaccaangccaaagccgtcgcgaagcccaaggcgg

SEQ ID NO: 102970 - DNA, 704 bp, Triticum aestivum
  unsure (1)..(704): unsure at all n locations
  Clone ID: PAT_TA_102970
gngagnnntttnnnncccttnnnttttgatccgncagctcgaaattaaccctcactaaagggaacaaaagctggagctccaccgcggtggcggccgctctagaactagtggatcccccgggctgcaggaattcggcacgagctcgattcttcgtggacaacggaacatacctcactgagcaggggaggtttttccttgcatggtactccaataatctgatcaagcacggtgacaagatcttggatgaagcaaacaaggtcttcttgggacacagagtgcaactggcaatcaaaatctccggcattcactggtggtacaaggctccaagccatgcggccgagctcacagctgggtactacaacttacatgacagagacggctacagacccatagcacgcatgctcaaaaggcaccatgctagccttaacttcacttgcgccgagatgagggactcggagcaaagctcgcaggcgaggagcgcaccagaagaactagtccaacaggtgttgagtgctggttggagagagggcctaaatgtggcatgcgaaaacgcacttcctcgatatgatccaactgcttacaacaccatactcaggaatgcgaggcctcatggcatcaacaagagcggccctcctgagcacaagctgtttggattcacctaccttcggttatcgaatcaactggtagagggacaaaactatgtc

SEQ ID NO: 102971 - DNA, 709 bp, Triticum aestivum
  unsure (1)..(709): unsure at all n locations
  Clone ID: PAT_TA_102971
gagnnntttnnnncccnttnnnnttttgantccgncagnctcgaaattaaccctcactaaagggaacaaaagctggagctccaccgcggtggcggccgctctagaactagtggatcccccgggctgcaggaattcggcacgagctcaactggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcagaccatcccgggcaatgt

SEQ ID NO: 102972 - DNA, 693 bp, Triticum aestivum
  unsure (1)..(693): unsure at all n locations
  Clone ID: PAT_TA_102972
ttggnnccttnnnttttgntccgtcagctcgaaattaaccctcactaaagggaacaaaagctggagctccaccgcggtggcggccgctctagaactagtggatcccccgggctgcaggaattcggcacgaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaatgttggcttcaatgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgaactggtgaccaagattg

SEQ ID NO: 102973 - DNA, 806 bp, Triticum aestivum
  unsure (1)..(806): unsure at all n locations
  Clone ID: PAT_TA_102973
gnagcgaatnantgacttctttgattgnaccccttnnacnagccaggaacccatagctggagctccccgnggtggcggccgctctagaactagttnatcccccnggctntangaattcggcangagaantanaggggganantaanaaagcnntanagagngnganagnnancgananagaganagaganacatccagananaganangagagagntgatagacgncanaaagaaanatnacagcagncgccganaagtacaangacncnggatgtacaatantatttncttttntttttntcnatactaaaaacgngacaacaaacatgcttnnacacnntanaccnggnggcaganntnacccncaatgnccagncaacaanggtgagatactntgaccatcatnaaaaccaataaccctgcccagntnaatncctnnaccngggcttnnatgnanatccactccnaatnaccaagnaagannngccccgngnntgnngaaaagtgggtgggatanncantgnggtnntantnaancnanaactatcgccacccnttnttatacnggaccttcttcgaancccnntggttgcnnntnancgctancagnaantnnttaaatnnaggcngantnaccctgnttncccaaggaanncaaatctnanncntaaagccngncncanaatacncaaatggtatcntctacntggaccnctacanaccantaganccattcgnnaggngangngggnaataagncnnatttcatnantncaagntcngccccccttnnntanannnancg

SEQ ID NO: 102974 - DNA, 706 bp, Triticum aestivum
  unsure (1)..(706): unsure at all n locations
  Clone ID: PAT_TA_102974
nnnagntngatncgccaagctcgaaattaaccctactaaagggaacaaaagctggagctccaccgcggtggcggccgctctagaactagtggatcccccgggctgcaggaattcggcaccagggccagccaggtagtcctccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagaggggtatcaccattgatatcgctctgtggaagttcgagaccaccaagtactcgtgcactgtcattgatgctcctggtcaccgtgatttcatcaagaacatgatcactgggacctcccaagctgactgtgctgtgcttatcattgactccaccactggtggttttgaggctggtatcttcaangatggccagacccgtgagcacgctctccttgctttcactcttggtgtgaagcaaatgatctgctgctgcaacaagatggatgccaccactcccaagtactcgaaaggcccgntattaaaaaaattgtcaanggaagtctcttcataccttgaaaaaaggcgggtacaacccctgacn

SEQ ID NO: 102975 - DNA, 713 bp, Triticum aestivum
  unsure (1)..(713): unsure at all n locations
  Clone ID: PAT_TA_102975
gnnttnattccgccagctcgaattttncnttcgccagctcgaaattaaccctcactaaagggaacaaaagctggagctccaccgcggtggcggccgctctagaactagtggatcccccgggctgcaggaattcggcaccagcacaagcatcaaatccaagtaggtagtagttaacgcaaatccaccatgaagaccttactcatcctgacaatccttgcgatggcaataaccatcgccaccgccaatatgcaggtcgaccctagcggccaagtacaatggccgcaacaacaaccattcctgcagcctcaccaaccattctcccagcaaccacaacaaatatttccccaaccccaacaaacattcccccatcaaccacaacaacaatttccccagcctcagcaaccacaacaacaatttctccagccccgacaaccattcccccaacaaccacaacaaccatatccccagcaaccacagcaaccgttcccccagactcaacaaccccaacaaccatttccccagtccaagcaaccacaacaaccttttccccagccccaacaaccgcaacaatcattcccccaacaacaaccatcgttgattcaacaatctctacaacaacagttgaacccatgcaagaatttcctcttggagcaatgcaaacctgtgtccttggtgtcattccttctggtcaatcatcttgccaccaaagcgat

SEQ ID NO: 102976 - DNA, 704 bp, Triticum aestivum
  unsure (1)..(704): unsure at all n locations
  Clone ID: PAT_TA_102976
nagtttgaccnttnnnnnccttttgatctcntnagctcgaaattaaccctcactaaagggaacaaaagctggagctccaccgcggtggcggccgctctagaactagtggatcccccgggctgcaggaattcggcacgagcacatgcgctgctctcctgcagcagtgtagcccgacaccatatgtccagtcacaaatgtggcaggcaagcggttgccagttgatgcggcaacagtgctgccaaccgctggcccagatctcggagcaggctcggtgccatgccgtctgcggtgtggcccaggtcatcatgcggcagcagcaagggcaaagtttcggtcagcctcagcagcagcaagggcaaagttttggccagcctcaacagcaggttcccattgagataagaaggatggtgcttcagacccttccatcgatgtgcaacgtgaacatcccgcaatattgcaccaccaccccatgcagcaccatcactcagaccccctacaacgtccctatggccactacctgtgttggtggtacctgctaagatctgtgatgcgctaactagaccgatcaccatttagtttagatgatggatgaagggtgaaaaataaaataaaagtgccatacatcatcatgtgtgggcagtaccgttgcaacataaaaaaaaaaaaaaaaaactcgaggggggggccggtacccaattcgccct

SEQ ID NO: 102977 - DNA, 700 bp, Triticum aestivum
  unsure (1)..(700): unsure at all n locations
  Clone ID: PAT_TA_102977
gngnttgnanccctttnnnnnncnttctgatccgccagctcgaaattaaccctcactaaagggaacaaaagctggagctccaccgcggtggcggccgctctagaactagtggatcccccgggctgcaggaattcggcaccaggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtcagttcggccagaanggcatccctacctgaacacctatgatgggcggaccatncgttcccagccctttatnaanggcaatgcactatna

SEQ ID NO: 102978 - DNA, 697 bp, Triticum aestivum
  unsure (1)..(697): unsure at all n locations
  Clone ID: PAT_TA_102978
agaattngntccttnagctcgaaattaaccctactaaagggaacaaaagctggagctccaccgcggtggcggccgctctagaactagtggatcccccgggctgcaggaattcggcaccagcctcctcctcctccaaatctcaagcgagcacaccgcgcaagtagcaccgcttcagtttcggtttcagagctccgcttcagtcagctgacatgcctgccctcgccaagcccgctgcccgccccgccaagcccgccgccgcggcgccgaagccgaagcccgccgccgccaagcccaaggcggccgccgctggagccgcccacccgacctactttgagatgatcaaggaggcgatcgcggcgctcaaggacaggaccgggtcgagctcggtcgccatcgccaagtacatcgaggagaagcacggcaaggctctcccgcccaacttcaagaagatgctctccgtccagctccgcgcttccgccgccaagggcaagctcgtcaaggtcaaggcctcctacaagctctccgacgccgccaagaaggactcccccaaggccaagcccgcggcgaagcccgccaaggacgccgccaagcccaaaaagaangcggccgagaagcccaagaagacggccgccgttggcaccaagcgcaaggcgccggagaagaagaactggtcaccaaggccaaaaatcgccggttg

SEQ ID NO: 102979 - DNA, 720 bp, Triticum aestivum
  unsure (1)..(720): unsure at all n locations
  Clone ID: PAT_TA_102979
nctgnntgatgantttgnnctcgctctaacccccctaaaaggaaccnaagcgggagctccaccgcggtggcngccgctctagaacttntgtttcccccgggctgcacgaattcgaggnggngncttntactncttcaaatntcaagcgagcacacccgcgcaagtancaccgcttcagtttnggnttcacagctccgttttagtcaactgacatgcctgccctcgccaagcccgctgnccgccccntcaagcccgtcgncgcggcgccnaagncgnagcccgccgtcgacaagcccaaggnggccgcctctgganccgcccacccnacctactttgagatgatcaaaggaggcgatcgcgtgctcaaggacaangaccgggtcgagcttngtcgccatcgccaanttcatcggangagaaatcacggcnaggctttnccgcccaacttcaaagaaaatgctctccgtccaanttncgcgctttcggcggcaaagggcaanctncnttaangtcaaggnctcctacaagnttnttcgangccantcaanaaggactcccccangcacaagcccgcgggngaanccctgcaaggacgccgccnatncccaaaaaagaangcagncnaaaaanncccaagaagactgccgncgttngcancaaagcgcaangcncccggagaanaanaagnttgggtnccaaaggcaatangtnnncgcgtgc

SEQ ID NO: 102980 - DNA, 702 bp, Triticum aestivum
  unsure (1)..(702): unsure at all n locations
  Clone ID: PAT_TA_102980
gaanttgnancctntgattncgccagctcgaaattaaccctcactaaagggaacaaaagctggagctccaccgcggtggcggccgctctagaactagtggatcccccgggctgcaggaattcggcaccagggagagttgaggtacccatcgtatcctcagagccacggatggtcattcccaggcatcggagaattcatctgctatgataagtacctgcaagcagacttcaaagcagcagcagcgatggttggccatcctgagtgggaatttcctcacgattccggaacgtacaatgacactcctgagagaactcgattcttcgtggacaacggaacatacctcactgagcaggggaggtttttccttgcatggtactccaataatctgatcaagcacggtgacaagatcttggatgaagcaaacaaggtcttcttgggacacagagtgcaactggcaatcaaaatctccggcattcactggtggtacaaggctccaagccatgcggccgagctcacagctgggtactacaacttacatgacagagacggctacagacccatagcacgcatgctcaaaaggcaccatgctagccttaacttcacttgcgccgagatgagggactcggagcaaaactcgcangcgangagcgcaccagaagaactagtncaacaagtgntgagttgctggttggaaaaaaggcc

SEQ ID NO: 102981 - DNA, 702 bp, Triticum aestivum
  unsure (1)..(702): unsure at all n locations
  Clone ID: PAT_TA_102981
gcgggntntganatngnncctcnttnaaccctcactaaagggaacaaaagctggagctccaccgcggtggcggcccgctctagaactagtggatcccccgggctgcaggaattcggcaccaggngccnntcacaccnncngcngcngcagangnagaannngtggcaataactncntgttncaacgccagcagaacaccnggntcaggtttcngtnccggtaanncnccgnngncnnatngcacgccgttctttatgctgnggctnacngtgcgganccttctgncgggagggggcagcttnnantagntggtgagaggctaccnagcctncctctccagnntttttagcnggangatcgnaggacgtcctcntcccggnngtggaccacgccctggcggnctgacatgcaccnctnccgacnagangccgccaatnctnatgccgncgatcgaccncaacnaaactggnatgcaccggtcgcantncctnnnctttaacatnaagaaattcatctncgncnanagnatcnanaggatgaantngctcggtgncntgttccncgtgntccantacnatncgcgngcccccgtcganaccagtaatgncgagccngacatagtccctacatgaacnacatngncntanatngggatgacnacnacggtgatgacatnggnggggangatgcgtttntctgttt

SEQ ID NO: 102982 - DNA, 701 bp, Triticum aestivum
  unsure (1)..(701): unsure at all n locations
  Clone ID: PAT_TA_102982
gnantttgttcntntgnttncgccagctcgaaattaaccctcactaaagggaacaaaagctggagctccaccgcggtggcggccgctctagaactagtggatcccccgggctgcaggaattcggcacgagccaaggacgaccctgccaaggaggctgccaacttcaccgcccaggtcatcatcatgaaccaccccggccagatcagcaacggctatgccccggtgctggactgccatacgtcccacattgctgtcaagtttgctgagatccagaccaagatcgaccggcggtctggcaaggagattgaggcggcgcccaagttcctcaagaacggtgatgctgggttcgtcaagatgatccccaccaagcccatggtggtggagacctttgcccagtaccctcccctgggccgctttgctgtgcgtgacatgaggcagacggttgccgtgggtgttatcaaggctgtggagaagaaggatccgaccggtgccaaggtgaccaaggctgcggccaagaagaaatgagatggtgtcaggttctttactgcatctatggtggcggtggcggtatttggtggtggtgatagttgttctagttgttttggaaacttgttaagcttcggttatttgtgtcgagcagtgttggaactgcttattgctctgtcattgtatcgtccggtgngttggtgaaacttctcaag

SEQ ID NO: 102983 - DNA, 699 bp, Triticum aestivum
  unsure (1)..(699): unsure at all n locations
  Clone ID: PAT_TA_102983
gnnnttggntccgtnagctcganttaaccctcctaaagggaacaaaagctggagctccacccgcggtggcggcccgctctagaactagtggatcccccgggctgcaggaattcggcacgagccggagttggttcctactaataaggaaaggtctctagtaatatatagttggatcaccgttgtttagtcgatggatatgtcgatgcagcggtgacaaataaagtgtcacacaatgtcgtgtgtgacccgcccatactagttgtttaaattctgaaataaaataaaaataaagttgtatcaagacaatgttcatattggcattgtgtggatgtcgatctgattgccatgcttgcaagttcataagtttgtctttcctagtcacaagcgcaacctggtgccttaattaattatccatgtgttggaataatcactatttgaatataatggtgttactgtaaaaaaaaaaaaaaaaaactcgagggggggcccggtacccaattcgccctatagtgagtcgtattacaattcactggcccgtcgttttacaacgtcgtgactgggaaaaccctggcgttacccaacttaatcgccttgcagcacatccccctttcgccagctggcgtaataacgaagaggcccgcaccgatcgcccttcccacagttgcgcacctgaatgggcgaatggcaaattgtnagcgt

SEQ ID NO: 102984 - DNA, 673 bp, Triticum aestivum
  unsure (1)..(673): unsure at all n locations
  Clone ID: PAT_TA_102984
gagntttttctttgttcnccagctcgaaatttaccctgactaaagggaacaaaagctggagctncaccgcgggggngggcgctnttgaantactgggtccccccggctttaggaattntgggncanggggcntcaannngngngtttnaagctntggggctcaaggncgggggatntttctttttgggcaanggngttttcaagggggttcacnanntgnactccattatttgcccncnttggtcggccaggnccctcccctcaaactgtgcttgcnactttnttgttcttcanatccncggggccccaatgnnaggggttngtgcaacccaaaaattnttnttcatgcccccaccggtntggtccncntcanccctnnanaaaatggggncagcncccnttnttattntccccttccnccacattttcaannctgntggcgtcaccngaattgtnttttcccccgcctncggnggctaataanaaaattttgggaaaaccccctgttcanacnccnggntnntttttnaggaaaaccaacnnacccntnccccngggggggncccnctaanttgggggggggggaaggaaaatananggcgttttggngggannanaaaaanattttttttaaanacccncgttgggggggaanaaaaacacccgggcncgg

SEQ ID NO: 102985 - DNA, 632 bp, Triticum aestivum
  unsure (1)..(632): unsure at all n locations
  Clone ID: PAT_TA_102985
agangnttgttctttnntcncntnntcntatnaccntactaaaaggtnnaatctggagctncancgggnngnctnnnnctntngaantnnnggatcccccgggctncaggaattcgggancaacccacaccctctcccccaacctgatctgtttggatcncntngccnccgangccgacnacgtcggntganntntacgactcgctcgaatcctgcccgngccgatcgatntgcttgcagaagtccngggganganactngccacantnncngnagntgccngngnanaccacacacatattnaattnngcgatcncaanatgacttgactttttctgcatatnnggcgnnacntnatccnactnnctnctactgggggancaccaaggngatcancccgcacacatcntgngcantgntgaccacntgtctnacaaantcgaggtccaaatannnnaacatccancntcngtcggcaaantnanaccgcgatnannnggctatctngncnccaantcaantaccantgntctgngtganaatgnntcttgtggangttgtgcactctnnaggggtggatatnggcatntacaacgntgctnaggcacaaacntncgatgacganacggnca

SEQ ID NO: 102986 - DNA, 632 bp, Triticum aestivum
  unsure (1)..(632): unsure at all n locations
  Clone ID: PAT_TA_102986
tgngnntttttcctttgattcgccagctcgaaattaccctactaaagggaacaaaagctggagctccaccgcggtggcggccgctctagaactagtggatcccccgggctgcaggaattcggcaccagggtgcatcaactggtgtctatgaagctttggagctgagggacggtggatctgactncttgggcaagggtgtttccaaggctgttaacaatgtgaactccattattgcacccgctttggtcggcaaggaccctaccgctcaaactgagctcgacaactttatggttcagcagcttgatggaaccaagaatgagtggggttggtgcaagcaaaagcttggtgctaatgcaatcctggctgtatcactagctgnttgcaaagntggagccagcgtcaanaagattccactgtaccagcacattgccaaccttgctggcaacaagcaattggttttgcccgttcctgcgttcaatgtcatcaatggnggatcccatgctggaaacaagcttgntatgcatgagntcatgatcctttctactggagctcctcattcaaggaggcaatgaanatgggcgttggagtgtaccacaacttgaaagctgtntnaaaaanaaatacccgcccgg

SEQ ID NO: 102987 - DNA, 631 bp, Triticum aestivum
  unsure (1)..(631): unsure at all n locations
  Clone ID: PAT_TA_102987
agattngntcgtngctccanttaccctactaaagggaacaaaagctggagctccaccgcggtggcggccgctctagaactagtggatcccccgggctgcaggaattcggcacgagcaagcatcaaatccaagtaggtagtagttaacgcaaatccaccatgaagaccttactcatcctgacaatccttgcgatggcaataaccatcgccaccgccaatatgcaggtcgaccctagcggccaagtacaatggccgcaacaacaaccattcctgcagcctcaccaaccattctcccagcaaccacaacaaatatttccccaaccccaacaaacattcccccatcaaccacaacaacaatttccccagcctcagcaaccacaacaacaatttctccagccccgacaaccattcccccaacaaccacaacaaccatnttcccagcaaccacagcaaccgttcccccagactcaacaaccccaacaaccattttcccagtccaagcaaccacaacaacctttttcccagccccaacaaccgnaacaatcatttccccaacaacaaccatcgttgattcaacaatctctacacaacaggtgaacccatgcaagaatttnctcttgcagcaatgcaaa

SEQ ID NO: 102988 - DNA, 651 bp, Triticum aestivum
  unsure (1)..(651): unsure at all n locations
  Clone ID: PAT_TA_102988
agaagatttgattctttaatccccntgactcnanctttaccctgactaaagggaacaaaatctggagctccaccgggnggnctgnnnctctagaantnnnggatcccccggnctgcaggaatngggcaccaggnaacatttctanctntatgtcgctcgctcgnnnacgaatacatagancactaaanggcatggncctcnnactcccnaaactnccnnccctctatcggaggatttgancntnggtgccncngaatcnnanggtctnncncgnnagtactcgntgatntngntcgcagnnngtgctcacncagaaaccccanatacntnnnctntatcngncgncgncanaatcgngnnctcantggaagccgangacnctgaanttataagccanctgcggcnntttaataggcnatgatntttntcnnncgctnnanttgaatgancgnggtattnncgcntaatacccgntantacaatcccggaanacaaagntananantncggcctnanngnttttnaccgctnntactaacnaactatatnccnntcntnatacnnaggtnaantnnacgnnattctctacgtnaagtggnttcnaaccngtcngtanttnntaccccttaccaangcnnggangccannntt

SEQ ID NO: 102989 - DNA, 639 bp, Triticum aestivum
  unsure (1)..(639): unsure at all n locations
  Clone ID: PAT_TA_102989
agaanntttgattctttnnttcncnngctcganntttaccctnactaaagggaacaaaagctggagctccaccgnggtggcggccgctctagaactagtggatcccccgggctgcaggaattcggcaccaggcnanaaccctagcctccggntccatncatacgcccntcnntgncgctgcntatcgtatccancaccccantngcnnngggaccnannnggatggncangnnatnnnncacacccntgagaaccanttgtantccaaggacgactccggccctgctatacctaccctnancnngncggtgccntacgcannggnggncacnttgncatcanagnccatacntgcnaggttgtngaggnntgcanctanaanactgncaancatggnnacgcaatgtgtnactttgttgccattgacatctttaatggnaagaancttnacgatatcgttccttnattgccacaactgtgacnttccccatgttgnccgccnagannatcacctgattgacataactgatgatggatntnccagccttctaactgagagnnncnacactnangatganctgnagcttccnacngatgatgctntgcttggccaaatnanaacnggatgtgctgatggna

SEQ ID NO: 102990 - DNA, 830 bp, Triticum aestivum
  unsure (1)..(830): unsure at all n locations
  Clone ID: PAT_TA_102990
agaaatttnntccttnagctcnaacttaaccctcactaaagggaacaaaagctggagctccaccgcggtggcggccgctctagaactagtggatcccccgggctgcaggaattcggcaccaggagagagagagagagagagagagagagagagagagngnganagngantgagantgnganagaganaganaganagatnnngcnccngatgnncnancacncnnngcgcgngtccctntgnttgctacccaaaaagnggcgctcgcgccaccnccgntaggtcatngcntntnncncncatgacnanctcaaaaaatgccnccttactgccttccttngctannaggcttggatnacccacattgtgcgtgaatggtgaaaaagccngggttccanagnctacacangcaanngaggnctnttgtntaggtctctttnacncacttcgntngnnntacaacncnnnaaatttggttttttttttcnngacctgngtttgcccttattgntganaanaanttcnnctgcgggngattncttttnnnnaacattnattcaaaaactacttgttccttgggggncaanntaaaccatttttttctttgnncgtattccattcntttccaaancaattaanttnttttcnttaaccannannaaatttttgggcntnatcgaaatnttnattccatangttanagggaaaaaatggtttctttttttttaacannaaatggncttttttgggcgtcccnccttntggntanttggnaacccaattttggaattttttcttttacncccaaaagngaaaancggtattagnttt

SEQ ID NO: 102991 - DNA, 620 bp, Triticum aestivum
  unsure (1)..(620): unsure at all n locations
  Clone ID: PAT_TA_102991
gaaatttgnnctnagctcgaaattaaccctcctaaagggaacaaaagctggagctccaccgcggtggcggccgctctagaactagtggatcccccgggctgcaggaattggcacgaggagagagagagagagagagagagagagagagagagagagagagagagagagagagagagagagagagagagagagagagagagagagagagagagagagagagagagaganagngagagagagactgncngngtntgagtnannatnnnnngtnnnnnnngggnctgntcacccttntngcccgcnacttngangatnncatngncaatcaccccttnatgctcgcnnntctaccccctgggtgccncttntnanttgncactgnngatgnaaangcnncctctgttagantcacaacctnatgacngnntnactaangttttcccctncgtntagnaagtgcngccgcntgntgncnaatncaanctnantgttnncttncttcangatattccnanntgannaaacacgtccctgnattgnnaggncncnggncagcttttgnnntttgctnaatncttnganaaancngngggnannntcnttcnnnggngntcanggcc

SEQ ID NO: 102992 - DNA, 630 bp, Triticum aestivum
  unsure (1)..(630): unsure at all n locations
  Clone ID: PAT_TA_102992
agagttgttctctgntcgccagctcgaaattaccctactaaagggaacaaaagctggagctccaccgcggtggcggccgctctagaactagtggatcccccgggctgcaggaattcggcaccagccanagtgcagcagcttctccaggacttcttcaatggcaaggagctttgcaagagcatcaaccctgatgaggctgttgcctatggagcagctgtccaggctgccatcttgagcggagagggcaacgagaaggtccaggacctgctgctgttggatgtcactcctctttcccttggtctggagacagccgggggtgtgatgacagtcttgatcccaaggaacacaaccatccccaccaagaaggagcaggtcttctccacctactcggacaaccagcctggtgtgctcatccaggtgtncgagggtgagaggaccaggacccgcgacaacaacctcctcggcaagtttgagctgtcgggcatccctcctgcacccaggggagttccccagatcacggnctgctttgacatcgacgccaatggtatcctgaacgtgtctgctgaggacaagacgaccgggcagaagancaagatcaccatcaccaacgacangggcangctgagcaag

SEQ ID NO: 102993 - DNA, 643 bp, Triticum aestivum
  unsure (1)..(643): unsure at all n locations
  Clone ID: PAT_TA_102993
gaagatttgntctntgactacgcnaagctcgaaattnaccctactaaagggaacaaaagctggagctccaccgcggtggcggccgctctagaactagtggatcccccgggctgcaggaattcggcacgagcaccgttctccagtcgatcacgcacgctctcctcgccgccgagatgttcgggttcgggcaccaccacaaggaccaggcgccgccggcgtcgggccccaaccagatcttcaagatctactgccgcgcctccgaggactactgcctcgccgtccgcaacggngaggtggtgctcgcccccgtcaaccccaaggacgagacccagcactggctcaaggacatgcgcttcagcaccaccgtcaaggacgaggagggcatgccggccttcgcgctcgtcaacaaggccaccggcctggccgnnacncttcatggncagtcccacccngngangntggngccgtanacccggnctacgaaagaccccttngttnntgnggacagaaanggaaagtacattgnncganggncttncgatgcatccggatganaaaaaacacccgccttnggtttcnncnccctnaacggaaagaangaccacggggnggggtgcacgaccgcnccaccngttnttggttt

SEQ ID NO: 102994 - DNA, 691 bp, Triticum aestivum
  unsure (1)..(691): unsure at all n locations
  Clone ID: PAT_TA_102994
gaantttaatccttttcncgcctnaaccctcnctaaagggaacaaaagctggagctccaccgcggtggcggccgctctagaactagtggatcccccgggctgcaggaattcggcaccaggagagagagagagagagagagagagagagagaganagagagagngagagagagagagctnccccaaacccnncacttggtggnggcgnggngcacctcgaggaaggaggccaacatggtgaagttcttgaagcccggcaaggacgngntcctgctgcatggcatgtacgccnggaagaaggcggtgatcntgcgcntgttccangagggctcccgcnaccnncccttcgcgcactgcctcganaacggggctggnaatnactcnnagaaggaganccgcanggactcngccangaanacnggcatgaagncccccntttatgtctacctnaagntcngccncntcnaccacntctatnnncaccccgtncangnttgncgntctccctaaacnaanntgatcctcccggngccccnaaanttanaatccttttnccaaccngcattgaagggngcgggncnccnttccnantggcccgnccaaagggcccnancccctggnatngnnggangnttccntttgaaancnggtnnaaaaaaaaaaaaaagntngggttccnttcccncccnccc

SEQ ID NO: 102995 - DNA, 636 bp, Triticum aestivum
  unsure (1)..(636): unsure at all n locations
  Clone ID: PAT_TA_102995
gannttaanccttgattcgcccgctcgaaattaaccctcactaaagggaacaaaagctggagctccaccgcggtggcggccgctctagaactagtggatcccccgggctgcaggaatcctccccagcccaagctcgcagccatgcctcccaagctcgacccgtcccagatcgtggaggtgtatgtccgcgtcaccggcggggaggtcggcgctgcgtcgtccctggcccccaagatcggtccgctcggtctctccccaaagaagatcggagaagacatcgccaaggagacggccaaggactggaagggcctccgcgtcaccgtcaagctcaccgtccagaatcgccaggccaaggtgtccgtcgtcccctccgccgcagccctcgtcatcaaggcgctcaaggagcccgagagggaccgcaagaaggtcaagaacatcaagcacaacggcaacatcagcctcgacgacgtcatcgagatcgccaagatcatgaaggtccgctccatggccaaggagatggccggcaccgtcaaggagatcctcggcacctgcgtcagcgtcggctgcaccgtcgacggcaaggaccccaaggatcttgcagacggagatcgacgacngcgangtggagatccccct

SEQ ID NO: 102996 - DNA, 633 bp, Triticum aestivum
  unsure (1)..(633): unsure at all n locations
  Clone ID: PAT_TA_102996
gnnntttgntcgccaagctcgaaattaaccctactaaagggaacaaaagctggagctccaccgcggtggcggccgctctagaactagtggatcccccgggctgcaggaattcggcaccagacccaatctcgtctccgatcgacccgaggctcgtcgaacccttcttccccaccgcctcaagatgcagatcttcgtgaagacactcacgggcaagaccatcacccttgaggtggagtcgtctgacaccatcgacaacgtgaaggccaagatccaggacaaggagggcattcccccggaccagcagcgccttatcttcgctggcaagcagctggaggacggtcgcacccttgccgactacaacatccagaaggaatccaccctccacctggtgctccgcctgcgtggtggcatgcagatcttcgtgaagaccctcaccggcaagaccatcactctggaggttgatagctccgacaccattgacaacgtcaaggctaagatccaggacaaggagggcattcccccggaccaacaagcgccttatcttcgcangcaaacaactggangatggtcgacccttgncgactacaacattcaaaaggagtccaccctttacctggngctccgcttccgggg

SEQ ID NO: 102997 - DNA, 637 bp, Triticum aestivum
  unsure (1)..(637): unsure at all n locations
  Clone ID: PAT_TA_102997
gangtttgatctccagctcgnantnaaccctactananggactaaagggaacaaaagctggagctccaccgcggnggcggccgctctagaactagtggatcccccgggctgcaggaattcggcaccagactcaacttgagaacaaacattatctaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgatccccaagcagtcaagatgtgaggccatccacaacgtcgtgcacgccattattttgcaacagcaaaaacaattggtacaaggtacttcaacccaacctcagcagcagcaacaacaaggtcaacaagaacatggtcagggttctagccagccacacaccaacaacaacaacagcg

SEQ ID NO: 102998 - DNA, 668 bp, Triticum aestivum
  unsure (1)..(668): unsure at all n locations
  Clone ID: PAT_TA_102998
agnttgancctnttttcccccnctccaattaccctccttnaaggaacaaaactgggcttcccnccgtggcgggcgctcttnnantaatggatccccccgctncangaattttgnaccaagnacttcctnnatttaatccaacngctntcaanaccctctttttaattgcaacggcctcntggcttaaacaaaagcgnncctcctnaccacangctntttggnttancctncntccncctntgnaataaantngngggggnacaaanntatgtcaatttcaagaacctttnntgacanaacncnttnncaanctncctcatgncccatgtgtnnattnaccnggnncctttncaaacattnntggccnnaacttgngnttgaaatgntcctaccttcaggggcagngccaantgnatgnatttccctttnanaaacacaaaaaaanccccccagtttaaaggcctnggnggcttcggnggngatttntgnaaagccccncttnctggctttgngtgggggagggttcaaaaaacccacttattatnntggcttgggnaaccttcctttccaccgggctnaatggnaaacnttttttggattttncaggnaccccctttttttttttgggtgttggncatgnaaaaaaaaaaacnttttntttttttntt

SEQ ID NO: 102999 - DNA, 637 bp, Triticum aestivum
  unsure (1)..(637): unsure at all n locations
  Clone ID: PAT_TA_102999
gaatgagtttanccttgntcccctnntcntattaccgtactaaaagnnncaantctncgcttngcgccggtctnnaactctaggantcccngatcnnccgganttcaggannnnggctcgagcntcacngngnanatgaacgctttnccgggccccancaaanttnnnngantaaaccnaacatntgcgtccaanatcacaattgaganncccncctgggaatagatnttgcngnctttttatcggacnaaacngccaccnatnngncancctnaaactttgtccacgctnnncnataaacntnnaccaaatanacagnctctncgggagggtnttcattnaggctccccttgngtntctttcttnngcccagaataattagaatcntttcctgtgcacaatggatggggccnnacttnacgctctcnannntttcaatccanatctcnttnaaggngctgagaaatnccnanaangttnctccggggcaagnactgggcttccttttaagaggagcancacccctaatttttcntgctngataannaccaaagnantggnnctncttgctttcctnttgnagattnaccggaacataggtgnncccccccttaggaacnttgttgccgtacttnnc

SEQ ID NO: 103000 - DNA, 655 bp, Triticum aestivum
  unsure (1)..(655): unsure at all n locations
  Clone ID: PAT_TA_103000
agtngaggttgatccnttgntcacctnancctantaaacgnaactnaaggnnnaantgctnnngctcnnccgccgnggtagannttntagaactnnnggatcngccggantncagganttgggcacgaggagcgacnatgtcnagctcgncncntcaacgacccctttatnancaccganctcatgacctanatgttcaagtacnacaccgttncncnnccactggaagcacatntgacatcangctcaaggacgacaagacgctgctctttggcagagaagccatttaccgtcttcggngtcaggaaccctgangagatcccgnggggtgaggntggtgcgcgattacctttgtggatgtccaccggtgtcttcactgacnatggcanagntcnctgctcacttgaaggggcggtgccaagaaggtggncatctcttgnccaatcaaangatgnccctnttgtttgagggttggtgtnaaatnaaggacaaagtacacctcaaaccgttaacanttggnctcaanatgctagcntgcaccanttnactngncttgctgccctngcaaancattattnatgacancttcgggattattgangggttnattgaccactgttnattgcattactggcacncaaancacttnttgtgg

SEQ ID NO: 103001 - DNA, 634 bp, Triticum aestivum
  unsure (1)..(634): unsure at all n locations
  Clone ID: PAT_TA_103001
agnagnttnganctctgnttcgccagctcgaaattaaccctcactaaagggaacaaaagctggagctccaccgcggtggcggccgctctagaactagtggatcccccgggctgcaggaattcggcaccaggcacttcctcgatatgatccaactgcttacaacaccatactcaggaatgcaaggcctcatggcatcaacaagagcggccctcctgagcacaagctgtttggattcacctacctccggctgttgaatcagttggtggagggacaaaactatgtcaatttcaagacctttgttgacagaatgcatgccaacctgcctcatgacccatgtgttgatccagtggcgcctttgcaaagatcagggccagaactgacgattgaaatgatcctacaagcagcgcagccaaaactggatccattcccctttgaagagcacaccgacctgccagttcaaggcctcggtggcatcggtggggatgttgaangccccactggtggcatgggtggggaggttcaagaccccactggtagcatgggtggggagctccctgccaccgtctaatgaaacctttatgatctacagtaccttttatgttgtgtgtgacaaaaaaacctttctctgncttat

SEQ ID NO: 103002 - DNA, 1145 bp, Triticum aestivum
  unsure (1)..(1145): unsure at all n locations
  Clone ID: PAT_TA_103002
atttttatcccccccnntttttncntttacggtaaaacccatcttcaaaaaccccctttttggnaaaaaaattattaaaaaaccncccctttcccaacctttaaaaaaaaggggggggnaaaaacccaaaaaaaaaaaggccnttgggggnaaggccctttccccnaacccccggccngggggttgggggcccgggggcccccgggcntttcntttaaagnaaaaaccntaaaggtnggggggaanttccccccccccggggggncctttggcnaaaggggaaaanttttccgggncnaacccgnaaaggggttggcccccccctttccccntttncccaacnaacngntttnccnttttccnttttcggcaattggggctttgnacccaacccaacaaagaaagaaccanggggggttggttcccttaaaggcgggcggggcgggcggccctttcgggcgnacccggcaagtgggcccatttggaagggcttacgggcgggcgaaccaccaacgaagcaagcaccaagcaagaaagcaagcccgcgcttgattgttgccgcccttcaaangcccgcgaacgggcggggccacgggcccgcccggggtccgatgcttgcttgctattcccggggcttgaatccttgggcaagggccacccggtcattngcgctttacccgtgggccaacttccccgttgccttggggtcaattttttcaagcccccgggttgccttgggttgcccggggccgggcccaatttggcnggcctttgggcggccttttatttgttttcccgcccngggcttttttgttggaaccgtttccccgggccngggggcctttggggcccgntttggccgggggcggccttntttccggtgggttttntttcggtnggggatttgtttaccaaaaagttaacccttttaaccccggggnaaaaagccaaccccccggcccgggggcggccccgaaanccaancttttggaaccaacgcccaaanggggccggggttttgcgttcaaagggccgcgaacatttaaaggaacgccgcgcaanacccgcattgaccaaagcgcaagggggctttgaaaataaagtgcgtgccccgacaccccgggcgatgcgttggtgatgaacan

SEQ ID NO: 103003 - DNA, 681 bp, Triticum aestivum
  unsure (1)..(681): unsure at all n locations
  Clone ID: PAT_TA_103003
ngattctngctcgacattaaccctactaaagggaacaaaagctggagctccaccgcggtggcggccgctctagaactagtggatcccccgggctgcaggaattcggcaccagatcgtctccgcgtcccgcgaccgcaccatcaagctgtggaacaccctcggtgagtgcaagtacaccatcggcggtgaccttggaggcggcgagggccacaccggctgggtgtcctgcgtccgtttctcgcccaacaacttcgccccgaccatcgtctcgggctcatgggaccgctccgtcaaggtctggaaccttaccaactgcaagctccgctgcactcttgatggtcatggtggctatgttagcgccgttgcagtcagcccagacggttcgctttgcgcgtctggtggcaaggatggcgtcaccttgctgtgggatttgaccgagggcaagagactctactcgctggatgcgggatccattatcaactcactatgcttctcgcccaaccgctactggctctgcgcggcgacacaggattccatcaagatctgggatcttgagtcaaagcacatcgtgcaggaccttaggcccgaggtccctgtcttcaccaagcagatgctctactgcacttgcttgagctggagcgcggatggaacactctgtacgctggntacaccgatggaacn

SEQ ID NO: 103004 - DNA, 961 bp, Triticum aestivum
  unsure (1)..(961): unsure at all n locations
  Clone ID: PAT_TA_103004
ngannnccccnatgacncnnntgaaaaacccnaaangganttaaagggaacacaagctggagctccaccgnggnggcggccgctctattnctagtggntcccccgggctgcaggaggncggcaccagnantttcagctangnntccngnacccttctaatacnncngtnnaagangncgcnaatggtnnagggaaccntgaagtggntcaacgtnnncaananggnnnggattcatgtnncntgaggactgncancagnggacctattnntccaccanacngtnanttanntnngacagttaccgaancctnaactagaacgacaccgtctncgctcnaangtnantcatnctggaaanngcngtnagaccaatgccttcgntgtnaccatancacaangaagagnagnacttcnngaggaacnnagnccntgnnaanngnngttngtnnacnntnatgganncnnanntcgntactngtggnncgtntagnctactngganannggcctcncnncatncnnactgaccntaccgnaatnncnnnnngganngtgnnnggncttacanaggtagtgatcgntcannnngaagtnttgccatnannanttagngtnatgntatcgtatgnttcatagcacacgacgnnntaatgacactancanagantncngcccatgcacatnnatcggnnagtnnggngcnctaaatatnnntctatcgcgataccnanntnatctcangtntnacantnacaccaataaagatcggantgactanaanatacatnnacncgaancgnncanactcgtntngatataaanaaagacacnntgaaatngantgnntnggganntctcaanatattcgnataagtnanaatatgtcaannanttttntctcncgatntcntnaaaaatnnctcnanatnaaanattagngntctntatnccacacngcgcn

SEQ ID NO: 103005 - DNA, 680 bp, Triticum aestivum
  unsure (1)..(680): unsure at all n locations
  Clone ID: PAT_TA_103005
gaattccttggncncnctaancttgactaaagggaacannagctggagctccaccgcggtggcggccgctctagaactagtggatcccccgggctgcaggaattcggcaccaggtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttctggttgttgccaacccagcaaacaccaatgctctcatcctgaaggagtttgctncatctatccctgagaagaacatcagttggttgacccgnctaaccacaacanggcactcggtcagattt

SEQ ID NO: 103006 - DNA, 682 bp, Triticum aestivum
  unsure (1)..(682): unsure at all n locations
  Clone ID: PAT_TA_103006
gnanccctttgctccnnttaaccctactaaagggaacaaaagctggagctccaccgcggtggcggccgctctagaactagtggatcccccgggctgcaggaattcggcacgaggtggtatgggagctgggcgcaagctcaagacccaccgcaggaaccagaggtgggctgacaaggcatacaagaagagccacttgggtaacgagtggaagaaacccttcgccgggtcatctcacgccaagggcattgttttggagaagattggtattgaggccaagcagcctaactctgccatccgtaagtgtgctcgtgtgcagcttgtgaagaatggaaagaagattgccgccttcgttcccaatgatggttgcctgaacttcatcgaggagaatgacgaggtgctgatcgctggattcggtcgtaagggacatgctgtgggagatattcccggtgtccggttcaaggtcgtcaaggtgtcaggtgtttctctgcttgccctcttcaaagagaagaaggagaagcccaggtcttagattgccgttgcatggagtagacagtatgtcgggcctttagatgttgaaggaggatggtacctttgtgtttacagcacttttaagttgataacttatgatcgtgtttggtgaaaactatgccttgncacattttgctnctgttatgggaaagtg

SEQ ID NO: 103007 - DNA, 651 bp, Triticum aestivum
  unsure (1)..(651): unsure at all n locations
  Clone ID: PAT_TA_103007
ttnaaaaccgttnaatctttaaaaccttactaaagggaacaaaagctggagctccaccgcggtggcggccgctctagaactagtggatcccccgggctgcaggaattcggcaccaggccgtccgccgccgcagaggggagaggcggccgccgcccaccgccgcagcaccgccggccccgtcgcccccgccggtcgggtttgatcccatggcgtccaagaggatcctcaaggagctcaaggacctgcagaaggaccctcccacctcatgcagcgcaggtcctgtaggtgaggacatgttccactggcaggccactatcatgggaccctcggacagcccgttcaccggtggcctatttttggtgaacattcatttcccaccggattaccccttcaagcccccgaaggtctctttccgcaccaaggtgttccacccaaacatcaacagcaacggcagcatttgccttgacattctcaaggaacaagtggagcccggctttgaccatatcaaaggtcctgctgtcaatctgttcgttgctgacggacccgaaccccgatgatcctctggtgcccgagatcgctcacatgtacaagactgatagggccaaagtatgaatncacggcgcgctnctggacacagaaatacgccatggg

SEQ ID NO: 103008 - DNA, 640 bp, Triticum aestivum
  unsure (1)..(640): unsure at all n locations
  Clone ID: PAT_TA_103008
tgattcgccngctcgtctgattcgccagctcgaaattaaccctcactaaagggaacaaaagctggagctccaccgcggtggcggccgctctagaactagtggatcccccgggctgcaggaattcggcacgagcccaccaccagtcccctcgcaccctccggcgaaccaccgcacctctccccggcgaagcaacagcgtccgatggctcccaaggcggagaagaagccggctgccgctgagaagaccccggcggcggagaagaccacggcggggaagaagcccaaggccgagaagcggccgcccaagtccaaggagggcggcgccgacaaaaagaagaagaaggccaagaagagcgtggagacgtacaagatctacatcttcaaggtgctgaagcaggtgcacccggacatcggcatctcctccaaggccatgtccatcatgaactccttcattaaacgacatcttcgagaagctggccggcgagtcggccaagctcgcccgtacaacaagaagcccaccatcacgtcccgggagatccagacctccgtccgcctcgtcctccccggggagctcgccaagcacgccgtctccgagggcaccaaggccgtcaccaagttcacctcctcttagatacgccgtt

SEQ ID NO: 103009 - DNA, 553 bp, Triticum aestivum
  unsure (1)..(553): unsure at all n locations
  Clone ID: PAT_TA_103009
ttgattncgccaagctcgatattaaccctcactaaagggaacaaaagctggagctccaccgcggtggcggccgctctagaactagtggatcccccgggctgcaggaattcggcaccaggagagagagagagagagagagagagagagagagagagagagagagagagagagagagagagagagagagagagagagagagagngagagngngagagngnnatcgangcttttagantgnnttngaacntnnttnctgntntcaacttcntttnctttcttgtccatannttggngggtttnntngnntnttnttcncnctaatgccnactgntgtncgnacgtgacgtgccatgngctccttgcctgnttgacttctgntatncctacccaantnctnaattccagaaccctgtatntgtcntnctgctgntcatctcatactnnnnacctgtgnnnnatcttcnaccttgtatnctgctgtgngacngntnnannnnagactcncaatnttctcatgtttagtgncactgctcccattctcnagnnttcagtt

SEQ ID NO: 103010 - DNA, 908 bp, Triticum aestivum
  unsure (1)..(908): unsure at all n locations
  Clone ID: PAT_TA_103010
agggnnnnnnnnaaggagaggagggaggggnnnaggnnnnnnnnnnnttttnggggaaaaaaanccccnntttgnganaaaaaaanaancttttgggaaaaaaacccccgtttnngnnaaaaaaagggnccaaaaaaaaaaaggcngngggaannnaaaaagggganaacnannannggggnngggggaaagnnnncaanangggaaacgnanggnnggggganngcnnncngagggaanaggnagagggggaaanncngngggggggggggggaangnaatangggggggggggaggacnnaacaataaacancaaaagcaaggctttngggnggngncaccatgaaagaaccatgggggatnctcgctctgctcgnctttnaagggagacaagangnaaaggcagcaggnnggacacnacctgnaagacagggngagnggggaanggcaggngnaggggaagagggaganggaggngcagaacacangcgctggattgggcngcagnaagggcntccaaaggaccgaaaggngcaaggaagnggatnggggggggcaaaagnanngcnaggnnggangncgggaaacagnggnggcaggcggngggncaagaantaggangccaggnnaggnnggagggggaggntggagcgcnagngtangnagaagggnganaaacaaaggcaaagggntnggcngncanagagnangaagggggaaggtnaagcnaggacgggcnaangnangnaggntgnaaagnangnngggangnggggagaccnggcncnaaanggaangagngnaangnangnagaaaaagaaangnggacgnaaganacngnggggaaggaacnaannggcccgnnggagtnnagggnatggaccaanaaganaggaancggggtcg

SEQ ID NO: 103011 - DNA, 687 bp, Triticum aestivum
  unsure (1)..(687): unsure at all n locations
  Clone ID: PAT_TA_103011
tttgaaaaccctttnaaannncttgaantccgtcaagctcgaaattaaccctcactaaagggaacaaaagctggagctccaccgcggtggcggccgctctagaactagtggatcccccgggctgcaggaattcggcaccagcgggaggctatgttgataatacccatttcccaaggtgcaagtaaggtctgctatgtggagctctggttccgactcttgcccaattaccctgaatgccgttgcacagtctgaaggatgtggcatgtacccaggaaatgtatcgcatttgtgttagacgtgactgttattatgcttgtttggtggatgtaacggagtcatgcatgttgaagaaacatgctaagcagaaaaaaaaactcgcctgttattgagctgaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcnccagctggcggtaatagcgaanaggcccgcaccgatcgcccttcccaacagttgcgcagcctgaatggcgaatggcaaattgtaagcgttaatnttttgttaaaattcgcgttaaatttttgtaaatcanctcatttt

SEQ ID NO: 103012 - DNA, 674 bp, Triticum aestivum
  unsure (1)..(674): unsure at all n locations
  Clone ID: PAT_TA_103012
ttgaaatccgntaagctcgacttnaaccctactaaagggaacaaaagctggagctccaccgcggtggcggccgctctagaactagtggatcccccgggctgcaggaattcggcacgagnnaaancgcaacnggnnnnccnnncgancngnnccgaanntncancatacnctgcgcgcgccgacnactcnggcggcgacnatgggtgtctnggacgccatgnacngcntggcnatncnccggancggtnnntacntnaccntcctnggactnngngncttcggtgnctagcnncnngcgnactacggcgnananaaggtctggcagatgaacaacggcgaaaaannntntnaagacanatatgntcnnnggcaaaggcngnnnnagganngaacacatagnaacncacattncccntgannttnnaattgaaanttggcannnnatanaanttcatgnntngacanntttctttngcacnntannattgnnnaanncatttgctggtggtnntncactncctttnatnactatggcatgnanatgnnacacagnananaatggctatnactggancttnanaacaaagngtgatactatnnaaataatgaatggactnctttctaatgtaancatatgtanaaaaaaanaaanananaancctngccaagcctnn

SEQ ID NO: 103013 - DNA, 675 bp, Triticum aestivum
  unsure (1)..(675): unsure at all n locations
  Clone ID: PAT_TA_103013
aancccnttgnaannnctttgngnttccgnnagctcgaaattaaccctcactaaagggaacaaaagctggagctccaccgcggtggcggccgctctagaactagtggatcccccgggctgcaggaattcggcaccagatcaaaaccaagcaatactagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagnancaacaaccntttccacagcancaccaaccanttnttttatggaaccattancanttttcggaggaacaacaaccagttctgccgcaacagcaaccagttattatactgcaacaaccaccattttcgcagcaacaacaaccagttctaccacaacaaccaccattttcacaacaacaacaacaacaacaacaacaacaaccaccatttttgnaggaacaacaaccagntttnccacaacaaccaccatttttaaanaaacaacaaccaccattttttgnaggaggacaaccatttttcaanacccctttttccaanaacccaaaagnttccaanaacaaannctggngtaaacnt

SEQ ID NO: 103014 - DNA, 1134 bp, Triticum aestivum
  unsure (1)..(1134): unsure at all n locations
  Clone ID: PAT_TA_103014
aacnngngggnnnnnngnannggggnaaaannnggnngaaaanantggnaannnnnngggggggnnannnnnggnaanngtgggganannatnggngnnnannnncnatannncgnnnnnncaaagnnccnagagaagnggagggtaggnnnnnnntttggnaaaaaccccgctcnanaaaaangncttggaaanaccctttggaaaaaangccncaaaaagcntggggagnataacgaccnccggangggctggngagctctaggaactaagcngngancccccggantgcatgaattcggngggnaggaaaaaattgagggganngancgacngagnatganatgncnggcggnncctcacananaggtngganncngcgganaggcacgncanggggnngtnagcggacnnngcggcnacnggtngnacnaaggggngcnnaagnttcgctcncagcgcatancccnantantagatnacngngngcacagaaccnntncncgggnntccaagaaaggnaantcnncggnggaaggcnccacnagagncgaananaggacgggacnncgcagcggangcnngncnaaagaaacanangnncgggnggggcgctgggncaggatnnatggatcgcnnnagggagnaatgnacnantnggngnntcannggaaacggncgctatcgatagngttgnnganacgaacgggncagagagaanttggnncgcantgggnanaactatctggangngnggtggggggnnanaaaaaaannaagngngaccnatgntgtcgcaaggnatannaacnnagcgngcctggggncnactngggccntatnagccnangcnccgtatatgcttnatgaagaanntngggggcccntaaagnctntggnannaatnntncgngatgcggggagaaannacaanaaaggntcgagcgaacagtcgntgggnggnatntcgcgggggggtnagagcnatangtcgtttngngggaaanctcanaaaaaaaaaaacatgnaanangaaantcanggncncgcggggnaaaataagntctntnttnangggtgcgcnccnattgtgnaattnctcngaggggaattngngaganagggaacanncng

SEQ ID NO: 103015 - DNA, 685 bp, Triticum aestivum
  unsure (1)..(685): unsure at all n locations
  Clone ID: PAT_TA_103015
tgattcgctaagctcgaattntncntccncnagctcgaaattaaccctcactaaagggaacaaaagctggagctccaccgcggtggcggccgctctagaactagtggatcccccgggctgcaggaattcngcacgaggaagaccggcaacaaggacttccttgagctcagcaacctcctcgtcggtaacgttggcctcatcttcaccaagggtgacctcaaggaggttcgcgaggaggtcgccaagtacaaggttggcgctcctgctcgtgttgggctagttgcacctgttgatgtggtggttccccctggcaacactggtctggatccctcccagacgtccttcttccaggtgcttaacattcccaccaagattaacaagggtactgtggaaattactatcccagtggagctgatcaagaagggtgacaaggtgggctcctctgagtctgccctgcttgccaagcttggtatccgccccttctcatatggactggtcatctgcaatgtctatgacagtgggtctgtcttcagccctgaggttcttgaccttactgaggaagacctgatggacaagtttgcttctggtgtttccatggttgcctcactgtccctggcgatctcataccccaccatggctgctgcgccgcacatgttcctcaacgcatacaagaatgttcttgcgg

SEQ ID NO: 103016 - DNA, 697 bp, Triticum aestivum
  unsure (1)..(697): unsure at all n locations
  Clone ID: PAT_TA_103016
gnnnnagagnagnnnnnnnntntgattcgccagctcgaaattaaccccactanagggaacanaacctggatnnanaccncaanaggtggacnttctacgaactagtggatccccngggctgcaggaattcggcacnagctnaaatatggntgggcctgntaatgccgtgaannncaagaccntgntttaccttgcaggntcaactnctgctgaggnaattgntnatattgntctgngcccnngtgaagctgtnaangnccgcntgcaaacacagcctgttttgctcgtgggttgantgacggggcttaccaaaggcattaaagctgagggtgctggtgngatctacaagggcanngntncactntgggntnnacnnattcnttacaccatnatgaagantgcctcctttganaccattgntnngcttatcnacnngcacgctgntnctnttcccaaagncgagtgcacanggcttgccagtngggtntgatntttgctggtggctacattgccngctcttctggantattgtttctcactctgctgacaacnnggtgtcttttctcaacaatgccaaaggtgctatagngggngaggctnntaacnagatngtgctgttnggccttttcnnaanagggntaccccntcgtgtcnaangattggtactgttaccggtgcttanacgnggaatntntgn

SEQ ID NO: 103017 - DNA, 705 bp, Triticum aestivum
  unsure (1)..(705): unsure at all n locations
  Clone ID: PAT_TA_103017
gnnnnnnnnnnnntntgnnnccnnnnnnnnnnnnttctgnttacgccagctcgaaattaaccctcactaaagggaacaaaagctggagctccaccgcggtggcggccgctctagaactagtggatcccccgggctgcaggaattcggcaccaggccttcacggcgacaagcgctgttgcgcagctgtacactacctgtagccagggctacgggcaatgccagcagcagccgcagccgcagccgcagccacagccgcagatgaacacatgcgctgctttcctgcagcagtgcagccagacaccacatgtccagacacagatgtggcaggcaagcggttgccagttggtgcggcaacagtgctgccagccgctggcccagatctcggagcaggctcggtgccaggccgtctgtagcgtggcacagatcatcatgcggcagcagcaagggcaaagtttcgggcagcctcagcagcaggttccggtcgagataatgaggatggtgcttcagacccttccgttgatgtgcagagtgaacatcccacaatattgcaccaccaccccgtgcagcaccatcacccccgccatctacagcatccccatgacagctacctgtgctggtggtgcctgctaagatctgtgatgtgctagctagatcgatcaccggttaattgatcgatgaagagctacaaaataaaagtgccataca

SEQ ID NO: 103018 - DNA, 651 bp, Triticum aestivum
  unsure (1)..(651): unsure at all n locations
  Clone ID: PAT_TA_103018
gagannttaaaccctnagtnttantcccttngctcgacnnaaccctactaaagggaacaaaanctggagctncaccnnnnnngnnnncgntttnnaactagntgntnnnattnnctnccagnattngccctngtccctnntccaaatgtggggcgagctcgagcaccgnngctctgacgccnganantcctttgaccgcnagccgtacnngnacacgcccgaccgccnccggnagcncntgcnncttatcgatctacngctnaccatctgacacggtacatgnctnacggtccnggacggcaaggnnantggtngacnggctcgaccacacggaaaggcananggtctggctcgtcnngnntgtgnttgcagatggccatccaggacgcncgacgccctcncggccttccgcattggaggacncgaccgccgcggttagggagaagcaatgggngcctccnccatccccnganggttggccccncanatctgattactaagatnncctcgggngcttcagacggagngcaaggacgttgtcaaggnctnacattgtatcnaaaattgtcaacaacaaccgacttaacttttangctnttttttgngncaanggactnnngggggagtgcacgactgcaccaccntngggct

SEQ ID NO: 103019 - DNA, 648 bp, Triticum aestivum
  unsure (1)..(648): unsure at all n locations
  Clone ID: PAT_TA_103019
gagngnttnannccctagntttgattncgccagctcgaaattaaccctcactaaagggaacaaaagctggagctccaccgcggtggcggccgctctagaactagtggatcccccgggctgcaggaattcgggcaccagcacaactagagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattnccccaacaaccccnactaccatttncccaacaaccccaacaaccattctngcagccttagcaaccncaacaaccatttccccagtcacaacaaccacaacaaccttttacccngccncaacaacantttccgnagccncancaaccacancaatcat

SEQ ID NO: 103020 - DNA, 629 bp, Triticum aestivum
  unsure (1)..(629): unsure at all n locations
  Clone ID: PAT_TA_103020
taganttgtacgcnagtttnntcatttattangggaacanaagntggagctccaccgcggnggcggccgctctagaactagtggatcccccgggctgcaggaattcggcacgaggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgttggtaacgtcctcccgctccgctccgtgcctgagggaggcgtcatctgcaacgtcgagcaccacgtcggcgaccgtggtgtcttcgccagggcctccggtgactacgccatcgtcatcagccacaaccctgacaacggcacctcaaggatcaagctcccctctggtgccaagaagattgtcccaagcagctgccgtgccatgattggtcaggttgctggtggtggcaggactgagaagccaatgctcaaggctggtaacgcctaccacaagtaccgcgtgaagaggaactcctggcctaangtgcgtggtgtggccatgaaccctgtggagcatccccacggaggaggtaaccaccagcatattggtcacgctttcactg

SEQ ID NO: 103021 - DNA, 631 bp, Triticum aestivum
  unsure (1)..(631): unsure at all n locations
  Clone ID: PAT_TA_103021
gngnnnttnaatctnttagnttgacctccaccctactaaagggaacaaaagctggagctccaccgcggtggcggccgctctagaactagtggatcccccgggctgcaggaattcggcaccagagcaaaactagntngcancaatccattatgaagaccttnctngtntttgnccttctagncgntgnggngacatntgccattgcacagatgganactagctgnatccctggtttggagagaccatggcagcancaaccattcaacaangagagacatttccacaacnnccaccatcttcacaacaacaacaaccattttctcaacaaccaccatttttgcagnancaaccttcattttcgnagcaaccactattttnacagaaacaacaaccaggtctaccacancaaccagcattttcgcagcagcaacaaacagntctaccncaacaaccagcattttcgcagnaacaacaccaacagcttntggaacaacaaatccctatnggtcatccatccattntgnagcagntaaacccgtgcaaggtatttctccagcagnagtgtnccctgtggcaatgcccaacatnttgctaggtcgcagatgtggcacaaancaattgcaangngatg

SEQ ID NO: 103022 - DNA, 640 bp, Triticum aestivum
  unsure (1)..(640): unsure at all n locations
  Clone ID: PAT_TA_103022
gnngngnttannnccttnnttntgnttncgccagctcgaaattaaccctcactaaagggaacaaaagctggagctccaccgcggtggcggccgctctagaactagtggatcccccgggctgcaggaattcggcacgagggctcacgaaccaggacaagaacaaatacaatacccccaagtaccgttttgttgtgcgatttaccaacaaggatgtcactgcacaaattgtctatgctaccattgctggtgatatcgtgatggccgctgcctactcccatgagttgcctcgctacggtcttgaagttggcctcaccaactatgctgcagcctactgcactggtctgcttttggctcgtcgtgtgctcaagaaccgtgatcttgatgaggagtatgaaggcaatgttgaggccacaggtgaggacttctctgttgagccttctgatgagaggaggcctttccgtgcgctcttggatgttggtcttattaggaccaccactgggaaccgcgtgtttggtgcccttaagggagctttggatggtggtcttgacattccccacagtgacaagagatttgctggttttaagaaggacgagaagtcgctggatgctgagattcaccgcaagtacatctttggagggcn

SEQ ID NO: 103023 - DNA, 753 bp, Triticum aestivum
  unsure (1)..(753): unsure at all n locations
  Clone ID: PAT_TA_103023
gnatgttattcccttgctntgantcgccagctcgaaattaaccctactaaagggaacaaaagctggagctccaccgcggtggcggccgctctagaactagtggatcccccgggctgcaggaattcggcacgagcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcggcgagtccatctacggcgagaagttcgccgacgagaagttcgtccacaagcacaccaagcccgggatnctcttcatggccaacgcgggcccaacaccaacggttccagttcttcatctgcaccgtcccctgcaattggctcgacggcaagcacgtggtcttcggcgaggtcgtcgagggcatggacgtcgtcaagaacatcgagaaggtgggctcccgcagcggcacctgctcaacaagtggtcatcgccgactgcggcagctctaatccgccgcgcgcggtcgctttcgccgtctcgtcgccgcccngtgtnccgtgtcgtgtcgtcgatctaataa

SEQ ID NO: 103024 - DNA, 763 bp, Triticum aestivum
  unsure (1)..(763): unsure at all n locations
  Clone ID: PAT_TA_103024
gagtgttaattcccttgcttgnnctacaccctactaaagggaacaaaagctggagctccaccgcggtggcggccgctctagaactagtggatcccccgggctgcaggaattcggcaccagggcaacaaccatggccaccgncaatatgcaagtcgaccccagcggccaagtacaatggccacaacaacaaccattcccccagccccaacaaccattctggcagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattnccccaacaaccccaactaccattttcccaacaaccccaacaaccattcccccagcctcagcaaccccaacaaccatttgcccagtcacaacaaccacaacaaccttttcccagccccaacaacaatttccgcaggcccaacaaccacaacaatcattcccccaacaacaacaaccggcgattcagtcatttctacaacaacagatgaacccctgcaagaatttcctcttgcagcaatgcaaccatgtgtcattggtgtatctctcgtgtcaataattttgccacgaagtgattggcaagtgatgcagcaacaatggtgcaacaactaagacaaattcttaaaaagttcaggngngnagcattcacaggggtgggcattcat

SEQ ID NO: 103025 - DNA, 995 bp, Triticum aestivum
  unsure (1)..(995): unsure at all n locations
  Clone ID: PAT_TA_103025
gagngtntnacccttngtgtnaccccttnaaaaaccnnaacaatttanagggaacanaagcnggagctccaccncggtggcggncgctctanaactagtggatcccccgggctgcagggggtcnncacgagnncactnctacngctgatacnccactgctnntaccagnacacttncttgggacctctnccaacatgtctacaggtgacccgnncctacctagaccagaggntctgcgtcgccaacccgntgctncanagaggctgncatggncgnagccaaggccggnngcagtnnccgncgtngctgccgnaatccccaccctagcaaagcgtgaggatgctgcctgtgggcganggcgcacttgnacccnaccgggcaggcggcttcattatgttcaccgncncctggnnngnactacttcattgtntnncnaccagaccatttntctccatggtccagaaagncacntncttnntangncgacgccggngnccancntgaaanaanaccctccctttcgacctnaattatggnttntcaattngngccngaaacnggcncnannnnntaaanctttctccctncctnacggatanggnaagccattancntggantggnaaggcncccttatnttccnaannatgnganggccncnangccttcgctcnnnaactanngccanatgngggntggcngngcntcntcttngcncnctnttccntntagnncgttgnccanactatcnttccttggnnntgcnaaagnttatatgccattnncatngnntttnctccancccccangctnnaattnctttnggcaaaaatnnaaacacaatgtncnnnctntngcttattattttgggnaccctcattacaantctnnnncatctnngctccgtnattncgncgcnataacgcatntanatnntctanagtcgggatggggnggggnnncctcggntngaacctcnnaatatatctacgcnnt

SEQ ID NO: 103026 - DNA, 775 bp, Triticum aestivum
  unsure (1)..(775): unsure at all n locations
  Clone ID: PAT_TA_103026
anatatttnattcccttngtttnattccgntagctcgaaattaaccctactaaagggaacaaaagctggagctccaccgcggtggcggccgctctagaactagtggatcccccgggctgcaggaattcggcaccaggaaagcncaancatnaaattnannctggtannntttaactaanntgnngcntgnagaccntnctnatcctaacaatccttgcgtggcaacaacaatcggcactggcnatatgcnagntgacnntagcaggcanctacaatggccacacnaacaaccacccnnccagtcctaacnncgattttcctngcnnccacannaaatnttttnncaaccnnaananaaanttcctgggatcaactacaataatcatttctccaacctgaacnaanattgccccgtcgtccacatcaacaanntgacaagnccnagctnccacaagaaccattnnntcaantnncnacaagcngaactaccatttccgcancnaccacnacaaccattncnccatcctcaacanccncnacatccatttccctagtganangnnccacatcaaccttttgctnaatncnnacaacaattnccggaggctcaacaaccacagcnattattcccnccaacancancantngatgattcaatcattnctacaacaacaagatgaacccctgctggaatttcctcttgcancaatgcaaccctgtgtcattgggncatctctcggnngaatgatcttgccacnaatgattggcactnatc

SEQ ID NO: 103027 - DNA, 769 bp, Triticum aestivum
  unsure (1)..(769): unsure at all n locations
  Clone ID: PAT_TA_103027
gagnnttgnatacncttgntntgacacnccagctcgaaattaaccctactaaagggaacaaaagctggagctccaccgcggtggcggcccgctctagaactagtggatcccccgggctgcaggaattcggcaccagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcaaggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaaattcgacgttggtaacgtggtcatggtgactggcgggcgcaacactgggcgtgttggtgtgatcaagaacagggagaagcataagggaaccttcgagaccatccacgttgaggatgcccaaggccaccagttcgccacccgtctgggcaatgtattcaccattggcaagggcaccaagccatgggtgagcctccccaaaggcnanggtatnaaagctcaccattattgangagcaaaaggaagcgggattgccgttgcccancttgttgccaaggcctgatnttgagcgttgatcgtt

SEQ ID NO: 103028 - DNA, 765 bp, Triticum aestivum
  unsure (1)..(765): unsure at all n locations
  Clone ID: PAT_TA_103028
gagtnttgntcnctgcttnaattcaccctnctaaagggaacaaaagctggagctccaccgcggtggcggccgctctagaactagtggatcccccgggctgnnggaattcggtnccagccaccgcgnatntgtntgnntancccanggggcatgtcnatggnngcaangnctgcntgccgnaggccccctntnnatttnttgctcttccncacttcctntactgtcccactnccntttttgnataaccacancgtcnntttncccnttccctgtgnccacgataacgatgnttnnnncccnctctgccacgacanncntntccngnggnnnnacaagggcatctnccattttggcancatntcannggatccatnatccnntactcatanactcncataaccgtnttgaaattatannntccnatgcttnctacncaatngtagatcataaaatcttggccacacnaacnatggtgattgagggntctatacatgacnnntgnacncttncaagaantncctnttacatnatganccttgtgaantggagtnatncnttgcccaatgncacntgccncganangantcgtnggggtgtgtgnttcaacattgngtgnngncaccctagccntgggttgnctcntcccgctttnagtggggggntatcatannttanccnttcattgnttgncnntcngggttgccgggaangccnantaccanggctntttggcancgcccggantcttgtggcntttagtccatn

SEQ ID NO: 103029 - DNA, 764 bp, Triticum aestivum
  unsure (1)..(764): unsure at all n locations
  Clone ID: PAT_TA_103029
anattaaanccctttnttttnnttncgctagctcgaaattaaccctactaaagggaacaaaagctggagctccaccgcggtggcggccgctctagaactagtggatcccccgggctgcaggaattcggcacgagaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcaagcaacaatgttgccaacaactggcacagattcctcagcagctccagtgtgcagccatccatagtgtcgtgcattccatcatcatgcagcaagaacaacgacaaggcgtgcagatccggcggccactgtttaactcgtcanggtcanggcatcatccaacctcaacaaccagctcaattggaggtgatcangtcattgtattgagaactcttccaaccatgtgcaacgtgatgtctaactgatggtcaccatcaacgcac

SEQ ID NO: 103030 - DNA, 750 bp, Triticum aestivum
  unsure (1)..(750): unsure at all n locations
  Clone ID: PAT_TA_103030
gntgaaaccttgcttactnnccctactaaagggaacaaaagctggagctccaccgcggtggcggccgctctagaactagtggatcccccgggctgcaggaattcggcaccagctctcatgagtggaacttggtcaacaagcagaagcctatctggatgaggaaaccagaggagatcaacaaggaagagtacgcagctttttacaagagcttgaccaatgactgggaggagcatttggctgtcaagcacttctctgttgagggtcagcttgagttcaaggctgtcctgtttgtgcccaagagggcccccttcgacctcttcgacaacaagaagaaggccaacaacatcaagctgtacgtgcgccgtgtcttcatcatggacaactgtgaggagttgatccctgagtacctgagctttgtcaagggtattgttgattcaaaggaccttccctgaacatctcccgtgagactctncagcagaacaagatcctcaaggtcatcaggaagaaccttgtcaagaagtgcattgagctcttctttgagattgctgagaacaaggaggactacaacaagttctacgaggccttctccaagaacctcaacttggcatncacgangactccagaacaggaccaagattgccgagcttctgaggtccactccacccaaagtggcgatgaactgacaagcctgaaggactatgtgancaggatgaaggagggacagaacgagatctactacttactggtgag

SEQ ID NO: 103031 - DNA, 658 bp, Triticum aestivum
  unsure (1)..(658): unsure at all n locations
  Clone ID: PAT_TA_103031
gnntggttcctgctttnattccgcnagctcgaaattaaccctactaaagggaacaaaagctggagctccaccgcggtggcggccgctctagaactagtggatcccccgggctgcaggaattcggcacnagggatcnnacattctnnannnccaatngcccatggaannanntantanggcttggnctnntngangtngggnggaccacnncgngcngancaancnttntntgnatngcngctgatnnncnncnnancntttcatcatactnngacnatngntnnnntangnnnccncctgaacttccnggnacacatnaatgntngtacccntgctganatggcnactncaacactagaggatatcctgtganatgtgatgatgcnntnacangtggancacatatacatgantntgatgtgntancagtgtanaatcaatgngtggcnatcnccancaatggnactgagcttgcactngtatgacacctaggtngcttctnctnttctgnnttnancancaannganncnnngggnctnacacggnntntanctgacacncaanntngacagcngngntgngatgtnnntgancaactacgttggcacacntttaacctctgnngcacttagntctngccataccgttgccnnatna

SEQ ID NO: 103032 - DNA, 759 bp, Triticum aestivum
  unsure (1)..(759): unsure at all n locations
  Clone ID: PAT_TA_103032
gnntntnnttccnagcttgnatcccnngctcgacttaaccctactaaagggaacaaaagctggagctccaccgcggtggcggccgctctagaactagtggatcccccgggctgcaggaattcggcacgagggatagcagatacaacaggcccagaggccgtggcaacggatattatggttttggcaatgagagtcaggatggaacaattgagctcaacagaggtcctaggtctggtcgtttcaagaaccagaaagcatttggccatactgttactattgctgtgaaagggcagaccctcccttcaagtgaaaacaagaatgctagtgacatacctgataaggcacagttcaacctagaggatttccctgtccagtatgatgatgcaaagttttttgtcatcaaatcatacagcgaggatgatatccataagagtataaaatacaatgtgtgggcaagtaccaccaatggaaacaagaacttgatgctgcttatcaagaagctcangcaaagggctctagctgccctatattcttgtttttctcggtgaatacaagtggacagtttgttggtgttgctgaaatgactggtcctgttgattttgaaaaaactctagagtactggcaacaagacaagtggnatggntcattctctgtcaagtggcacattgcaaagatgttcccaacaacattctcaagcacatcgtccttgagaacaacgagggcaagccagtcacaaacagccgggacacacangatnta

SEQ ID NO: 103033 - DNA, 759 bp, Triticum aestivum
  unsure (1)..(759): unsure at all n locations
  Clone ID: PAT_TA_103033
gcggtgttcgcnagcttttnntcncntgctcgaaattaccctactaaagggaacaaaagctggagctccaccgcggtggcggccgctctagaactagtggatcccccgggctgcaggaattcggcacgagggnacaaccanctttnntgnatcnncanccaccgngtcttccnnnacaacanntnccntatgtnctntcatntatnttgcngcanctaatcccatgcnaggtattgctccancancaatgccnccctgtggctatgccacanagtctngctaggncgnnnntntngtgnnacancanctgncntntgnngcagcaccantgttnccagcagntgccgcgtatccccanacnatcacgctntgatgcaatccncgcnatcatntactcgatcgttctacaagaacaacatcctggnnagggtntcaaccaacnttagcaganacaacccctatantcggtccaaggtgtattctnccccaccaacaacngaanntgataggacagngttcttttcaacgacctacacnacnacnacnggntccatggcctncaccacnnccggnaccncntggtaccttgtttgcaacacaccanatagcttgcatngatngaggactgncattgcactcngtaccctngcaatgatgtgcagtgtcaaccngccggcntaccgnaccannactaatntgccattcnngttnntnncaaattnntgcctactgntaangaaaatnnctntngnaatgttn

SEQ ID NO: 103034 - DNA, 775 bp, Triticum aestivum
  unsure (1)..(775): unsure at all n locations
  Clone ID: PAT_TA_103034
nagnttaaaccctngcttgnataccccnantnaanggacnnaagntggagctccaccgcggtggcggccgctctagaactagtgggatcccccgggctgcaggaattcggcaccagcacttgatggcgtcggaccgntccnaaaaaccncccgcggcggccaccgnatcnttcgctattgcngccgccgccacgcnatgcacttgnggatctgnttggtgcgaccncaagcggtccttctanttnttggcctgccnngtctgcnngcnccgtcgcacatgaagaaggccaagctccccaccagtntatcctnctccgtcgntcacnccantcgtaccctnntntgtgttccncgcacaccccagggctccacgcagnaaaccccagcgctccctnatccagatccctctggtccatcgccgcacccacncctgcgctagcgccncacttttcaaaaaaccaggcttnnatngggtgcaaccaanangccatngatgtcggtanaantntgagatcgnaagatggctcatatntttgnggtggncattgatggaacataggaccacaanggncatttggtttccanagatgggcatgagatcttntccctgngaaatnagagtgcaganatacatcngnggtgaatncaaagaattnggaaaataaaactgtnncaaatngggaaaaactgaaaggagatgatgtgcnaacttgnggtgggaagatacttgatgctacncttggaagatgnnnangaatggaggggncccataaat

SEQ ID NO: 103035 - DNA, 895 bp, Triticum aestivum
  unsure (1)..(895): unsure at all n locations
  Clone ID: PAT_TA_103035
naantgnanaannctttgattgnanccccttgaaaaaccaaaaanattttgngaggaacanaagctggagctccaccgcggtggcggccgctctagaactagtggatccnccgggctgcaggnattngncaccngaatctttngaacccnaaccaccncccacancnntcctangnctttaccncancccttgctntaggcgatncctancactttactnattttnaacagctnnttgaatgngaccncaatccntncttnctctngacctgcncctatncgtacggnacgngcatnnccntnnnaangnccagatccacnccntctccttgctccgntacctatananccacgtggtnattcnctcttattncacnggtcaccccntnttcctcaccgcgncanaancacncctantctttgccananaantnttnnnnattnanatggccgatnaatncnatcnnnttgcannanttttngtttanatnaccaaaataanannttggttatngtcnccangaaatnntnnnttnaatcnggaanaanaannganacttatanactgaacanttgcnnngnnttnntncaantngtncccgtctnaattntgacaccnanaanccctacntantnnggncnagatattgtntctacctaaagaatcntaacnttnctatatcananaaaannatcncgaccnncangtcaanctnttancngnccncaacagctnnncgaacnggtggantcaaactncctgatatttttctttttnncnggttanatccnnntgtcaatatttngactaaanatnnntaannatttnntgttcntgcggantgnatgtctacanagcangagnntnngctacaanntagtncgcaaaaaacnn

SEQ ID NO: 103036 - DNA, 675 bp, Triticum aestivum
  unsure (1)..(675): unsure at all n locations
  Clone ID: PAT_TA_103036
nnngnttgttcntnctnaactnanccnacnctactaannggaacaaaagctggagctccaccgcggtggnggctcgctctagaactagtggatcccccgggctgcangaattcgnnnccancntnattgnacccgtcgnaaataatggtggccctcnnngntctntaacctgnntcntcngtggaggtgcccccatnatcncagcaccctgnantannggggtagcggnagaacccacgcccgtcctgtggcctcgccnanctnncgcgggccaccattatttgngacgcctgcnaacnngggtttccctantgctncgtccacctttttggtccacttatgcgccagcctccaccaccaccgatgcccagncgtgtgcnggtgcggcggtctccggttgngntgaccanngactngntgggcnngatgggttnaattttgttnaaaantntgatgcnagtaatgtggntgatgnaattgtgcttnaatnaaaggagccaacccctgatcctgnactacttttgnggggaagcgtcatnttnaacagcagtcaanccaacaaaantgctcnctgngnaccgggctccntntcngagatntttatnatgccttgttacaagaagaaactctnntnttctnggggggncaaagaaaancatgcgttcncctgaactg

SEQ ID NO: 103037 - DNA, 784 bp, Triticum aestivum
  unsure (1)..(784): unsure at all n locations
  Clone ID: PAT_TA_103037
ngnnttgttnntcccnagctcgaanttaaccctcactaaagggaacaaaagctggagctccaccgcggnggnggctngctctagaactantngatccccngggctgnnngaattcgnnnccanacntantgnncccgttggaantcntngtggnnntctgtgatctgtnacctgantccaccnnggangtgtccnanttatgncaggccctgtaangaattancagcggnacaacctnagcccntacnntggcctcccacattnttcccagctnctgtttttnngaccactntgaacantgggntntgactactgctcgttcgcgcttttngatctnnnnngggtngaggtacnncncnacnaanaccatganctgtncaagctcgncggtctcaggttgngntngcctttgcccttctgngcattnatgggtttgatttttgtctggaaaaaaataaacctaattaatgtcggcaanatnaattgttcctttaatttaggnanccnacccctggggnctgggnccttcgnttntgggcctggaaacccnttntctttcaaccaagcnggnngaaancccaaccaaagaattnccntttncnnggggggacccccccggttttcnccaatttttggggcctntaattaaaanggggggggcccttntttnaaaaattgnaaaagaaagaccccccttnattttttttccccaaaaaaggccnggnngaaaaatngggggaaaaaaaaanccggggtgnggggntttttccccaaaatttccaaa

SEQ ID NO: 103038 - DNA, 674 bp, Triticum aestivum
  unsure (1)..(674): unsure at all n locations
  Clone ID: PAT_TA_103038
gnngnttgttgcntccctagctcgaaannaccctactaaagggaacaaaagctggagctccaccgcggnggcggccgctctagaactagtggatcccccgggctgcaggaattcggcacgagccaagtcataaacccaagtcggactcgccttcctcctccccaactactcctctcctccgcgcatcgcatcgnaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccanaagatgaaatccgccatctggtgatcntnggaatgtgaaacntggaacggatggtgttgctaacatcaatggtactgactggcatatccnccttactggaccaaattcaattgttggccgtgctgttgtcgtccacggtgacgctgatgatcttgncaagggtggacatgagcttaacaagacactggaaacnctggtgcccgtgttgnttgcggaatattcggnntcaag

SEQ ID NO: 103039 - DNA, 698 bp, Triticum aestivum
  unsure (1)..(698): unsure at all n locations
  Clone ID: PAT_TA_103039
nnagntttttacctccttgaaatnaaccctactaaagggaacaaaagctggagctccaccgcggtggcggccgctctagaactagtggatcccccgggctgcaggaattcggcaccagccgccgatccaccaccgccgccgccaacaccacacctcgagagtcctcgccgccggagaagcaggcaagcgagatggccgggaggaagggcggcgagaggaagaagtcggtgacccggtccgtgaaggccgggctncangttccccgtcggccgcatcgggcgcttcctcaagaagggccgctacgcgcagcgcgtcggctccggcgcccccgtctacctcgccgccgtcctcgagtacctcgccgccgaggtcctggagctggccggcaacgcggccaaggacaacaagaagacccgcatcgtgccgcggcacctgctgctggccgtccgcaacgaccaaggagctcggcaggctgctcgccggcgtaccatcgcccacggcggcgtgatccccaacatnaaccccgtgctggttcccnaaaaattccccccccccccccnaaaaagaaggccancnaagtcgnccaaaaaaanaagggccgncggccaagtncccccaaaaaanaagccccgnccgnccgccnaagaagtaaccttggncttattacgcccganggaaccgtgtcgtggttgccttat

SEQ ID NO: 103040 - DNA, 690 bp, Triticum aestivum
  unsure (1)..(690): unsure at all n locations
  Clone ID: PAT_TA_103040
gnagtgttgtttgcttcgcnagctcgaaatnaaccctactaaagggaacaaaagctggagctccaccgcggtggcggccgctctagaactagtggatcccccgggctgcaggaattcggcacgagagcaacactagttaacaccaatccaccatgaagaccttcctcgtctttgccctcctcaccgttgcggcgacaagtgcaattgcgcagatggagactagatgcatccctggtttggagagaccatggcagcagcaaccattaccaccacaacagacatttccacaacaaccactattttcacaacaacaacaacaacaactatttcctcaacaaccatcattttcgcagcaacaaccaccattttggcagcaacaaccaccattttctcagcaacaaccaattctaccacagcaaccaccattttcgcagcaacaacaactagttctaccgnaacaaccaccattttcacagnaacaacaaccaggtttaccttcacaacaatcaccttttccacaacaacaacaacaacaccaacaggttggtgcaacaacaaatccctggtggttaagccatncattttgnaagaacttaaacccatgcaaggtatttctttcaagcaagcaagtgcaagccctgtggcaatgccacaacgtcttgctaggtcgcaaatgttgcaagcaagagc

SEQ ID NO: 103041 - DNA, 676 bp, Triticum aestivum
  unsure (1)..(676): unsure at all n locations
  Clone ID: PAT_TA_103041
ngnagntttgttncttcctcggctngacnctaccntactaaacggaacanaanctngagctncaccgggggggngncnnctntnaaactantngatcccctggnctgnntgaattcnngnccagtngtcttttcttncngncgcgnntgtttnatccccgcttnacttcnttcctntcttcgcngacntcnacgntgtcatcttngnggccccnnncgcccanncgaaaaacangaccntcnctaagnncagctntcgcggcggngatctccatnnnctnctcattntgtacaccgnngacctngtccacatnttcccngctcgngcccgnatnaantttaaaangngtcttnagaagnaccccnttnctntcgcgattaancntggncaaggngaaaaaagacnctctnctngtaanaagcctgagttagtgagnncacancttcangacatgngcattgcccttgagatgattggatggcntactggtggccaaaaaagggannccntcatcccgngtgctaattacactggaactgttggggctttccttggccaggtctttatctnctacctgtcatttaaanatnttaaggccngggtttgtgacntacactatngtgnnggncattcnncttaananaattatggccgttnntacnttcnaacanttccc

SEQ ID NO: 103042 - DNA, 606 bp, Triticum aestivum
  unsure (1)..(606): unsure at all n locations
  Clone ID: PAT_TA_103042
nnngngttgtttgnncncnagctcgaaattaaccctcactaaagggaacaaaagctggagctccaccgcggtggcggccgctctagaactagtggatcccccgggctgcaggaattcggcacnagatntggngnnnancatgannnnnactgctgcttcnttctacanngcagnnnntgcnntnacatnngnntngncnngggnactgaanaatttatcanncatatncanacnncaggnnagctntgctgatgctnttgnntgngacncccnagntcttattataaannctactgcaanngannctcttgttaatacaggaaatncatntnatgaggatggaacnagtggacttgcaattcagnattcntncatgctgtgacanntncncncaatatngcgggngccgacaccaccttagncttanntnattangatngtgnacatcnaganccctntcnctcctgtaacanactnttgctggtctgntntcngantactcaactctttcttaaagtgttggangnanaaggtcttgtccggagtgactatataacnnactaanngtatttgcacgnaccttatnttgnatctatntcttnnccn

SEQ ID NO: 103043 - DNA, 790 bp, Triticum aestivum
  unsure (1)..(790): unsure at all n locations
  Clone ID: PAT_TA_103043
nnngngttgttacntnctcgaaatnaccctactaaagggaacaaaagctggagctccaccgcggtggcggccgctctagaactagtggatcccccgggctgcaggaattcggcacgagcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaaagacctaccctgctggggtcatggacatcattttcatttccnaaactngngaaaacttccaggcttnttttttgacanccaaagggtcggtttcccccnttacttttnttaanggattaaggattcttaaanttcaaacttntttcaaaggggaaaggggttgttgccacaattttngggccccaaaaanggggcntttncccccttaanccttggnaaccaancccttatttgaatnggggnccgggaaanccaaattnccgggttttncccccaaaaaaaccccccacntttcantttaaaaaggggncccaaaatnggcnacccccccnntttnaaaaggccntttggaaaccccttnggggggaannccccccccccc

SEQ ID NO: 103044 - DNA, 845 bp, Triticum aestivum
  unsure (1)..(845): unsure at all n locations
  Clone ID: PAT_TA_103044
cccagnngntgnngnaatnnctntgcccgaacctaaccctactaaanggaacaaaagnnggancnccaccgnnggggcngccgnnntnaaactagtggatnccccgggctgcatngaattcncgcnnggggggtntnntnaaaaaanactctntgnccctnacnctgntagcatccatgcnctnnaccgnntaaattaaccanngcccacagggatgaanaccanaaaagggataacctacctgtctttcattntcccaagcttnngttacccaaaaacnncntttttnccctcanagcttcccccctagccgaactnnnantcctcctcntnncnccgaacncaanggcttctnccttggagntctcgcttactatgttacctcccnatncaaagtcgnngaccnggtggcgaatccattccatgcattgttnnataccgttctgnggcnancagcatgtgctctcttctcaaaaacatgggattgaagtctnttggttnattcacanccnncaatgtttgcttnncnncgntaaagtnttatcacccnatgnnnggatnncccnnatnngccannncctttncgcnattgngtttnttgnggggtnattcccaaaanaaaagggctcttttcnnntaangccggnccttccncctttttgccaaaccnttttccnaaanggantaacccttttgccatttgttngttgggggnncggaaattgccccttggaanagncccttttttttgggggtngttttccnggggttttggccantaaannngngtaattcaaaaaaaanccaacccgccanctctnggtttagtattccccannaaccct

SEQ ID NO: 103045 - DNA, 685 bp, Triticum aestivum
  unsure (1)..(685): unsure at all n locations
  Clone ID: PAT_TA_103045
aagnagnttttttccctgctcgnnnnaccctancttaanngaacngaacctgganntncacngcngcggngggcgntctagnantannnnatcccntcgcnctgcacnaattnanttcgagagagagaganananatagagacagagacactagncagacgcctcacaagctcgncgccgacgcagcgagctctncctncaccgccgcaaccatggcgacccagatcagcaagaagaagaagtttgtgagcgatggcgttttctacgcccgagctgaacgagatgctgacccgggagcttgccgaggacggctacttcggcgtggaagtgcgcgtgacgcccatgcgcacggagatcatnatcagggccacgcggacgcagaacgtgcttggtgagaagggccgcangatcaaggagctcaccttcgtcgtcanaaacgcttnaactttccngagaacggcgttgagctttacgccgagaaagtcgtcaacccgtggcctntgcgccatcgccaagcccgagtcacttcgntcaaacttcttggangccttgccgtcccaaggcttgctntggggtcttccttttgttttggaaantggncttaagggtttgaaggcattttgagtgggnnaactttaagggcccncanangcccanttntttaaaattaaangcggngttnttt

SEQ ID NO: 103046 - DNA, 848 bp, Triticum aestivum
  unsure (1)..(848): unsure at all n locations
  Clone ID: PAT_TA_103046
aagnnannttttttnccttgctcgaaattaaccctactaaagggaacaaaagctggagctccaccgcggtggcggccgctctagaactagtggatcccccgggctgcaggaattcggcacgagagagagagagagagagagagagagagagagagagagagaganagagagagagaganananagagagannntncctttnnncnncgcaaccattggtnncccnnattcannaannaannanttantttnntgnaccgatggcctttttttncnccnacnctnnncnanatgctnanccncngnncnttnncnnnnncnngnttcnttcnnnnntnnncagttcccnntnannccttttccncacnnnnttatcattnntnnnnnnccctnttccnanccnatgnaatgtttntttnttgnnnaannngccnnnatgattcanntgnncttnttctttnnnntntntncnanaannnnnntttnaaacnnttncnnnnnnnaaanncggnnntttttggnntttttttncnccccccnnnaaannatnnttttttnnnnccnnngggnnnttttttnttgcccatttttnnntnnnnnnnnnnngnntnnnnntttcccnnttttcaaannttttcntttgnnaanggnccttttnccnnnttccccnaaangcttttnnntttttttgnnnttnnntttttncnttttntnnnnnttgggganananntgtngtnttttaangggttttntntttgnnntnttttttngnggtttgnggnnaattnttttntncccctnnaanatnnnnnntttttntttnaatntnnttnggggncgcnttnttt

SEQ ID NO: 103047 - DNA, 682 bp, Triticum aestivum
  unsure (1)..(682): unsure at all n locations
  Clone ID: PAT_TA_103047
gnnnggttttttncctcctngctcgaanttaaccctactaaagggaacaaaagctggagctccaccgcggtggcggccgctctagaactagtggatcccccgggctgcaggaattcggcaccagagagcgcatcatttaagccaagcaagctgtggtcaatacaaatccaccatgaagacatttctcatccttgccctccttgctatcgtggcgaccaccgccacaaatgcagttagagttccagtgccacaattgcagccacaaaatccatctcagcaacagccacaagagcaagttccattggtacaacaacaacaatttctagggcagcaacaaccatttccaccacaacaaccatatccacagccgaaccatttcaatnacaacaaccntntttgcagntgcaaccattttcgnagccgcaactaccntattggcagccacaaccatttngaccacaacaaccatntccacaaccggaaccacaggntttngaaaccacaacaaccattttacagcagcagcagcagcagcaacaacaacaacaacaacaacaacaacaacaacaagaacaacaaatccttcaacaaatttgnaacaacaactgattccatgcatnggtggtgnattgnaagcaacacaacattagcgcgnggaanatcacaagtttgcaacaaaagt

SEQ ID NO: 103048 - DNA, 669 bp, Triticum aestivum
  unsure (1)..(669): unsure at all n locations
  Clone ID: PAT_TA_103048
tgttacctnnctcgaaattaaccctactaaagggaacaaaagctggagctccaccgcggtggcggccgctctagaactagtggatcccccgggctgcaggaattcggcaccagcgccaagcggcaccggaaggtgctccgcgacaacatccagggcatcaccaagccggcgatccggaggctggccaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggttcctgggttccgttggtggcagcagcagtgtggttgcngcttgtgtctgncnttgggccctntggaatgtgngctggggganatgggatttactgnttgctttggcgtgcgtcgntgtgttccgtgtcttgngttcaataagctgtaatatcttggtgcggcnatgaaactaagtctggtntgaattcaaaaaaaaaaaaaaaaaaattganggggggcccggccccaattggcctatagtgagtcgtattacaattactggccgcgttttacaacgtcgngactg

SEQ ID NO: 103049 - DNA, 671 bp, Triticum aestivum
  unsure (1)..(671): unsure at all n locations
  Clone ID: PAT_TA_103049
agnnnngnttttttncntcccttgctcgaccntaccntactnaanggaacaaaanctngagctncaccggggnggnggcngctntnnaactantggatccccngggctgcnggaatccgnaccagcttgtttattctgggttaccatttaacntgagtgcctaggagacaaactaaagttttcatttgttnttcccattaggatatcctatttcngggacatattcttggcaacactctgncctgnaaaagatatnnttngntctnaantggttncctttgtnttnatgnnactaataanggngaggagggcacatnttacatattcccacntgnccagacnnntggnaacatgggtngctcgcaggaattcanattttcattcgccttaactgccgcacaagtgaatgctttgggcttactacctgtctatgccaaggagcttattgctggtggtgcacttgtncattgccaaagacnggtcctcgccactntatangggaaanaanntntgcgcantacaactcaagggttaaatcctngnaatgtccaatcntgaggaagctganccatacgaaggagtctaagcttntacaanngaaatggtgngagtgngctnnanactggtncatatgcatnactgctntacatgacntatganctgcttgngtg

SEQ ID NO: 103050 - DNA, 682 bp, Triticum aestivum
  unsure (1)..(682): unsure at all n locations
  Clone ID: PAT_TA_103050
agnnnaggtttttcntccttgaaattaccctactaaagggaacaaaagctggagctccaccgcggtggcggncgctctagaactagtggatcccccgggctgcaggaattcggcaccagatctccatctccatctncaaaccgcagcaacccacctccctccccgncgaccccgcagcagctccgatggcccgcaccaagcagactgcccgcaagtncaccggcggnaaggcgccgnggaagcagctcgncaccaaggcggcgcgcaagtcggccccggccaccggcggcgtcaagaagccccaccgtttccgnccnngcaccgtcgcgcttcgtgagatccgcaagtaccatgaagagcacggagctgctcatccgnaagctccccttccagngcctcgtncgggagatcgcccaggactttaagaccgacctccgcttacagtacttncgncgncttcgcgctcnaggangccgccgaggcgtacctcgtcgggctcttcgaggacaccaacctgtgcgccatccacgccaagcgcgtaccatnatgcccaaggacattcagctcgccgccgcatccgcggngagcgcgcctaggctntgtatgcgccctntgtcagntgcgcctgaatnctgctagatgtttatgactcctgtanttggtgtttgccctgttgtatgtt

SEQ ID NO: 103051 - DNA, 786 bp, Triticum aestivum
  unsure (1)..(786): unsure at all n locations
  Clone ID: PAT_TA_103051
cnccnagctcgaaattaaccctcactaaagggaacaaaagctggagctccaccgcggtggcggccgctctagaactagtggatcccccgggctgcaggaattcggcacgagcaccatcctcggcttcaagaggtcgaagtcgaaccagtacgagagcacgtcgctggtgcaggtcgagggggtgaacaccaaggaggacgtggcgtggtacgccgggaagcgcctggcgtacgtgtacaaggccaagaccaagagcaacggcacccactaccgctgcctctggggcaagatcacccgcccgcacggcaactccggcgtcgtccgcgcccagttcaagtccaacctccccgccgagtccatggggcgcaaggtcagggtgttcatgtacccgagcagcatctaagggtttttcgatctaaggacagtaatgcttggttcttgngattgncatgagctttttatggngaatctatctatgttggcaacccgaaactgatcattgtatttttgagaaccttgtgggaagnttttggcttagacnttgttttgntcnaaatgtgccnggacccatttttaaggaataattttcttatttnttcaaaccncctttnaaaagcggttnnnnnnnnnnnnnannnnnnnnnnnnnnnnnnnnccctttcgnaaaaaanaaaatttgggncccngggcccccccnaaaaaaacccccnaaaaaccccctttaaancccttttccgggnccccccccccccttttggggnaaaattncccggcnantttnggntt

SEQ ID NO: 103052 - DNA, 630 bp, Triticum aestivum
  unsure (1)..(630): unsure at all n locations
  Clone ID: PAT_TA_103052
nnttttttacctcctngaaattaaccctactaaagggaacaaaagctggagctccaccgcggtggcggccgctctagaactagtggatcccccgggctgcaggaattcggcaccagggnatgcntcatncnctgncnngtngcccatcgccnacgatgntaccannnncnttntnaancccntcgncnttgngaacanctatgnctacncgntnncatactggnntgccacacnngntatcancctngnncnngnctccanatgttgagcatattnagggngcatntccnnnngaccnctatnctngaanactttgccttctattaganccccnntangntgccgcannncaanncantanaacntcnnncnatncnatntcnggnnnggnacnncagggctccgaaccctgntgctggagnnaancaacatgaagttcncnnggtaagctaaaggtntgtgtaccanaccatgttcattnngagaaacagcaggatgctgtcantgtaagcaaantcgctgtagcgannggngttacgnttatgcaantttgnagtnaatcgtccccgtgtctcatntgctctngnnagtgtcaaatattncaaaagtggtncacaatctttgcacctc

SEQ ID NO: 103053 - DNA, 681 bp, Triticum aestivum
  unsure (1)..(681): unsure at all n locations
  Clone ID: PAT_TA_103053
ntntgttaccttcctcgaaattaaccctactaaagggaacaaaagctggagctccaccgcggtggcggccgctctagaactagtggatcccccgggctgcaggaattcggcaccagctagggcaaagaagactgagggcgagctatttgagtcggagaaggaggcaaccaagaatttgcccgacttcaagaaggatgatcagaaggccattgatgccgagttgatgaaggctatcgatgctgtcccagaccttaaaaattatcttggtgcccggttctccctcagggatggtgacaagccgcatgagatgaccttctaagttacctggtacaagtttcaagatctgtggaagtcttttttgtctagtgtgtgtgctggttctgtacttctgatttcttttgcccggttggtgaatctttgatttccactgaagtctgcctgtcaaatattttgagaagattactagaagtaccatccctttattgnccgttgcgacattttcttgatccgcattgtattattcaagctgcaattcttgagtaaatgttttatcttctgatcaaaaaaaaaaaaaaaaaaaaaactcgagggggggcccggtacccaattcgccctatagtgagtcgtatacaattcactggcccgcgttttacaacgtcgtgactgggaaaaccctggcgt

SEQ ID NO: 103054 - DNA, 685 bp, Triticum aestivum
  unsure (1)..(685): unsure at all n locations
  Clone ID: PAT_TA_103054
tgttncttcctagctcgaaattaaccctactaaagggaacaaaagctggagctccaccgcggtggcggccgctctagaactagtggatcccccgggctgcaggaattcggcaccagcnctnctctnnntnatagntgattgcagcccntgnttgnanaagntnnaanccttctgacccgatggaggtccatntgctnatcaanacagatttttngngccctnaagangacgcgctgntnntgntcntnnttctncaacntngngcncgancnnngancgnnatnancnccagnntccccnggcgcacngncaactgtgcctgttgcngnngtncaaccatttnnacccngtcgttcagaaatcngcctttcatatganaggagagatgcgcttatnatngccagcgcaancncnctacnggancannngggccgacatagaccgantnctctctgatnntncnctnaanttngncaagaaccactngaactccaacctcntgangtgccatngccggccaaggccatggccnttgtcactggcgcangtgtttccactnctactcntgatctggatccctgcagaagcgaaaatatacancgannaacaattcatgntgatgaanaagtcgncntcagacaaatgggcctggtgcagtttctgctggtnttgaacaccctatgcc

SEQ ID NO: 103055 - DNA, 752 bp, Triticum aestivum
  unsure (1)..(752): unsure at all n locations
  Clone ID: PAT_TA_103055
gnnngntttttntttgctcgaatnaccctactaaagggaacaaaagctggagctccaccgcggtggcggccgctctagaactagtggatcccccgggctgcaggaattcggcacgaggccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccgggatcctnttcatgggcaacgccgggcccaacaccaacggnttccagttcttcatctgcaccgtcccctgcaattggctcgacggcaagcacgtggtcttcggcgangtcgtcganggcattgacgtcgtcaagaacattcgaagaaggtgggcttccgcaagcgggcacctgnttccaaagcaaggtcgtnattcggccgacttgggggcagntttntagattccgnccgnccggccggttcggccgtcgtn

SEQ ID NO: 103056 - DNA, 850 bp, Triticum aestivum
  unsure (1)..(850): unsure at all n locations
  Clone ID: PAT_TA_103056
gnnngcgttttntncntcgttngnncgaacnnacctaactnnagggaacannggntgnanctccaccggggnggcggtcnatatataactagtgnatccnccngnctgaatgaattccnnacgaggnaaaggcgttttcttnctnatcnctctangcgcaacctagccttccgctanctgctgcccatntcatcancggctcaccnannaacnacnnnnacccggagcnatgagggagtgcatcttcttcnacatcatgacagtgcngcatntaggtacggcaacnncgtgctgngagntctactgtcttgngcatgngattcngcctgnnggnnagatgcnnnnngncannacnntgggggnangagntgatgcttncannannttcttcngnganactgngnctgggnagcanaccccngggnctgacttcatagatcncgaccccnctntganngatnanncaangactggagntcacnagcccgcnnnatccccctaagnntcttcatnnggaggtanggtttgatgtttgtnaaanaangttcctaccgggaggggngggtntcaccctttttgccaatngganaacttgacttttntgtggcgtaaccctgttncccttnaatgganagnaaaattttttttnaaaaacnaaaangggcaaggttgggttcaaaanaaaaggggnttggcntttggcccttttaaaaccccnttgggnggggatngggnnggcaatnttgggttaattgggaccnccggttnnggggcccccnggggggngggggactttttaaagggttgggcttttgggtttggnaaantcccaaagctttggggtnnttcc

SEQ ID NO: 103057 - DNA, 775 bp, Triticum aestivum
  unsure (1)..(775): unsure at all n locations
  Clone ID: PAT_TA_103057
agnncgnttttntacctcnttgaacgaaccctcctaaagggaacaaacgctgganctncactcnannnggngggcggtctatanctannnnatncntccnnctgcntgaattaattaccancccaaacnccctctcgctctcgctcacgtgtggcctacctactccccacgcctncgttnccttccgtcgagcagatcacngacttaccccncntnccncngtgncgcantatgangtgangantattttaaatcacatacgcacacagccgggntngcacatcctgagcattgngcngntgaacnatactnagctttgcacgagcattgctaantgntnnccatgacanaactctcgactaatacnttctttagaggtgnttancncntatacancttattcaagggagaccgcgaatctgtgaggacantcccncntggtttctgaatgttgatccgaacaaggnacatctaatgtcatacgatntatctaacaccaggtttntacatgcccgaggcagcattattatgagggactagtaggacccnngncaacaantttggcgtgnngactacanaantggtaatgagattgtggatnttntgnacaagactgatctctangntgncnaanaactgnantggcctgcactnntttattggtntttnacgncagaagtgggggaacccgggctgggcttgcgaacgattcttcttgagcgcnttttcgtntgactattggaangaatttnaatcttaggntnttacgtgttcc

SEQ ID NO: 103058 - DNA, 742 bp, Triticum aestivum
  unsure (1)..(742): unsure at all n locations
  Clone ID: PAT_TA_103058
gnncgngttnttgcaccctagctcgaaattaaccctactaaagggaacaaaagctggagctccaccgcggtggcggcccgctctagaactagtggatcccccgggctgcaggaattcggcacgagcctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgncaagcttgaaggggatgacctanatgctttcaaaaagaatgttgagtncnccacaaaatatnttnttagcaagcttaaaggcccttanttntttntttggcaaaaacnntccntaaaantgggcgggntgggtnttcccctcctacanggngggagntngggggacccaactttcctgactttgcacatgggctgaaaagaggtnaagtgcttaatcgcactgnatgctaaaaactatctggcttaanatt

SEQ ID NO: 103059 - DNA, 729 bp, Triticum aestivum
  unsure (1)..(729): unsure at all n locations
  Clone ID: PAT_TA_103059
ngnncgttttttcctcgtcgaanttaccctactaaagggaacaaaagctggagctccaccgcggtggcggccgctctagaactagtggatcccccgggctgcaggaattcggcaccagaanccnctntccctattctcgngnccagangctncccnccncctcnnatggcgggnanagaacntantnccgtgctngtnacngnnnccntnggncnaatctgatatgctcttntncccntgaatnnnnngggaggtnttntngncncttaccatnctgtncttntngannntcnnnnnattnnntnnnntnntncngctcttaaacgngnccnnatgnatttcatcgatgcccntattngcacntcttaagggagngtgcctgcacaacatnatgttttgngctgcctgcactgntnncaatgtntgntgatctgggnggagnntcccccnagaagggccgtangncatngtnngatgtcatgactanaaangnttgaanataccaaacnnatgcntctggtntanaanaanatncaaanctcnannggggggcnntggnnnnnttccacctatnangnnccaatnttctttccttgangnggttnnttcatctttcctctggaaaaaatctgtgtttgcccctntttaccctcaaggcaatcccntttnttttttgggaatttgntcaaagtttttaccggaanaattttttattttngggganncctn

SEQ ID NO: 103060 - DNA, 1077 bp, Triticum aestivum
  unsure (1)..(1077): unsure at all n locations
  Clone ID: PAT_TA_103060
ggnnnnnnnnngggnggnttttttgttatttggaaccctncttcccnttttgggccctncggaaaaacattttnaaaaccccccttccaactttaaaaaaagggggggggaaaaaccaaaaaaaaaggccttngggggaaggcccttccccaccccggcggggggtggggggccgggggccccggcctttcnttaggggaaaaccttaaggtggggggaatttccccccccccggggggcctnggccaaggggaaaaattttccggggcaaaccggaaggccggccccggcnccggcnccccccggcaaccccggcnggccttttttaaaaaccccccctttcncccnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnannnnnnnnnnnnnnnnnnnannanntnnnnnnnnnnnnanannngnnnnnnnnnnnnnnnnnnnncnnnnnnngnnnnnnnnnnnnnnnnnnnnnnnnnnnnnnnnnnanngnnnnnnannnnnnnnnnnngnnnnnnnnnnnnnnanannnnncnnnnnnnnnnnnnnnnnannnnnnnnnnnnnnnnnnnnnnnnnnnnnnnnnnnnnnnnnnnnnnnnnnnnntnnnnnnnnnnnnnnnnnnnnnnnnnnnnnnnnnncnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 103061 - DNA, 699 bp, Triticum aestivum
  unsure (1)..(699): unsure at all n locations
  Clone ID: PAT_TA_103061
gnnngcgttntttgntccctngctcgaanttaaccctactaaagggaacaaaagctggagctccaccgcggtggcggccgctctagaactagtggatcccccgggctgcaggaattcggcaccagggcnggaggnccaactcttnatcccttccgaacagntatggtggcngtggacaccttggtggtgnctctaggcatacaganggtcgtagntctggttactggactaccttnttctgcatcatggcggngatctannggntcatntgnnanaggctngtgatgtttgttnctntgnngtgtatcnngagggnggtggtacnnttggaatngccgantatacntactntgntgacctnaantangctntnangaagcttgntgatactgnatctannaatgcattctctacagcncntatcncggngaccgagtatgctgnctaaagcgngacganctattcatncanccgnactanacnccnncnngncnnttnanccaggagtccgagtcaaagaanaattnatcaagccgnanaagattgatntaggccgagatnnnntatttcattcnngacncgaccatggcgntttcattatatcacacanatgccncannctgaantgctnngcncatgatnncnngacttgcgcatagnnccaananatncnnantcntgctntgtgcgatnngtacg

SEQ ID NO: 103062 - DNA, 756 bp, Triticum aestivum
  unsure (1)..(756): unsure at all n locations
  Clone ID: PAT_TA_103062
nnnnnnnnngnnngngtttnttnnatcntngctcgaantnaaccctactaaagggaacaaaagctggagctccaccgcggtggcggccgctctagaactagtggatcccccgggctgcaggaattcggcacgagagcaacactagttaacactagtccaccatgaagaccttcctcatctttgccctcctcgccgttgcggcgacaagtgccattgcacaaatggagaatagccacatccctggtttggagagaccatcgccaacaaccattctgccagcaaccacaacaaactattccccaaccccatcaaacgttccaccatcaaccacagcaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgatttcagctatctctacaacaacagatgaacccctgcaagaattttctttgcagcaatgcaaccctgtgtcattggtgtcatccctcatatcaatgatcttgccacgaagtgattggcaggtgatgcagcaacaatgttgncacaactggcacagattc

SEQ ID NO: 103063 - DNA, 756 bp, Triticum aestivum
  unsure (1)..(756): unsure at all n locations
  Clone ID: PAT_TA_103063
gnnnnnnnagnnngntntttgnttgttgctcgaaattaaccctactaaagggaacaaaagctggagctccaccgcggtggcggccgctctagaactagtggatcccccgggctgcaggaattcggcaccagtagagcacaagcatcaaatccaagtaggtagtagttaacgcaaatccaccatgaagaccttactcatcctgacaatccttgcgatggcaataaccatcgccaccgccaatatgcaggtcgaccctagcggccaagtacaatggccgcaacaacaaccattcctgnagcctnaccaaccattcttccagcaaccacaacaaatattttcccaaccccaacaaacattcccccatcaaccacaacaacaatttccccagccttagcaaccacaacaacaatttcttcagccccgacaaccattccccaacaaccacaacaaccatattcccagcaaccacaggaaccggtccccagactnaacaaccccaacaaccatttcccagtncaaggcaaccacaacaacctttttcccaggcccaacaaccgnaacaatnatttccccacaacaaccatcggtgattcaacaatctntacaacaacaggtggacccatgcaagaattttctnttgcagcaatgcaaacctgngtccttggngntattccctntggncaatcatcttgccaccaagcgattggcangtgatgcggcaacaatgttgtcaacaactagcacaaattcttaagg

SEQ ID NO: 103064 - DNA, 745 bp, Triticum aestivum
  unsure (1)..(745): unsure at all n locations
  Clone ID: PAT_TA_103064
ngtgttnntttnancccttttnatctcctcnctcctaaagggaacaaaagctggagctccaccgcggtggcggccgctctagaactagtggatcccccgggctgcaggaattcggcaccaggaaatntgntnnnnnntccncaatnccttcngcnatggggatctgtnaagcctngatctnaatgctgctcacncttgccnncttnctgnccgnnccancnnccnaancttatgangccctcgctgcccgaggaanctgnatgactggaggccgngctnancctgnacgccancnncttctacaanaccatggcangnaccccttgattctcgtgagtttacaccccatggtgtgcacactgngagancctggcacctaagnatnagaaggctgnccanctgttgacaagcncnacccacccattgtccttgctnatggtgatnccaaccatganaagaacaagccgcttnncngcnacatcnangnccagngnttnnctacccttnagatctttntgtangngggaaagaacattcccgaatacaaggccccaaggaggctnatggaatagtcgannctngaanaagcaggctggccctgcttccaanganatcaaggccctgtacatgcnacttccttgaagacggcaganccacattgctggtggttgacttgatttagaggggctgngataccaaacttcttgagcttgntataactgagggcttattatgctttggccna

SEQ ID NO: 103065 - DNA, 770 bp, Triticum aestivum
  unsure (1)..(770): unsure at all n locations
  Clone ID: PAT_TA_103065
ggnnnnnttnanncccttttnattctnntagctcgaaattaaccctcactaaagggaacaaaagctggagctccaccgcggtggcggccgctctagaactagtggatcccccgggctgcaggaattcggcaccagaagccgtgtgtggcattcctgcaacaaaagtgtagcccactgagaatgccattcctccagacacaagtcgagcaacttagcagctgccagatcgtgcaataccaatgctgccagcagttggcgcagatcccagagcgaacccggtgccatgccatccacatcgtggtagaggctatcattcaacaacaatcccaacaacaatggcaggagccccaacagcaagcacaacataagagcatgaggatgttggtttgagaacctatcattgatgtgcaacatctacgtcccggtacaatgccagcagcaacaacaactggggcaacaacaacaacaacagttgcaggagcagttgacaccgtgcacgacattctgcaacagcagtgtagcccagtgacagtgccattcccccagataccggtggatcaagcctaccagctgccaaaatgtgcagcaccaatgttgccgacagctatnacagatnccagagcaattncgntggcaagccattcacaacgtggnggaggntntnangcaacaacaaccccaacaacaatggcagggtatgtaccagcccagcaggcagcacaacttgagagcattaggatgtcgcttnaggcctgcggtcgatgtgtagn

SEQ ID NO: 103066 - DNA, 846 bp, Triticum aestivum
  unsure (1)..(846): unsure at all n locations
  Clone ID: PAT_TA_103066
gtgntnnntttnntcnctttntcgaacnnnccctcactaaagggaacaaaagctggagctccaccgcggtggcggccgctctagaactagtggatcccccgggctgcaggaattcggcaccaggcggcggcgcgcgcataggaggcgaatcaagcagcggaaccaagccgtcgacnccaccatgggtatcttgcgtgactncatgcacaagcgccgggccaccggtgggaagcaaaaggctttggaggaagaaaccaaagtatgagctcggcccgtcagccaaccaacactaagctttcaagcaacaagacantgaggagggtccgtgttcgcggaggtaacgtgaagtggagggctctccgtcttgacactggtaacttctcatggggtagtgaggctgtgacccgcaagaccccgcttctggatgtggtttacaattcgtcaaacaatgagcttgtgaggactcaagacccttgtcaagaatgccattgtgcaagttgatgctgcccccttcaagcagnggtacctgactcattatggantcgaaatcngtangaagaataaagcttgctgcagctgccaaagaaggaacctgcttatggggcaagaagcttaagttgcttgntgcttgccccaagaaggaaagccaaaagaaagaagcctaccaattgtnccaaaaggaaagcctttgaaaaaaccnccccaccanggggaccntacaacttgggaaatttggcacaantttgaaggnanccaanttttcaanttgggtggggaaaanggcctttttttnggnccctcgccaattttttcggnnttttgggccccttggggaacaaagnggtn

SEQ ID NO: 103067 - DNA, 849 bp, Triticum aestivum
  unsure (1)..(849): unsure at all n locations
  Clone ID: PAT_TA_103067
nnntntnnnnnnattctcttttcgaacnnaccctactaaagggaacaaaagctggagctccaccgcggtggcggccgctctagaactagtggatcccccgggctgcaggaattcggcaccagccccgctccacttcaaaacacccgagcagcctctccgatctcccatcccagcgcccccagcaccccccgcgatggcccgcacgaagcagacggcgcgcaagtccaccggcggcaaggccccgcggaagcagctggcgaccaaggcggcgcgcaagtcggccccggcgaccggcggcgtgaagaagccgcaccgcttccgcccgggcaccgtggcgctgcgcgagatccgcaagtaccagaagagcacggagctgctcatccgcaagctgccttccagcgcctggtccgcgagatcgcgcaggacttcaagaccgacctccgcttcagagcttcgccgtcttcgccttgcaggaaggccgccgaggcctacctcgtnggcctctttgaggacaccaacctntgggccattcacgccaaagcgcgtcaccatnattgcccaaaggacattncaagctttggcccggccggaattccgcngggggaagcggcgccctaaggcggccnttnggtttgggccggaaactgggttanggtggtttttaaagggcttncccttgttttccccggtcggnggnttcccattgttgtgccggttngntttncttattgtnaaacttgggctttgggttggcttggggcctttcgatgggacctaccnttattnttggatggnaaatattnggnttnccnnggattggggtttnnnnnnnnnnnnnnnnnnnnnnnn

SEQ ID NO: 103068 - DNA, 773 bp, Triticum aestivum
  unsure (1)..(773): unsure at all n locations
  Clone ID: PAT_TA_103068
gnnggnnnnttnannccttttantctcttgctcgaanttaaccctcactaaagggaacaaaagctggagctccaccgcggtggcggccgctctagaactagtggatcccccgggctgcaggaattcggcaccagccccaacaaccattcccccagcctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagcgtcgcgcattccatcatcatgcaacaagaacaacaacaaggcgtgacgatcctgcggccactatttcagctcgccagggtctgggtatcatccaacctcaacaaccagctcaattggaggggatcaggtcattggtattgaaaactcttccaaccatgtgcaacggngttgtgccacctaactgcttcaccatcaacgtaccatatgccaacatagacgcttggcattgggnggncaatggaaaaatgcaagatcatcgttgcttagctgatgcnccatcgtgnaggcgatgacaaaata

SEQ ID NO: 103069 - DNA, 716 bp, Triticum aestivum
  unsure (1)..(716): unsure at all n locations
  Clone ID: PAT_TA_103069
gnggntntttatcnntttcgcnnnccctactaagggacaaagctggagctcnccgcggtggcggccgtctnaactagtggatcccccggctgcaggaattcggcaccagcgacaaggccccaacaagacggnctgcccgccgcagcgacgcctggatgcgccgcgagctcggcgaggaggagctcaagaccgcgctgggccgacgcaactgctttctcaactactgcccgcggtggaggtcccaaggattcccgggaggcggccgncttntnattgtatcaggttganctacagccctcaccnnttattgttattctcttgtcagacatnattgtctctgtatccatctactcataacctggcatttttctttcttnttcggacatcattttgcaccttacttgttagaagaaatgtgaagaaagtgagaggagaanggtggtgtgcgtgccaatagcaatcttttggtgatctggtgacatttttgncttaagngtcactcacatcacatgcattgttctcttccagaaaagaaaaaaaaaaagctttgtattgggtgccgtttcttgacttttttggttngnaagnaaagaataaccaatngggnttntttgccaaggcnaannnnnnnnnnnnnnnnnnnnnnnnnnnnnnnnnnnncccttcggggaactagggttcttncctanancctccaaangggggggggncccccc

SEQ ID NO: 103070 - DNA, 1259 bp, Triticum aestivum
  unsure (1)..(1259): unsure at all n locations
  Clone ID: PAT_TA_103070
gnnnnnngngggnnnttnnnnnnttattttgaaaantactttccctttnttnctaacggaaaacccctattaccccctttcaactttanaaaggggggaaaaccaaaaaaaggctttggggnaggccttccccaccccggccggggttgggggccggggccccggcnttcnttaagnaaaaccttaaggtggggggattccccccccccggggggcctttggcaangggaaaatttttcggggccaccggaaagggaaaaggaaaanggggggccaaggccaaaagggggcccaaaanaaanggggccggttggggaggaacgttaccaaagaatcttaacaatctttcaaagggtggcttgaaagcaagggtgcacccccgacattcgggcattctttctttcaaagggccatggtncatcatgaactccttcatcaacgacatcttcgagaaagctcgccggcgagtcggccaagctcgcgaggtacaacaagaagcccaccatcaccttccgggagatccagacctccgtccgctcgtncttcccggcgagcttggccaagcacgccgtcttcgagggcaccaaaggccgtcaccaagttcacctnctcctagacaagttgatgcgacagatgtaagttggcttgctggtgtctnctgttaagtggggnccgcttgactcttgcttatgtatcttgcaaagtaagtggggtaagggaagttggggtccggtcttgttgccgcccaaaccgccttttnggtttgggcnttagttttggggtttggtggaagnaaaccttggaaaaggtttggcnttnaaatcnttaaaannnnnnnnnnnnnnnnnnnnnnnnnnnnnnaaaaaaaccttttggggggttttnaacnccaatttttccctttaanggggaatttttnttttttggaaancctttttggcntttggaaaaaaaaaaaacctttgttgggccantttggcccccccnttttttggntttttgncccccgngggaaaaaaaaaaaccntttnttttttnttnngggggggaaanagggggttnnaaaattttttttttttcccccccggggggggggccaccnaaaaaanccntttgggntttttcnccccccaacnaaanggggaaagccnttttttttttttttttttaaaggaaaagggnnnttttgatttttttccccctttggaaaaaancccccctttttntttttttttngggggncccancccccttggaan

SEQ ID NO: 103071 - DNA, 764 bp, Triticum aestivum
  unsure (1)..(764): unsure at all n locations
  Clone ID: PAT_TA_103071
gnnggnnnnntttgannccttttgatcccnagctcgaaattaaccctcactaaagggaacaaaagctggagctccaccgcggtggcggccgctctagaactagtggatcccccgggctgcaggaattcggcaccagatcatttaagccaagcaagcagtgctcaatacaaatccaccatgaagacctttctcatccttgccctccttgctattgnggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatnatatccgcagccgcaaccatttcgaccacaacaaccatatncacagccgcaaccacagtattcgcaaccacaacaaccaatttcgcagcagcagcagcagcagcagcaacaacaacaacaacaacaacaaatnctacaacaaattttgcaacaacaactgatttcatgcagggatggtgnattggaacaacacaacatagcgcatggaagttcacaagtttgnaagaagnacttaccantggtgcacaattgngtggtagcagttggggagatccccagcagtcgggggccaagccattcccaangtggtcatgctattatttggat

SEQ ID NO: 103072 - DNA, 741 bp, Triticum aestivum
  unsure (1)..(741): unsure at all n locations
  Clone ID: PAT_TA_103072
gagngntnnnnntnntttcctnnttngaaccnnccctactaaagggaacaaaagctggagctccacccgcggtggcggccgctctagaactagtggatcccccgggctgcaggaattcggcacgagccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgccccttcaagcagtggtacctgactcattatggagtcgaaatcggtaggaagaagaaagctgctgcagctgccaagaaggaacctgctgaggggcaagaggctgaggttgctgctgctgccncagaggaagcaaagaagaacaacaatgtccanaggaagcttgagaagcgccacagggacgtacactggactcgcacattgaggagcaagttcaatggtggaaggctgctggcctgcatttcgtctngccctggacagtgtggcagagctgatgggtacattcttgaaggcaangagctggaggtctactttaggaactcacaaaaanaaggcaaggngccncacttaagcttaaaactntcatgttctctgattttttaatgttcgncattatgtttgaactctgacaccttttttttaacggtcgnnctt

SEQ ID NO: 103073 - DNA, 760 bp, Triticum aestivum
  unsure (1)..(760): unsure at all n locations
  Clone ID: PAT_TA_103073
gnagnntanaagggaaattaagnaagattcttcccnanccaagggaacaaaagctggagcttcaccgcggtggcgggcgntctagaactagtggatnccccgggctgnaggaattcggcacgagggtttgcaagaaagnacttaccanctggngcaacaattgngntgncagcagctgnggnagatcccgagcagtcgcggngncaagccattcacaatggtggtcatgctattattctgnattaacaacaccaccaccacccacaacaacaacaaccacaaccacaaccaccggtgagccaagncttctttcaacagcctcagcaacaatattcatcaagccagggcttttttcaaccatctcagcaaaacccacaggcccagggctcttttcagcctcaacaactggcccagtttgaggcaataaggaacctagcgctacagacgctactgcaatgngcaatgngnatatccttcatattgnaccattgctccatttggcatcttcggtctaactgagaagagaagaactctagtagtagatatatgatacaccggtttcttagtccatgggttggncggtggagcggngaaaaaataaagtgacatgcactattatgtaagaacctgactatctagnttaaacttgggaataaaaaaaaaacacaaggcttggttaaaaaaaaaaaaaaaaaaaaaaaaaaaaactcganggggggccgggcccaaattnccctttagggaggggattaaaattann

SEQ ID NO: 103074 - DNA, 832 bp, Triticum aestivum
  unsure (1)..(832): unsure at all n locations
  Clone ID: PAT_TA_103074
gaggntnnnnangaactctaaggnanattttttnttgaccaaccctactaaagggaacanaagctggagctccaccgcggtggcggccgctctanaactagtggatcccccgggctgcaggaattcggcacgagcagcaatcctctcttcgcgcccacgaagcaagctccacactnccgatggcccgcacgaagcagacggcgaggaagtccaccggcggcaaggcgccgcgcaagcagctggcgaccaaggcggngcgcaagtccgccccggccaccggcggngtgaagaagccccaccgctttcgccccggcaccgtcgcgctccgggagatccgcaagtaccagaagagcaccgagctgctcatncgcaagctncccttcagcgcctggtgcgggagatcgcgcaggactttaagancgaccttcgctttcaaaagttccgccgncttcgcgcttcaagaaggccggcgagggctacctngtcgggctctttgangaaacaaccttttgggcatcacgccaagcgcgtgaccatnatgccaaggacattcaagttggccgncgcattcntngcgaaaagggnctaagctgntttctanaatnctaanggctggatcttgggcctcnangngtaaaanatgccgttacttaagntttntttattaaancccctttgtcttggggggaaggaaaagggttncctttgaacaaggttggggggttattnggggggggaagggaacccgggnttgnggnanggggancccattntttggttttttntttcnaaaaannnnnnnnnnnnnnnnnnnnaaaacttggnggggggg

SEQ ID NO: 103075 - DNA, 747 bp, Triticum aestivum
  unsure (1)..(747): unsure at all n locations
  Clone ID: PAT_TA_103075
ngnggnnnnntnanctcntttttaccctccctactaaagggaacaaaagctggagctccaccgcggtggcggccgctctagaactagtggatcccccgggctgnangaattcggnaccaagttnggtgntttcactcggtctctggttctccatatnttcctnttanacgngccacctanctttccgcttcgnnaagggggcaagaagttgttgttgtttgngggaaaggtgtcccnccgnngnccggggaagatcnggcgncttttgccgcttctcgtcggaagctgacctgcgtggccgcggcgggacttgcccgtgcagcggccggctgaatggcggatatatcgatccaccacacgtagaaccacacccacctggcgcncnattgagagaacncggagacggcaatggattcaaagaatctgaagcgcacggccaagccnnagggcanaagnaccgncatgacggtacggaaggcgggatctgttaaaagtttgagtccaaagacctggnagcagcattctttttaacattggctcgggtcantaatcaaaagatnggattgangggagtcattggcattcccanttggggtggaaatcggccccgtnttttacgttgcccccccaaaanttaacncctttattggggttnccgggggggnttttttccaaacccctgggggggaaatttaaaanccnaaaacttcccggggccttggtttnttttttnaagnaaaaaacnan

SEQ ID NO: 103076 - DNA, 769 bp, Triticum aestivum
  unsure (1)..(769): unsure at all n locations
  Clone ID: PAT_TA_103076
gnnggnnnnnttgannccttatnattctcctagctcgaaattaaccctcactaaagggaacaaaagctggagctccaccgcggtggcggccgctctagaactagtggatcccccgggctgcaggaattccncgcnaggnnatttnntttttntgnnnngaatatntnccgnggcgntnnnncccngnnnaggtgncggnaaaagngactcngnnngcggctgtnganganactnntntgcccncaatgcnggattacgctgccactgcttcgcttttncngnattgctgnnctcttacaatacataagcgaaaggcgtaaatgggnaaccncgcnttggnnnnccnctctaacatgtgcncnaantatngcntnacnngctnatngatggtccttaaactaaagccattgtncttctaannnanataactntnatnccngtncttgcagttatncgacaccttgtatcaagctgatgaaataccaatggtttaccgntatcgacgcgcctatcttgttgcaaatacaactgcattaatgcctgagcatatncgtgcacatcaatgctggatggnanggtcnatnatnaanggcattgtcgaacgncaactgataatngacctactntttcacttaaanggtntttttcgaaaaaaaacnttcccaaaataatggnttggcttgtccggttncctcaggccggncctttattggggattatctctcgggttacnccccgaaanngcccccttcccgggganggaatcntn

SEQ ID NO: 103077 - DNA, 748 bp, Triticum aestivum
  unsure (1)..(748): unsure at all n locations
  Clone ID: PAT_TA_103077
nnntannnnnatattttaagtnactcttcccnacaaagggaacaaaagctggagctccaccgcggnggcggccgctctagaactagtggatcccccgggctgnaggaattngggaccagcccaacccaaaccctacccgncggcggcgtngcgacgcaacgcgcggaggcgancttccaccgncgncaagatcagatctttgtgaagaccctgcgggcaagancatnacgctggaggtggagtctttgacaccatcgacaacgtcaaggncaagatcaggacaaaggagggcattccgccggaccagcagcgcctcatcttcgccggtaagcagctcgaggacggncgcacccttgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgcccgaacgccgactgcggcgccggcaccttnatggccaaccacttcgaccggcactatgnggnaagtgcgggctacctacgtctacaccagaangctttaaggtggnttgggttgctctgtcttttacctactacctatcgagagtcgactattttaattgtcccgtttgcggttaacctgatccttggttttatg

SEQ ID NO: 103078 - DNA, 754 bp, Triticum aestivum
  unsure (1)..(754): unsure at all n locations
  Clone ID: PAT_TA_103078
gntnntannnnntactctttttnaccaaccctactaaagggaacaaaagctggagctccaccgcggtggcggccgctctagaactagtggatcccccgggctgcaggaattcggcaccagtcgccaccnggntcaacntggtccnatnntnccccatcatgganaacgcctgcggcntcgccgagatgncccagntgccgnacgagnncntccngcgcnngnacgcactgtacancaangataacaccaccgtcnanntcaacnnagggttcgnganctacncgaccgagntagggaagctnctgctgctcaatgcctacaagagccccgcccagatnctgatccataacgagntangncntaaggagtncttggcgntcactgnattggccnntntcaactacttgagtgctaagattatcttncgtgcccgacagtactgctattcatgaaaatagggnagntacagngcagngcttatcacnaactgnttccctncnagtgggaggtgaatttcttgcactgcactaccatgaacgcnntatctacataccccanccnanctgggnngaatgacccaaaagnctttacttttactggnctgactgntaggagttaccggtctatnatcctgnaacttgnggacttgattttcnaagacttttanaaaaactnaatnaactccttaagccaatgnactggttnatgcttgncccataatntaatgtgngnnccaactttgaacaagggaana

SEQ ID NO: 103079 - DNA, 1253 bp, Triticum aestivum
  unsure (1)..(1253): unsure at all n locations
  Clone ID: PAT_TA_103079
ggngntnntttgttctctttttttnttctccctcactcaagggaacaaaagctggagcttcccgcggtggcggncgctctagaactatggatnccccgggctngaggaattngggaccagcgaaaacaccacccgcacattttcccgggcaagtagcaagcaagcgggcattncattggnccccaaagggcgggagaaagaaacccggtggggcgggaggaaaagcccgaagaaagacccaccgggcgggccgaaagaaaagaacccaaagggcccgaggaaagccgaacccggcccgggccggttncaaaagggaaggggccggggcggaaggaaagaaaagggggggaaaggaaaggaaaagtttcccaaaaggaaaagaaagcccggttggggaaggaaccggttacccaaaagaaattcnttaaccanttcntttttcaaaaggggttggcctttggaaaaagnccaaggggttggccaaccccccgggggaaccaantttcngggggcnanttctttttccntttncccaaaaggggggcccccaattggtttcccccantttcnantttggnaaaaacctttccccttttttcnantttcnaaaaaccgggaaaccaattttctttttttccggaaaggaaaaagggccttttcnggcccccgggggcccggaaaaggtttnccccggcccccaaaagggccttttnggccccccggcntttttccaaaanccaaaagggaaaaaggcccccccaaccccanttttcaaccgggttttnccaagggggggaaggnaattnccccaaaaaaaaccggtttncccggtttncccgggcccttttnggtttcccctttnccccccngggccggnaaggcctttcgggcccnaaaggccacccggccccggtctttttcccgnaangggggccacccccaaaaanggggcccccgttcaanccccnaaagntttcnaanccttttcctttncctttaaaatttnggggccttgggttnccccttggttcattttgggtnggggctttggaatcccnatttgcctttgcntttnttgttaagntttaaggtttaagccttgtttccgttacttnttgtcanttttttgcaacntttaantggccttggctttggtgtncttcccccnaacttggtttattgattttgggagnaaataagtaacaagggcttgaattanttgggcttttgctgnattatggttcaganggtnn

SEQ ID NO: 103080 - DNA, 1061 bp, Triticum aestivum
  unsure (1)..(1061): unsure at all n locations
  Clone ID: PAT_TA_103080
agggagaaaggaaggnnnnnaaaaanttttgggaaaaaaaaancnccntttggnttngggggtccgggncccccccttcccccnaaaaacnnaaanaaaaaaaaaaanannangnnnnagnnnnggngagagaaaaaaaaaaaaaagnngangggggggggggncnccaccccgccggggggggnggggngggggnaggggggnggaaaaaaaaaaaaaaaaanaaagantggtncccncanccggcggngggggaangggaaggggaaaaacccnggggggggggggggnnanaaaaaacaaccacannaaaaaaaaaaaangccgcggggggggggggnggccgacaanaaggngggggggnngaaaaaaaagaaaaagggcggaaaggaggangaaaaaaanaaaaaaangngnccggggggaganaaaaaagggagaaagggaaancaannnncccccacnaaanaaanaaaaaganaannnggnaagagaganananaannnannnnancnaanaangaanganngnaanngnannnanggggangagcnanngaaaagnnnnaaaaaaaaaaagtannangggggannaaaaaaaaanaanannaaangggggnngganagnannaanaaaacaaaacnaagngaangggnacnagaaaagnnangnannaaggaaagcaaaagacnangnnaaaaggggaangganagaaagggaacaaaaaacngaaaaangnggggncaanggggagcngaagaaanangcaaaaaaggggngaaaanaggggganggaaannncnaaggaaaagacnannggannagaangaannaaaaagannaanangnggggnnangaanaganaaangggaaannnggcnaaaaanagngnanangggggaaccggggggggnaaaacnnannaaaagagaancancganaagggnnaaaaaggngnaannnannngnggaaggggggaanangngaaaagnnaaanaanaaaaaaaangaanaaaggnnaggggggggngnnnngggggaggagaggaaaaancag

SEQ ID NO: 103081 - DNA, 621 bp, Triticum aestivum
  unsure (1)..(621): unsure at all n locations
  Clone ID: PAT_TA_103081
agaaaaaanttaaaaccnttnttttcccnncgtctcgaanttaaccctcactaaagggaacaaaagctggagctccaccgcggnggnggncgctctagaactagtggatcccccgggctgnaggaattcggnaccaggntancaccaatccaccatgaagaccttcctcgtntttgncctcctcaccgttgcggngacaagtgcaattgcgcagatggagactagatgcatccctggtttggagagaccatggcagcagcaaccattnccaccacaacagacatttcacaacaaccactattttgacaacaacaacaacaacaactattttctnaacaaccatcattttggcagcancaaccaccattttggnagnaacaaccaccattttctnancaacaaccaattntaccacagcaaccaccattttggnagnaacaacaactaggtttnccgngacaaccccattttttcaggaacaacaaccagttttacctncacaacaataccttttcacaacaacaacaacaacaccaacaggtggngnnacaacaaatcctgttgtttagccttcattttgcagcagcttaacccatgcnagggtttcttcagcagcaaggc

SEQ ID NO: 103082 - DNA, 615 bp, Triticum aestivum
  unsure (1)..(615): unsure at all n locations
  Clone ID: PAT_TA_103082
gngtntnnttttttcctntatccccttnccctactaaagggaacaaaagctggagctccaccgcggtggcggccgctctagaactagtggatcccccgggctgcaggaattcggcaccagcctngccnttanccnactccgacngntgcgtngccganacanngcgcggngncgancnnccacnntcgagcatntgcatntcttcgcgaanaccctgaccncangataataaaagctggagtgtngagntctatgacaccatcctnngcntaaggccctatccaggactngnatgggtntcactgctggnccagacnnaccttatnttgnnngncaagcatncttaggacngtcgcacccttgcctnctactanatccagatcgagtncaccctacacctgntgctnnaactaccgggngcgccntgnatntcaagaagatgacctacaccatgcccaagaagcaaaagcacaagcacntgaaggtgaatctcgccttatctccanntctacatggtcaacgacgccaccggcaangtcaccangctnaggantgantgcncgaacgcctctgaggcgcnggttcctttattgccaaccactttngatcgatttn

SEQ ID NO: 103083 - DNA, 617 bp, Triticum aestivum
  unsure (1)..(617): unsure at all n locations
  Clone ID: PAT_TA_103083
gaggntaannacnaactcccnaanccccntnaccctcntaaagggaacaaaagctggagctccaccgcggtggcggccgctctagaactagtggatcccccgggctgcaggaattcggcacgaggatnnatntatnattcaaccttcntnaactattaancnttcncaanaaacnaaanagatcngcnnatcnagntntctntactcttcatcntncntctngntgncacagcgctgcacgnnacatntnntctagntntggcgncgtataggngncancacnccncannattggtnangatgngcatnanntnntccatntngncaangaaccgactgnncaatcnntncccngncacncatgaccagacnggtnnnggnnnnanncntnccccaaggactggtanagggnctcgntntctnctagctnacatnctncnngnttngantaaatncgtaanncnacatctncctctatncntggntganngntntggnagacctnctcctntaggtgcntggnccctcttntnntcnanncccacntccatntgngnncagttgnnntcnaanagttgncnaacnacctgctcattgnggncnnncntntanccgnc

SEQ ID NO: 103084 - DNA, 834 bp, Triticum aestivum
  unsure (1)..(834): unsure at all n locations
  Clone ID: PAT_TA_103084
ggnnnttnnnnnnntntttngaananancncnttttttngacttncnccaaactttttaaaaccccctttcaacnttanaaagggggggaaaccaaaaaaaggccttggggnagnccttccccaccccggccggggttggggccggggcnccggcnttcnttangnaaaccttaaggttggggaattcnccccccccggggggccttggcaagggggaaaattttcggggcaaccccaaggaaaccccaaaattccccaaccccaaaaggccaaaaaaccccccggattggggccccccggccaccggaaaagccaaagaacggggnnggaaggggaaaaagttcccacccggggccgggggcaaaagggggcgccccggcggggaaaaagccaagcttgggcccaccaaaaggcggggcgccgcaaagtcgggccccgggccacggggcgggcgtgaagaagccgcaccgctttcgccgggcaccgtggcgctccgggagatccgcaagtaccagaagagcacggagctgctcatccgcaagctgcccttccagcgcctcgtcagggagatcgcgcaggacttcaagaccgacctgaggttccagtcctccgccgtgtcggcgctgcaggaggccgccgaggcctacctcgtgggcctcttcgaggacaccaaccttttgcgccattcacgccnaagcgcgttaaccattattgccaaaggacattcaagctttgcaagggggcattaaaggggccgaagaagggcctaagattcatcttgcttctttcgcaagtgtcttgtgccgctgatcttcaggtgtaaaaggggntgt

SEQ ID NO: 103085 - DNA, 614 bp, Triticum aestivum
  unsure (1)..(614): unsure at all n locations
  Clone ID: PAT_TA_103085
ggntaannngnatnttaannatctcttcgcncgaanttaancctactaaagggaacaaaagctggagctccaccgcggtggcggccgctctagaactagtggatcccccgggctgcaggaattcggnaccagcccgtcccgtnccgtccccagccaacctnccatntncgtctcgcgtcgcggnggcagttccactccctcgccatgggcaagattaagatcggaatcaacggtttcggaaggatcgggaggctcgtcgccagggtagccctccagagcgacgatgtcgagctcgtcgcccgtcaacgaccccttnattaccaccgagtacatgacctacatgttcaagtacgacaccgttcacggncactggaagcacagtgacatcaagctcaaggacgacaagactctgctctttggngaanaaccagttcccgcttnggcgtcaggaaccctgangagatcccgtggggtgaggctggtgcccattaccttgtggagtccaccggggtcttnacttgacaaggacaaagggcgctgntcacttnnaaggnggngccaanaaagnggncatntttgcccaacaaaaatgccctatttttgngggtggngga

SEQ ID NO: 103086 - DNA, 593 bp, Triticum aestivum
  unsure (1)..(593): unsure at all n locations
  Clone ID: PAT_TA_103086
tttnattccctngctcgaanttaaccctactaaagggaacaaaagctggagctccaccgcggtggcggccgctctagaactagtggatcccccgggctgcaggaattcggcaccaggntancaccaatannccatgaanaccntcctcttctntntcctgnntatcngtgannggacannnangntcnngcanatggagacnntntgcatnnctgggntgggggannnnntngtannngcgaccattaccacnncagnnnacatttanactcaaccagtatntgccaacaacnacaacaacnactatttcctcaananccattatttngnnatgnncanccnccnttttgggnngnncaaccacnattttctgagcaacaaccaattctacctagngaccancattttngagnnacacaactagnntaccgcncanccaccattttcacngcannacaaccagntttacctccncaacaatcatcttttacacaacancagcngcngcaacaacagttggtgcatcaacanatacgtggngnaaancntncattttgcagcagattnacccatgcangggatttcntcaaccn

SEQ ID NO: 103087 - DNA, 624 bp, Triticum aestivum
  unsure (1)..(624): unsure at all n locations
  Clone ID: PAT_TA_103087
gagnnnnnnttnataacctntanttcccttagctcgaacttaaccctcactaaagggaacaaaagctggagctccaccgcggtggcggccgctctagaactagtggatcccccgggctgcaggaattcggcaccaggnnctttancncancttncatattgnnnntcatttccccccanancttntcgatncntnnncgcnctnncntttncgtngacggttncaggccccnncgtannncnttnccggannanntnaatcgcntganctanctgngcttacgaacgatgagccgangnancggtccnnaccatctacttgggnantatttccgaggacatccgcnagangcnaattagacgaatctcttaacaannccgngctattgcacattcacatctnanaatcctccaaagacctgctgttgatgctactgtcgagtactgaacncccacgncatgctgatnatgtctatttattgccgggatgaataccattttgaccgctaccaatttgtggaaccagttatttcntggnggcanntgggcccttttttcgaccgaccaatcaatnatactagcttntgtacgtttgtatgcacantacntntactgatgaccnact

SEQ ID NO: 103088 - DNA, 629 bp, Triticum aestivum
  unsure (1)..(629): unsure at all n locations
  Clone ID: PAT_TA_103088
ganggggtaaatanagnnntaanngnacctctnctgaaaagacccgaaagggattncnagggngganctccaccgnggtggcggccgctctagaactagtggntnccccggnttgcaggaattcggcaccagnnccctagggngncttnngnacncttctcctccgctccccgnccngcctcgagcagntcagggacgcgcacagccatggcgacggagaccgagaccttcgncttccaggccgagatcaaccagctcctctcgctcatcatcaacaccttctactccaacaaggagatcttcctccgcgagctcatctncaactcctccgatgccttggacaagatcaggttcgagagcctcacggncaagagcaagctagacgcgcagnccgagctcttcatccacatcatccccgacaagggggaccaacncgctcacnatcgttgacagcngcattngggatgacccaagtccgaccttagngaacaaacctcgggaccatcgccaggtngggggaccaagggagttnatggaggccctcggccgcggcgcccgacgtgtncatgattgggcagttcggtgtcggtttctactccgnctaccctcgtcgccgagagggtttgtcg

SEQ ID NO: 103089 - DNA, 608 bp, Triticum aestivum
  unsure (1)..(608): unsure at all n locations
  Clone ID: PAT_TA_103089
gngntnnntntnattcctttnctccctttaaccctcctaaagggaacaaaagctggagctccaccgcggtggcggccgctctagaactagtggatcccccgggctgcaggaattcggcacgagnnncaannngtacgttttatanntnnaagccttgccngnggcnccngctccatggganactnaaacnnatgganctcnnancccaagaactacagaccnngatcnnnggtttnccgngngtnnggctactcnnatggnctgatccgntagtacgntctnttntgntggacnnattgcttccgcacgnacnctanggacattgnntttatctagtncccgtantaatggaantctcaaacgaagcactgactatgaaattattnaccgaactgngcncttcatcgaggctgatctttatcctataacctatgttatgaactggtattatgcttgaantcctggaggacaaatcccgngaaacannattagtnactgctgtttgatcatnnananccgatcattgttgnnctcttggnccatctggntaaaaaggtgatctnnaccctatatccatattatccngcgaaaggcccgaaaananggcc

SEQ ID NO: 103090 - DNA, 999 bp, Triticum aestivum
  unsure (1)..(999): unsure at all n locations
  Clone ID: PAT_TA_103090
ggnngggnnnnnnnnnnnnnnnnttttttttnaaaaaaaaaaaanccntttttnttgtaaaaaatnaccccccccnccaagggacccttccggggaaaaaaaatttttaaaaaaccnccctttnccaacctttnaaaaaaaggggggggggaaaaaccaaaaaaaaaaaggaccctnggggggaagggnccttttcccccaaacccccggcccgggggtttgggggggccgggggggcccccggccctttnccttaaaggnaaaaaacctttaaagggtngggggggaaatttcnccccccccccggggggggncctttgggccaaaggggggaaaaaatttttccggggggccaaacccccaaaggacccgggggccggggggccgggggggttgggccctttaacccgcttggggggaaggnaaaagaaagggggaagggggaagggggnangnggnannnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnannnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnngnnncannnnnannganaanngnnannnnnnnncnnnnngnngannanntnnnngcnnnaagggggcatgcatgtngnngggnggaannnnnnnntnnnnganggaccaaaaanaaaatttgccannnggngggcatggttgttngnnngnnacacccngnccnngngnnnnanatnnnnnncannncannnctncncccanaananaaaaaanannaannnnnnnnnnnnnnnaannnnnnnnnaaannntnnccnngggtnnaanggatcaaganctatgatatcttncancttc

SEQ ID NO: 103091 - DNA, 619 bp, Triticum aestivum
  unsure (1)..(619): unsure at all n locations
  Clone ID: PAT_TA_103091
gagtgntnnntntanttcctttgaatacccntgctcgaaattaaccctcactaaagggaacaaaagctggagctccaccgcggtggcggccgctctagaactagtggatcccccgggctgcaggaattcggcacgagnnanaactntatgntnnncnacaatgcannnatgnncttcctngnnnctannctnnnagacctnnnagcnnnnantgccgantctctctntttacagattcaacaacntccatcatnnntcaagnggnnaatantcancnattcccgnaanaacnnnaancnccattngncnttcnncaacnancatgnntanttnatntagctacaacatccacngcctcatnacanattcnagttntgcctcggccacnacctccattntgtgnnnttcnaccnntncctcttggtcangaacannncncancancttggcatggaggancagcaacattntcgccnagcactaaccatattttctgcaaancgcaagcnctgttatccatcgganttnnncnnccattnttgtagngaaaataaanacaancananttttgnctgatcnccaaccntcngtttcaaaacagccaccagatttgtcaggn

SEQ ID NO: 103092 - DNA, 622 bp, Triticum aestivum
  unsure (1)..(622): unsure at all n locations
  Clone ID: PAT_TA_103092
aaaaaaaattgtttccttgctcgncttaaccctactaaagggaacaaaagctggagctccaccgcggtggcggccgctctagaactagtggatcccccgggctgcaggaattcggcaccagcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaacaacaacaacaacaacaaatccttcaacaaattttgcaacaacaactgattccatgcatggatgttgtattgcaggaacacaacatagcgcatggaagatcacaaggtttgcaacaaagtacttaccagctgttgcaagaattgtgttgtcagcacctatggcaaatccctgagcagtcgcagtgccaggccatccacaatgttggtcatgctattattctgcatcaacaacaaaaacaacaacaacaaccaaccattcgagccatgtcttncnttncatttaagccanggcttcctttncggccatnttaagcaaaaaccaaaaggcccangggcttttgtccaagcctt

SEQ ID NO: 103093 - DNA, 611 bp, Triticum aestivum
  unsure (1)..(611): unsure at all n locations
  Clone ID: PAT_TA_103093
aaaaaaaattanaacctttantcccttgctcgaanttaaccctcactaaagggaacaaaagctggagctccaccgcggtggcggccgctctagaactagtggatcccccgggctgcaggaattcggcaccagctaaaccactctccctatccccgtgtccagaagctnccccccggctccaatggcggcgaaggaaccgatgcgcgtgctcgtcaccggcgccgcaggacaaatcggatatgctcttgttcccatgattgccaggggagttatgcttggtgcanaccaacctgttattctgcatatgctggatattgaatttgctgctgaagctcttaaaggcgtcaagatggagntgatccatgccncatttccacttctcaagggagttgttgcaacaactgatgttgtcgaggcctgcactggtgtgaatgttgcnggtattggtggngggattncccaagaaaggaaggaatggnaaaggaaggatgttntgaccaaaaatgtttcaatctacaaagctcaagcatctgctcttgaagctcatgcacccccaactgcnanggtttggttgttgccacccaacaaacacccatgctntnattctgang

SEQ ID NO: 103094 - DNA, 717 bp, Triticum aestivum
  unsure (1)..(717): unsure at all n locations
  Clone ID: PAT_TA_103094
gnggntnnntttaatccttnctccantaaccctactaaagggaacaaaagctggagctccaccgcggtggcggccgctctagaactagtggatcccccgggctgcaggaattcggcaccagcccaaaccttctcctccttctgaacctcccggcgcatcttcgactccatggnccgcaccaagcagacggcgaggaagtccaccggcggcaaggcgccgaggaagcaagctggccaccaaggccgccgcaagtccgcccggccaccggcggcgtcaagaagccccaccgcttccgccccggaccgtngcgctccgcgagatccgcaagtaccagaagagcaccgagctgctcattcgcaaagctccccttcagcgccttgtncnggagatcgcccangacttcaaagaccgaccttncgctttccaaagcttccgnccgtcttccgcccttgcaaggaaggcccgnccgaggccctaccttggtngggggcttntttcgaaggaacaacccaaancctnttgtgcccanttcaacgncccaaagccgccgttcaacccaattcaattgncccccaaanggaaccanttcccaagcctttgggcaaccggccccggcaatttncccnttggggccgaaagnaagggggcccccttaaaagccnttntttaccgnccggtttcggtnccggttcnttttaaanccccaagnaattggtt

SEQ ID NO: 103095 - DNA, 624 bp, Triticum aestivum
  unsure (1)..(624): unsure at all n locations
  Clone ID: PAT_TA_103095
gagnnnnnnttataacctantantctctttgctcgaacttaaccctcactaaagggaacaaaagctggagctccaccgcggtggcggccgctctagaactagtggatcccccgggctgcaggaattcggcacgagcaacaaccatttncccagcaaccacaacaaccattnccccagactcaacaaccacaacaaccatttncccagcaaccacaacaaccattcccccagactcaacaaccacaacaaccatttccccagttncagcaaccacaccaaccttttcaccagccccaacaacaattnccgcagccccaacaaccgcaacaatcattnccccagcaaacaacgaccgntcattnaagcatntntacaacaacgtttgaacccatgcaagaatattctcttgcaacaatggcaaacctgcggcaattgggggattccttntggtcgataatctgggcacaaagcgattggcaaagtgatgcaacancaatgctggcaagaactagcacagattcctcagcagcttcagtgcgcagccattcatagcgtcggcatttcattatngtgcagcagctcaacaacaaccncaacaaccaccaccnccaccaccaccanggg

SEQ ID NO: 103096 - DNA, 973 bp, Triticum aestivum
  unsure (1)..(973): unsure at all n locations
  Clone ID: PAT_TA_103096
gnngggggnnnttnnnnnnnntttntntttggaaaaannncccttaaaaggngaaaaaacttcccctccnttttttttnttntnttcccnttcccnncctnaaaaaaagggggggggaaanaccaaaaaaaaaaaggncccttgggggnaaggccctttccccccaacccccggncgggggggnnggggggnccggggggccncccgggccttttctttaaaggaaaaaaacctttaaagggttgggggggaaatttcccccccccccccgggggggggccctttggggccaaaggggggaaaaaattttttccgggggggccaaacccgggaaaggggggccccccggncncccggggangccaaattgggccttttcnccnggggggaattttcncccggaattncggccgggggggnggggttacncctttcnaacaccccaaaggggatcccccttantttangggnccattcctttattttnacaggggacttctttttacccggttattcccccacttcttatccaaccccngggccttaaatggttnacgaaccggaccgcgggcccncgtgcattctttcccaaaaccctaacttacccgtgggagggangtacntcgtctncanctgcggcctcacccgaccacaaggccnttaangcctncgncaagctntancacctcaagtcccccgccaatcccgacgcngtgctcgccttactcgncggtctaggcctatctgacagccgatgtggccgccctcgtngccanngacccagcaagttactntgagccaagcgtggagagaaacctggagcacgtcgtagtcggnntntctgnnctcggcttatnngcgtttcgacatcgctgcgcntcgcctagntctannggtacaagattcngctgtaaatncatcgtnttcaagntgcagaactacatgcctttctttgggtcctttgaaaatntcn

SEQ ID NO: 103097 - DNA, 1363 bp, Triticum aestivum
  unsure (1)..(1363): unsure at all n locations
  Clone ID: PAT_TA_103097
anaaantnactngtcatactatatgnaaaagtgagtaaccgggggcggcgtcntaacnagtgatcccggctgagaattcggacgaggcgcggcaagcgattcccgcggnttctcctacctnctcgactggcggncgcccgncgggnccccttcaacccggaacaagggccggcggggncctttccggcttggggggaaccccccggaaccgggggnccccccttaaacggtttctttttcccgggccccggggggcttttccccgggnccccccgggttttnccccgggccttttcnttttcngggggggtncccccnaaaaggggggggcccccctttnccccnttttcngggnaaanccccccccccnaaaccccccccntttttgggggccnccttttttncccccctttttcccccggggccnggggttttccttttttttcccccccccggggtttnaanttttccgggggggcccccccccccngggggncccccggggnnccccnaaaaaaggggttttttcccttttggggccctttttaaaaccngggnccngggnccnttttcnccccccccccnggggttttccggggaaaacccccccccccccnaaaaaantttccngggnccccccggggcctttttaaacccccctttttcncccntttttnccccgggggnccccccccgggnaaaacnccccttttttccntttttttcctttnaaaccnggggggggncccccccccntttttccccnttttcngggaaaacnggggggggncccccccccngggcccccccccgggttggggtttttttccgggaaaaannccctttccnaaanttncgggtttccngggaaaaccgggggggccaaaacccccnttttttntttngggggnaaacccccggggcccccgggttttcngggaaaaanaaaacccccgggggcccggggaaaattgggaaaaacaaaattttncccntttggggggccccccgggggccaaagggccngggccccctttttngggccaaaacntttaaccgnaaaangggggcccccggtngggntttttnccccccnggggggccccaaaanggggggggggccaaaanggggnaaaaaccnttttgggaaacccccttttttttttggggncccnttcgggggggcnggggttcnaaaaacccccccccgggaaacnttaaacaaaacccccgggaaacnttttncccggggggnccccccggggttttcnaattttaaaaaaacgggcccgggccttggggcaaaanggggttcnaattttcccaaaggccttttncccaatttggnaaatttttcgggggg

SEQ ID NO: 103098 - DNA, 620 bp, Triticum aestivum
  unsure (1)..(620): unsure at all n locations
  Clone ID: PAT_TA_103098
aaanaaaaattaaaactttaaatcccttgctcgaanttaaccctcactaaagggaacaaaagctggagctccaccgcggtggcggccgctctagaactagtggatcccccgggctgcaggaattcggcacnaggccnncngncanngattccgaggnttctcctanctccttnactgnngngccgaggccccctntaccgacagncgcggnctaaagctgggacctacgacggacctacgtgtccgccggntncaancgtatcgctctcggttcagggcctcctctaccccaccctcanntncctncgngtcttncnntatcngcccnncgtcaagntctgntacncnctnnccntnnancccaanngcngctacctgntcngcncgaccttcttctacggcccctncttaacggacnnntccgtgttcgacctcatngtcgacggcaccttnnggaccgccgttnataccgccgatnacatcntggccggcancncctagaactacnaggncgtgttnncggccaggggcaggaacttgaccttctgcctcggngtcaaccccgactacaccgactacggnccgttnatnancgcgctgcaggtcatacacctccatga

SEQ ID NO: 103099 - DNA, 1011 bp, Triticum aestivum
  unsure (1)..(1011): unsure at all n locations
  Clone ID: PAT_TA_103099
aggaaanttnataccttgctccatnaccctactaaagggaacaaaagctggagctccaccgcggtggcggccgctctagaactagtggatcccccgggctgcaggaattcggcacgagcagcaatcctctctncgcgcccacgaagcaagctccacactnccgatggcccgcacgaaagcaaaacgggcgagggaaatccacccgggcgggcaaagggcgcccggcggcaaaggcaagccttgggcggaacccaaaanggccggggccggccgncaaaaggttccccggcccccccgggggcccaaccccggggccggggccggttggaaaaaaaaaaaagcccccccccaacccccgggtttttttcccggcccccccccgggggcnaaccccngtttccggccggncctttccccggggggaanggaaattccccggccnaaanggnttancccccaaggaaaaaggaaaggcccaacccccggaaaggccnttggncttttcaaatttccccgggccaaaagggccntttccccccccttttttccccaaggnccggcccccttgggggttgggccgggggggaaagaaatttcnggccggcccaaggggnaacctttttttaaaaggaaaccccggnaacccctttccccggcntttttncccaagnaaaggcctttccccggccccggnttcttttnccggccggcctttgncaaagggnaangggnccccgnccccgnaaggggccccttaacccctttcggttccgggggncnttcntttttcggaaggggaaccaaccccaaaacccctttnttggccggccccanttccccaacggccccaaaagccggccggtttcaacccaattcaattggcccccaaangggaccantttccaagcttttggcccccggccgggaattncnntgggccgnaaaaanggccccttaaggcntgggttttcctttaaaaattccctaagnggtctggaatcttggggcttn

SEQ ID NO: 103100 - DNA, 379 bp, Triticum aestivum
  unsure (1)..(379): unsure at all n locations
  Clone ID: PAT_TA_103100
tctacanaagcttcagatacatgactgtccagaattctcgtcagtgattcacatctcttcgattgagagtctgcgccatgtcaggatacgacaagtaaaggtgctaaaggagtttacgtactcgaaatcatctgatggagcagaattggaaattgttggagagggttatctgcatagattagaccaagtgttagtttttgataaagaaataggataccccaagcaatcccttcagagattaagtatacgtaattcccgggcatttctatcctcgttttcccgtcacagtttcccttcctccttgcagttcctggagcttgtaggtgtggaggacttggggacacttgagcccctctcaaacctctactttgttactgat

SEQ ID NO: 103101 - DNA, 358 bp, Triticum aestivum
  unsure (1)..(358): unsure at all n locations
  Clone ID: PAT_TA_103101
cgccagtgtggcggttttccctgctccgnctaggggntacacccgnacagctctggttngnagcgatggngagccaccgncgncttcgcgacctgctcctcctcgncgcggngctcctgctctncgnctcctgngccgncgtcgccaacttcgagtactgcaataaggggcgccactatccggtgaaggtgagcggcgtnganatctgtncccgaccncgtcgtgcgcggccagcccnccaccttnaagatctccgncttcaccgataaaaccatcaccaaagggaagctgncggttnatgngtggtacttcntttctacacgttcnattcatagacttcatgactttgttgttctgg

SEQ ID NO: 103102 - DNA, 350 bp, Triticum aestivum
  unsure (1)..(350): unsure at all n locations
  Clone ID: PAT_TA_103102
ccccccatctnaaaaccctagcccgtncgatcccggcnagatggccaacccgagggtgttcttcgacatgaccgtcgncggcgcgccggccgggcgcatcgtgatggagctgtacaaggacgcggtgccgtggacggtggagaacttcgngcgctctgnaccggcgagaagggctgttngcaagagcggcangccactgcactacaagggcagttcgttccaccgngtgatccccgacttcatgtgccagggcggntgactttaccaagggcaacngcacccnnnggcgagtccatntacggnnagaagtttngncgnctagaagttngtccacaagcacaccaagcccg

SEQ ID NO: 103103 - DNA, 357 bp, Triticum aestivum
  unsure (1)..(357): unsure at all n locations
  Clone ID: PAT_TA_103103
gcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgatgggggaggtgatgatgctttcaacaccttcttnagcgagactggtgctgngaagcatgtcccccgtgctgnctttgtagatctcgagcccactgtgattgatgaggngaggactggtgcttaccgtcagctcttncaccctgagc

SEQ ID NO: 103104 - DNA, 360 bp, Triticum aestivum
  unsure (1)..(360): unsure at all n locations
  Clone ID: PAT_TA_103104
caaagcanggtgaaatganatcgtgcagtccatgggtaaccgagggagccaagatgttggtggttcctgcgagcttgccgcaaagcagcagctcgtcaccgctgatctcacttccatcataattcagctcatctcgactgccggctccatgcttccttccatgaagacccngctccttagcagcaatccagcggtcaggcaactcaacacgcctggttctcccatgggctttggctcgattgngaatcagcggccaagcacagtcagggaggagatggttcctgacattagcaagacctctgattatgaggagctgatgaatacccttaacacagcgcatgatgaaanggatgatctgat

SEQ ID NO: 103105 - DNA, 403 bp, Triticum aestivum
  Clone ID: PAT_TA_103105
ttgattgtctgcccgtataacaagcaaaagcgatccaaggttcctagccagctccacggtcgcgagaaaggtaccgacaggtcgtgctgttgattcattactaggtgggagggagcgaagcaaagggcataccatcgaccgaccgatggttgcgcacaaggcggcctcgtggctgcccgtggacttccggctgccggcggtgccgcaggcggcgctgggcatactggcgttcgaggcgggggcggccatgtccaagctgctctcgctgcaccgctcgctctcggagcaggaggtctcccggctgcgctccgacgccatgcgctcgccgggggtggcctacctcaacttcaccgaccaggcgttcctcctccggctggcgtgcgccgagctggtgctgtcgctc

SEQ ID NO: 103106 - DNA, 467 bp, Triticum aestivum
  unsure (1)..(467): unsure at all n locations
  Clone ID: PAT_TA_103106
gctcngatccactagtaacggccgccagtgtggtggnattccgcaagtaccagaggagcacggagctgctcatccgcaagctgcccttccagcgcctngtccgggagatcgcgcaggacttcaagaccgacctgaggttccagtcctccgccgtgtcggcgctgcaggaggccgtcgaggcctacctcgtcgggctcttcgaggacaccaacctctgcgccatccacgccaagcgcgtcaccatcatgcccaaggacatccagctngcaagacgcatncngggcgagagggcctaggatagtgtctgtctcttntgcaggtgtagagattagcatgtgttttgcgtggtggagtgatcctgtgttcgtgctatgttgggtgtgtgtgatgntctagtgcagtgtctgatgntaccatnttgttgtcatcagcaatnttgaatgaaatttggcttgtcaaaaaaaaaa

SEQ ID NO: 103107 - DNA, 458 bp, Triticum aestivum
  unsure (1)..(458): unsure at all n locations
  Clone ID: PAT_TA_103107
cactagtaacggccgccagtgtggngttttcagtacgctatacatgngctagtctggccgagactgcgggtcttgagagcacatacttaacgtatgtacgccaatgtcgccagctattgcacctcccaccgncggcggcgggcatgatccaccaacgcagcagcccgaggaagagatcgccgtccgtgtgatcccggcgtcagaagatgtcgaggagccggcggcagacaccaccagcttcttgtgtccactagtgccgcttncaacggcaaccttggcgaacggcatgcacgtgctgctcgtccagtccacgtctacggacttgtcgccgncaggtctccaagctctgctggtcccggccagctgctgggaggacggaccgcgtgatcaccaggcnagaaggaacatcgactnccgaatggccnccncggnngttnagggntttgnntnntggtccc

SEQ ID NO: 103108 - DNA, 399 bp, Triticum aestivum
  Clone ID: PAT_TA_103108
gagctttcgttccggccgcgcctccggcctcgatcgcccgagtcgcctccttgcgtcctcgcgtcttctccaccaattcccgattcgttccgaatcgcgtttgatttgatttcactcgccgtcgccgttgccttggattcgacccgtctcgtctctccgctccgtgcgatcccgggaagcgatcgatcgggggattcattcatttggtttgcgagtctatctcagattctgtttcgtgtgtacggttctgtttacaactgtggatcccgtgttcctcgtattcgtgttcgcatccgcgcgcgttggtcagattcccgtgctcgttcacaccgcttcctctgcgctcatccgtgattccagatttcaaatggatatggcccgcgtcatcttctggttcct

SEQ ID NO: 103109 - DNA, 402 bp, Triticum aestivum
  unsure (1)..(402): unsure at all n locations
  Clone ID: PAT_TA_103109
gaccttgtacttacttgacttcaccttgcactcccacagtcatatagctagttgccacttggttgcctttctagaccatcagaccaagaacacacagcatgtgtggaaagatggatgaggttcacctccacatggagcacaagagcctacccggtggagaatttggaggagttcgtgcctcgatgtccaaacctccgacgtctagcacttctaggccaaacagcatggttgtcaagaaagtgtgcccacgggagtacatcccgccgcacatcgtggcggaggcaatctcgacgctgcacggnctcgacctgcggtggtcggggccgatcacgcccagcgagcggctctacgtggagcagtacgtgatggccaagtacccgcagtactctcacggactcattg

SEQ ID NO: 103110 - DNA, 452 bp, Triticum aestivum
  unsure (1)..(452): unsure at all n locations
  Clone ID: PAT_TA_103110
gctcggatccactagtaacggccgccagtgtggtggaattccgctagtccccaggngagacggcgtggcgcccgagagtgtgccaccgctccgctccactccgcacccgcacccccgcattgtttcaaaatccgcaggccggnccacggaggcggcgcggcggtgggtcgccggcgggcaggggcgtctctggtgcgggagggggttcttggntcttgaagctctagccgaagcacggaggcngncgaggggataggagagaagggctagggagctcggaggagtgagcgaaggagagggaagccatggccgntgtgngcgttntcgcgngcctgctggctncggtnatgngnatctcctgngangtagngaggnngccggagnccaggatncacctgcacctnaagngccctnaacangttgtcntccaagagnntccttaagtncaaccg

SEQ ID NO: 103111 - DNA, 413 bp, Triticum aestivum
  unsure (1)..(413): unsure at all n locations
  Clone ID: PAT_TA_103111
gaggcacagtcctgatggcaatgaatggcattgccaaaatacatcagttctatacctcaaaaggagggggatttaccctnaaaaaagaaaaaagagggggattttttttacgcataacccaagagaatgatcatcaactgtcttctttcaaggagttgatgcactttggctcagctctgttcaatcacagccatnacccttcacccttcaccgtcaataactcagtagttgatggatactgtcatgacaatgcaaaaccgaccgtcgcgatggcgatgagtaggatcgcatgaaccgcctgccgtgctccgtgtgaatccgccatgggcggcaggtagccgcggaggccgacgttgtagaccggcgtgccgtcggggtagaacagcccgtagttgcgctncgacgccgggccc

SEQ ID NO: 103112 - DNA, 413 bp, Triticum aestivum
  unsure (1)..(413): unsure at all n locations
  Clone ID: PAT_TA_103112
nggggggagctccccaacgggctgcccgtggcggtgaaggtgctcaaggtgtccatgaacaagaaggttcaggaagggttcatggcggagatcggcaccatcggccggacctaccacgtgcacctcgtcaggctctacggcttctgcttcgacccggacaccaaggcgcttgtctatgagtacctggagaatggttcgctggagaagtacctttaccaccatgggnaaggagacnnnnacagagacngcgnacgaggnnaggagggaaaggctcanttggcnntcacttgaacatcatctcctnncnnaccnnnnaaggggatccgttnccttgcatgaggagtgccagcacatgatcgccactacgatatcaagncggtcaacatccttcttaccgtcgacttnaccgcccn

SEQ ID NO: 103113 - DNA, 408 bp, Triticum aestivum
  unsure (1)..(408): unsure at all n locations
  Clone ID: PAT_TA_103113
cgccgacgaggcggccatgcgcacccgcggcttcccccccgtagagacccacctcggccgcctggtcgtgtccgtccagtacctccccagcctcgccgnctacaacttcgagatcacgtctctctcctccgccatgctcatcaccgattacgtcgggagcccggcagcggagcctatgcgctccttcccgtcgtcgctcacagagcctgccagctcggccttgccgctgccctcacgccgncccaacagctgggcgtcgcctgctggtgcctactggccacagtcgcccgggcagcacgccaagttctcaccgnccccaacgctgtacgcgtctcccacgccatcttctcccacgttcggtggcggctacctgcagtcgcggctgtgcggggagaccgcaccaatnac

SEQ ID NO: 103114 - DNA, 407 bp, Triticum aestivum
  unsure (1)..(407): unsure at all n locations
  Clone ID: PAT_TA_103114
ctngtcgtcactgctagcggggttttggggctcgctatcagcttcacttcgatgtggtttcttcgtcagacaagcgcaacaacatatagccttgtaggttccctcaacaagatcccactttccattgccggaatccttctcttcaaagtccgcacgagcatggagaattccatcagcattctgttcgggctattagcaggagtatnttnntccagggcaaaattgcgcgaaaactcccagtcgtagatgttccatatcccattcctaccagagggcaggattgcggtcgcataaaaaaaagcagtctgctccctcaaaccagactggaaaatttgtgcangtgtgaggntgtttcccagctggcaagacaagagacaacgtcatgttagttagcctggtgctnngct

SEQ ID NO: 103115 - DNA, 409 bp, Triticum aestivum
  unsure (1)..(409): unsure at all n locations
  Clone ID: PAT_TA_103115
cctnctccttcttcttcttcttcttcttcttccatgtcaatggagattcggagcagccaccaccacgaggaggcgaccggaaatctaatgaggccgggatcagaatacccgccgggaatgcagcgaggaggagcacctgcgactgcgacgcaccggcggcagttccagcccattccggcgcccttcatgtcattcaggccgcccacctccagcacgcccatgacgatgccacatnatcatcaggggcagcttcggttccacggccaccacggcggatccaggccgtttcaccagccgtcgccgggggccaacccaggtgccgncgatggcntcgngtncacaactcaccagngtttnaccgnaatgagcgccgcgttcaggtcttgcggttggngtttacgccccaagc

SEQ ID NO: 103116 - DNA, 430 bp, Triticum aestivum
  unsure (1)..(430): unsure at all n locations
  Clone ID: PAT_TA_103116
cgtggccgccgacnggtgcggcgggtgatggcggagggcgaggaagggaaggcgttcgcgcgcaacgccggggagctccaggcggttctctgggacagagcgaagcaggacgagtacgtcgacgatctggtggcagagcacttgctgcgcctgcgcctgtgatgctgcctcagcgaggctgcttctcgtggacagtgagtgtgcgatgctcagtgctcggtaatgctattcgtacgtacttnctctgtaaaaaataatactgtaatatataaagtaaaataatacggtaaacacttttatatttctttacgaaaaatctacgtgtaagttttttttctnntnannnngatncncatatacttaatcaactnggagctgctggnggggcntgcnnncccgnnnggacntggcgatcatncncaagttcnct

SEQ ID NO: 103117 - DNA, 432 bp, Triticum aestivum
  unsure (1)..(432): unsure at all n locations
  Clone ID: PAT_TA_103117
ggatgccgacctcgcagccgacatggtgcgtctgtcccgcgagtttttagcgctgcctgccgaggacaaggtccggtacgacatgtccggcggnaagaagggcggtttcatcgtctccagncaccttcagggcgaggcggtgcangactggagggagctagtgacctacttctcctacccggtgaaggcacgggactacngncgttggccggagaagccggcggngtggcgcgcggtagtggagcggnacagcgagcggatgatggagctgtcntgcaagctgctgggcgtgctctcggaggcgatgngcctggagacggagtccctggccaaggttntgncgtggacatggaccagaaggtggnggtnaacntctacccnntgggntcccnaaanccgagcttaccctgggcagtcaagcgccacacccct

SEQ ID NO: 103118 - DNA, 403 bp, Triticum aestivum
  unsure (1)..(403): unsure at all n locations
  Clone ID: PAT_TA_103118
ngtccggcggggngccaccgncgcggcggcggctgaggagcaacggnggcggngtctccggcggtgcggggccgaggggctcgcctcggtccgagaggaggcggtgggagcggntcatgctcaacggnaacggtcgctactacggngacgacacctncgacgacagccttggngncgactactacgacgccnacgaggagctcgccgcctccgagcccaggnttccgccggtgcancgnctntcgcccagcacggngcccccgcgtncccgncacagtctggcgccnngcaccaccacagcagttgcagcagctggctgcngctgcgnnggntgttncaacanccaccaccatcacnggcngtagcacttgcactggatggggggcttcaattccaagggccc

SEQ ID NO: 103119 - DNA, 430 bp, Triticum aestivum
  unsure (1)..(430): unsure at all n locations
  Clone ID: PAT_TA_103119
ggaagtgcaatctcgatccacatcggccanggccggtatccaggtcgggaacgcgtgctgggagctctactgcctcgagcatggcattcagcctgatggacagatgcctggtgacaagactgttgggggaggtgatgatgctttcaacaccttcttcagtgagactggtgctgggaagcatgtcccccgtgctgtctttgttgatcttgagcccactgtgattgatgaggtgaggactggcacttatngccagctcttccaccctgagcagcttatcagtggcaaggaggatgcagncaacaactttgcccgtggtcactacaccattggcaaggagattgttgacctatgcctggaccgtatcaggaagcttgcagacaactgcactggtcttnagggattcctcgtcttnaacgctnttggaggtggt

SEQ ID NO: 103120 - DNA, 340 bp, Triticum aestivum
  unsure (1)..(340): unsure at all n locations
  Clone ID: PAT_TA_103120
ccttcgaagaacgcagnatccgccgccgtagcattccatggcacccaaggctgctgagaagaagcctgtggagaagacccccgngggcaagaagcccaaggcggagaagaaggtgccggcgtccaaggagggcggcgacaagaaggggaagaagaaggccaagaagagcgtngagacgtacangatctacatcttcaaggtgctcaagcaggtgcacccngacatcggcatctcctccaaggccatgtccatcatgaactccttnatcaacgacatcttcgagaagctngccngcnagtctgncaagctcgccaggtacaacangaagcccaccatcacn

SEQ ID NO: 103121 - DNA, 340 bp, Triticum aestivum
  unsure (1)..(340): unsure at all n locations
  Clone ID: PAT_TA_103121
angtacangaggcaacgtaccgacaagcagcatccgccgaggtgaagagctactacgcgtccgtcagcggctaccacgacgagctgctctgggcggcgctctggctgcaccgcgccaccgggcgggccagctacctcgactacgtggtggacaacgcgcacgagttcggcggcacgggctgggccatcaccgagttcagctgggacgtcaagtacgccggcgtccagatcctcgccacccggctgctgctgcgcggcgagcacgaggagcgccaccgggccacgctcgaggggtaccgcgccaaggcggagcactacgtgtgcgcgtgcatgggcaggan

SEQ ID NO: 103122 - DNA, 671 bp, Triticum aestivum
  unsure (1)..(671): unsure at all n locations
  Clone ID: PAT_TA_103122
aggtgaaggaagcattggtgctgttcnngcggttctggagctctggcatccgtgctgatggacatgtcctctccagcatcgtaggcgtgtttgcagactttgctctcatcgagcaggggagacaagtgcactgctacacggtcaagaacccggccgggctggacgtgtcagtgccaactccctggtcgacatgtaccacaagtgtgggctgaccgacgaggcggagcagcggntctgggagacgcccgaggaggaacgtcgtgtcattggacagngatnantcaacggccttgggaanancggccntggccganaggcattganatgttcgagaaaatgcnaccggaaggcgttgagcctgacgaggtgagctacctggccctnctgtcggcgtgcagccactctggccttgtttaggagtgtcgcccggtatttcttcgatgatcccgccagggacaaaatggcttangcccgangggcaagagcactaccgcgtgcantggtcgaccttctttgggccgcgcnggggagcttaacggaggccagggaccttgttncgaacaatgcccattggagcccacccgtcgggntntgggcagaactntgctgaagcgcctgcagggntgacaaggacgtnaccacacccaangagcggcgagggcctctggcnt

SEQ ID NO: 103123 - DNA, 435 bp, Triticum aestivum
  unsure (1)..(435): unsure at all n locations
  Clone ID: PAT_TA_103123
cattgagcagaaggaggagagccgtgggaacgaggcctatgttgcttcaatcaaggagtaccgnaccaggattgaaactgagctcagcaagatctgtgatggcatcctcaagcttctggactcccaccttgtcccctctgccactgcagcagagtccaaggtgttctatctgaaaatgaagggtgactaccacaggtccttgcggagntcaaggcaggcgctgagaggaaagaacaagcttgagaacactcttgtagcatacaagttaagcccaaggacantcggggnctgnttgactttgccttaccaaccccacccgataagggctttgggaccttgcactttnaaactttnttaagngggttcntaacttttgaagaataccttggaacntttttccaaaacccgggggcctttgngaaancctttgggcca

SEQ ID NO: 103124 - DNA, 443 bp, Triticum aestivum
  unsure (1)..(443): unsure at all n locations
  Clone ID: PAT_TA_103124
catcattagtgcgtcggccacnactgagctcggccatggcgggggcgcagctgcggcgcgtggtggccgtggtcctcctggcctgctgctgcggcatggcgccggcggcgacggcnagggggatgtcngcggggatcgngcacaacatcacgtncttcctcagcggccacccggagtacaagcagtcaaccagtacctgacggagacgcgggtgtgcgacgagatcaacgcncgcgcgggggtcacggtgctngtccttgggnaacggngcccattntncancccttgtgttngaacncccggggcccnaccttgggcggcnattaaaaaacccnctntgcctccacccgcttgcttngattactggnaccgttnaagaaacttttaaagcccnttcccncccggtgccgacacgcttaccnacaacctttttaccaagcccg

SEQ ID NO: 103125 - DNA, 476 bp, Triticum aestivum
  unsure (1)..(476): unsure at all n locations
  Clone ID: PAT_TA_103125
ctgtngccgtgggcccncccgcgttcnccatcggggccgcgccggccgcggagatggagatgaanccgncgctggcnccgccgganccgagccgnggcntgggcggnatcggngaggacagcgacggcgtccgggtggccggcngaggggcgggcgtcggggttccngtggatctncgtntactgcggcagcgccanggggcgcaaggccatgctaccacgacgccngccnttcaancttngaaaangaganctgtgganaggggnannnaccttgncntacggggncngntccantgtccttatggggcctcgnttaccacnccgttcacgccggcaggccgttttagtatgcatctagagggccnnatcatnnaattagnatntgtcaccgnttacattaacgcccttgcccccacattncgatttaaccgaaaaggaangnttttgacaaccttgaagtctaggtccctntnt

SEQ ID NO: 103126 - DNA, 325 bp, Triticum aestivum
  unsure (1)..(325): unsure at all n locations
  Clone ID: PAT_TA_103126
aaagtntgcnaagaggggaagctgaaaccagccaaggtagccgggaagattgttttctgcgaactgggtgtaacggctcaagcagcgaaaggacaagccgtcaagctcgccggtggcgccgnagcaatcctcaccggcgccaaagaagacggcgagcaggtcatcaccagcccccatgtcaccccgncacgggacntttccattntgctgccgccgtnaagattaaaaagtacatacncacgcaaacttcccctacggcgacgatcatnttttcncggtaccgtggtcggctcgacgcctncttccctagaatggcgtctttctc

SEQ ID NO: 103127 - DNA, 489 bp, Triticum aestivum
  unsure (1)..(489): unsure at all n locations
  Clone ID: PAT_TA_103127
tgtggnggaattaagncacccagggccttattgcggcactcgggaaggaactaccggtggtgtccgttngcgagcacctgtntgccgccgtcttctcggtcgtcgcgcgcctgtgtttcggcgacgacatcgatgagggctatctacgcgccatgcgctgcgggatacgagacatccagctcatcgctgttgtggaggccaaaccgnngnctggctccatgatggccaagctcacggggtggagagtgctgcgccagctnttggnctgacacgctcggatgggcgagatattcctccgtcttgtcgccgcacggcgggagtcccgacgtccatgcgacgggggcagccgtcgtccatacgtcgactctctcatcgacctacgcgtccccgatggtgacggtggccgccgtgctgttagggatgacgagttggtgctcctcgtgctggagttccggggcgcccggccgctgggacggtngcagcatgcct

SEQ ID NO: 103128 - DNA, 410 bp, Triticum aestivum
  unsure (1)..(410): unsure at all n locations
  Clone ID: PAT_TA_103128
gcctctggcgacctcgtcccgctttcctatatcgcaggcctggtgaccggtcgggcaaactccgtggccactgctccggatggcagcaaggtaaacgcggcggaggcgttcaagatcgccggcatccagcatggcttctttgagctgcagcccaaggaagggcttgccatggtgaacggcacggcaagtgggctctgggcttgcgtccatggtgcttttcgaggctaatatcctaagcctccttgccgaggttctatcggctgtcttctgcgagggtcattgaacggcaagccggagtacaccgaccacttgacccacaagctgaagcaccaccccggacagattgaggccgnggccatcatggagcacatccttgaaggaagttcctacatggactcgcaaagaagctc

SEQ ID NO: 103129 - DNA, 327 bp, Triticum aestivum
  unsure (1)..(327): unsure at all n locations
  Clone ID: PAT_TA_103129
agccctcaaaagtcacaggatgcacccggcgttggccagaatggnctgagccccaccagnttgagctcgcggacctacctcaagagcgcgagcattagcgcttncaagtgcgtcgctgtcaacccgaataaacagncagagtatgacgacacgatctctgangaaacagaangagccgttgacggactatcgagaaggtttaaagatgcatgcctagtgcagcaacgacgacngaagtcngnaccgnatttntcatttctgtcaggncaccggatgctgatagctgatagcaaagcactgcnagttgnagatggnttacngantgct

SEQ ID NO: 103130 - DNA, 312 bp, Triticum aestivum
  unsure (1)..(312): unsure at all n locations
  Clone ID: PAT_TA_103130
ggacttcgttcgnnaccaacgncaccgcngatggcgggttgttggatcgtctggatgcggggagcgtcaccacgttcagcttctgcaacttccatnccgagtaccgcggcaaaaacctgacggtgatcggcgacgctgacatcaccaagggcgcgctccagatcacgccggacacggtcaacgaggccggccacttctcaccaacaagtgcggcgcgtnctctactactttcacntcaggctctggagactcaagaagggcgngctgggacatgcctgtgccgaangggcnaantcgtactacttccgcacc

SEQ ID NO: 103131 - DNA, 379 bp, Triticum aestivum
  unsure (1)..(379): unsure at all n locations
  Clone ID: PAT_TA_103131
ggaaggccgaaatggctcggtttgctgatgcttttattgccttaccaggcggctatggaaccttggaggagttgcttgaagtgatcacgtgggcacaactaggaatacataagaagccggtcggtctgctgaacgtcgatggattctatgacccactgctgtcgttcatcgacgtggccgtcaacgaaggcttcatnacccagggaggcgaggcagatcattatntcggccccaacagccaaggagctagtcatgaagctggaggactatttcccagagtacnaggtcggcctggtgtgggaagaccagggccagaaaccaagcaacagcctggtcccggagccgctggagacccccgcaatacctcctcctgatcgat

SEQ ID NO: 103132 - DNA, 352 bp, Triticum aestivum
  unsure (1)..(352): unsure at all n locations
  Clone ID: PAT_TA_103132
atgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgcgtcttgnctgnaggaaccctgagnagatcccatgggctgctgctggtgntgagtacgtnntnnannccaccggtgttttcactgccntggncaagattgnagctcacattaaggntggngccaagangggaancatntntgnnccccanacaaaatgctcccatgtttgtctgnggtgtcaatgagaagnantacacc

SEQ ID NO: 103133 - DNA, 385 bp, Triticum aestivum
  Clone ID: PAT_TA_103133
gcccaaggtgaagaaacccaaggtcacggtcgccgacgccgccgcgctcatcgacgccgagaacctcgccgcccacctcgtcgacatctcggcctcgtatgagaaccaggagggcatccagctcatgcgcttcgcggactactttggcagggcgtttgccaacgtgagcgcggcccagttcccgtgggcgaagatgttcaaggagtcacccatgcccaagatggttgatgtacccttgtcccatgttcctgagccagtttgcaagactgcaagtgattggatcacccagagatctcctgatgcattgggagaatttgttttgtggtgtatagatagcatcatgtcttgaattgtcaggtccaactgtgggacctaagggctcgaa

SEQ ID NO: 103134 - DNA, 383 bp, Triticum aestivum
  Clone ID: PAT_TA_103134
gcgcgaggccgaccgtgccgacatattcaaggagcccggcgagagcctgcacgacaagctgctctctgagttcactgaagaaactgaggggactgggctggtgatcaccgggtgggcgccgcagctggagatcctggcgcacggcgccacggcggcattcatgagccactgcggctggaactcgacaatggagagcctgagccacggcaagccgattctggcctggccaatgcactccgaccagccgtgggacgcggagcttctctgcaagtacctcaaggccgggctcctggtgaggccatgggagaagcacagcgaggtgctaccggcggcggccatccaggaggtgatccgaggaggcgatgctcacggacaaagggatg

SEQ ID NO: 103135 - DNA, 422 bp, Triticum aestivum
  Clone ID: PAT_TA_103135
cctcgccaggtgccaagttgcgcgccggcgaccaagccagcccgtcaagtaccaagatgcgcgccggcgaccaagccagcccgccaagttccaagatgcgcgccggcgaccaagccagcccgccaagttccaagtttcgcgccggcgaccaagccagcccgccaagtaccaagtttcgcgccggcgaccaagccagcccgccaagtaccaagatgcgcgccggcgaccaagccaatcaagcagggcaacttgctacaacggacagattagatcgtcttttaagtcaaccagcaaacaaatgttgtgccgactgtggtgctccagatccaaaatgggtatcattaacttttggcgcgttcatctgtatcaagtgttctggagctcatagaagcctcggggtgcacatttctaagatagtctca

SEQ ID NO: 103136 - DNA, 321 bp, Triticum aestivum
  unsure (1)..(321): unsure at all n locations
  Clone ID: PAT_TA_103136
atccaagatgcgacgttctgctcttctccaaagatccacaaggcaagaaagagcattgcctcaccagggttctctccaagcaagctcagtgaatccagcccaggagaagccgatttcgaaacatataggaagagtgcagtgcgttcctccttcaatcgagcaagcttagtcccactgactcgctggcagcaagtntncaacggggcctgcacattatagagtaccatcagcagaatnctccagccccgcgaaaatcgttcgttggcctttcatttgatcattttgcactgaacccccgncagtcagnaaaagcangttnag

SEQ ID NO: 103137 - DNA, 338 bp, Triticum aestivum
  unsure (1)..(338): unsure at all n locations
  Clone ID: PAT_TA_103137
gncgtnttcgtcttcctcctctacctctacgccaagcgcttcttgggggccaaccccatgctcaacggcgccggcgccacctcctngcgcttnatcttcgtcggcgactccccgttcccgcgccgcggcctgccggcctccgtgctccggaccttncccgtcgccgtctacggaggcggcgcctnacccaagacgcccngnggccangggaggaggagcagccgcgacgcnctcgagtgcgcggtgtgcctctcggaggtggccaacggcnanaaggtgcngacgctgctaagtgcgaccaccgtttcacgtcnctgaatcgactttggttccattcc

SEQ ID NO: 103138 - DNA, 305 bp, Triticum aestivum
  unsure (1)..(305): unsure at all n locations
  Clone ID: PAT_TA_103138
ctcgccgtcngccatgggcngcgactggcaagagctggcccagtcggcggccatcggcctcatcttcgccttcctcgtcgccaagctcatctccgtcgtcctcgccttcaaggaggacaacctncgcatcacccgctcgccccgaaccccgcccccttgnccgacgccaccgnccccgcgctcgacggcggcacgagcggcggcgacagcgacagcgacggcgactgggagggcgtggagagcacggagctcgacgaggacttcagcgccgctccgcttctcgcgctccgcgcggcgtcccgagg

SEQ ID NO: 103139 - DNA, 313 bp, Triticum aestivum
  Clone ID: PAT_TA_103139
tttagaaagagaaatgctgaagtccgacagaagttacatactggactgtggaactgaaatattcttgtggatagggatgacaacactagtttcagagaagaagacatctgctaccgcattagaggagtacgtacacttacaaggcagatcatcaattgccgcactgttataatgactgaaggtcatgaaattgtcgattttaagctgcattttcagcattggcctaagaatgttgtgcagaagttgtacgaggcagggcggcagaaagtggcagcaattttcaagcatcagggatatgatgttgcagaaattc

SEQ ID NO: 103140 - DNA, 364 bp, Triticum aestivum
  unsure (1)..(364): unsure at all n locations
  Clone ID: PAT_TA_103140
cgcgccctccaactccaaggcccccgcggcggcgcctccggctgccgctccagccgcggccacgacgacgacgccgcgcaagttccccatgcggttcttccggcgtagcgaccgcggcagccggtgcatggcgttcctcgacctcctgctgaggatcgcggcgttcgggcccgcgcttgcgggngggcattggcaccggcacgtccgacagacctntccgtnttaccgagttcttcagttcgcgcccgtttcgacgacttccggcttctgttcctcatggtggcgagtgcgatcgccgcggggtacctgccttatcgctccgttctccgccgtcgtcgtgctgcggctaaacaccgtctgaggt

SEQ ID NO: 103141 - DNA, 378 bp, Triticum aestivum
  unsure (1)..(378): unsure at all n locations
  Clone ID: PAT_TA_103141
atgggtatcgacctcgttgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgancaagancaacccccccgccgttttcattgcgccgcctttccaactttatgaagggaaaggaggagaagaacattgctgtggttgttggtacaatcacaaatgacatgcggatccaagaggtcccagcaatgaaggntaccgctctgaggttcacaganacagcgagggcaaggattgtcaatgctggtggggagtgcctcacttttgaccagct

SEQ ID NO: 103142 - DNA, 326 bp, Triticum aestivum
  unsure (1)..(326): unsure at all n locations
  Clone ID: PAT_TA_103142
atcggcacggncggncgcaggggtccgaggacaaggactacaaggagcccccgccggcgccgctgttcgagcccggcgagctcaagtcctggtccttctaccgcgccggcatcgccgagttcatggccaccttcctcttcctctacgtcaccatcctcaccgtgatgggctacagcggcgccacctccaagtgcgccagcgtcggcatccagggcatcgcctggtccttcggcggcatgatcttcgccctcgtctactgcaccgccggcatcttcgggcgggcacatcaacccgggcgggngacctttttncggggggggggnctt

SEQ ID NO: 103143 - DNA, 472 bp, Triticum aestivum
  unsure (1)..(472): unsure at all n locations
  Clone ID: PAT_TA_103143
ccgctactcccctgcctcccccagagctcgttagggttttctcttttttcgggggagaaatctcnngaggcggcaccatgctcgtgtaccaggacaagctttccggcgacgagcttctgtcggattcgttcccttacagggagctgganaacggcgtgctctgggaagtcgatggccattgggtcgttcaaggagcanttgatgtggacattggagccaatcctctgcnnanggtgggtggtgatnaataagggggtttatnaccaagccnttgaaggnggttgacattgntgacaccctncgtcttnaggancaacctgcttttnacaaaaaacattttatctctcaaatgaagcgctacatcaaaaacctttctcccaacnttnannggggatgaacctatattctttcaaaaaanaatgttgagtcccncaccaaantatctttnttagcaggtcaaaggccttcagtt

SEQ ID NO: 103144 - DNA, 612 bp, Triticum aestivum
  unsure (1)..(612): unsure at all n locations
  Clone ID: PAT_TA_103144
cggggaatacgacgctgccatcatcagccgtggcgcnaccatggacggagaacatctcgcggatggntccgnccaggctcagattggaagcataccgcttagacggcccaaggctcgattttttgcccttctacggacaaggcaggggcgatggtaagatcctctcaatggactcggcgggcaacaccgtcctctgcaacgccgtcagcggctccatccagcccgttccctgccttaaccaacccaaagggggacaagccccgctccttgtctatcactcgtgcngacacctnccatcaagccttgtacgttatggacaggtttcccgcagctcgcaatgctttcatcttcgaagccctcatctacggcaagaatagctgggagtggcaccggctccctnggccgccctacgtcaacaacccancctataactgcacagccatccagtctacatgttgcttgggtgaatggctcgaccatntgcatattcttcgntngggcaancttcattnggcacctactggtttgataccgntagctgcncntgggaaaaaggtnggccgnttggaccttgncatttcattggacangctganccttttccttaacntt

SEQ ID NO: 103145 - DNA, 469 bp, Triticum aestivum
  unsure (1)..(469): unsure at all n locations
  Clone ID: PAT_TA_103145
cacgaattctatgtcatgctgtccggcaagactgctgacatgcattggctttttgacatacatngntgtatttctatcagggttaactagcncgtatgagatagtgacacacaagagtcatgatgtcatagtattcactattcaggtctatgagcactaaaaaggttgtaattctgtgttgtcttttttgtctttaataactttataaatgccaacgccatcttttgacttttcggatggtcagcgccgccataaactctataaccagtaaaagatcagacgagactgaacttcacaaggtctgcgtgtcagagatgatcaaacatactccctccattcctaaatataagtctttagagattccaatatggactagatacnggatgtatatagacacagtttaagagtgtagattcactcattttgctcccgtatgtaagccatattggggatctctaaaaagacttat

SEQ ID NO: 103146 - DNA, 384 bp, Triticum aestivum
  unsure (1)..(384): unsure at all n locations
  Clone ID: PAT_TA_103146
tccctcctcggcggcttcctctccgactcctacctcggctgcttctggaccatgctcaccttcggcttcgtcgagctatcgggcttcatactactgtcagtgcaagcacaccttccgcagctgaagccgccgccgtgcaacatggcgttcattggacggcagcttgcgagcaggccaggggcttcaagtccagcatcttnttcgtcgcgctctacctggtggcgctcggcagcggctgcctnaagcccaacatgatcgcgcacggnggngaccagttctncggntncgacaatgccaanagtctttccacctactttaactncgcctacttcagcttctgccttggcgagcttngtngcgctcacagcgcttngtntgggtgcn

SEQ ID NO: 103147 - DNA, 345 bp, Triticum aestivum
  unsure (1)..(345): unsure at all n locations
  Clone ID: PAT_TA_103147
cagagagtgctagggttttctgtccgggcggcggcgatgtcgatggcggcggcggcgagggcggcggcgcgggccccgggcagggcggcggcgcggttngtgcanaccaggctccgctnctccggcaaggtgctcagcgaggaggagagggccgnctagaacgttttccttnaagaaaaatgnntcnaatanaagcgngagaagctcgcacgcatggggtcccagcnctggagagcaagctncnttcaccccaagcgcttggancgggtgacgtgaacaccgcangcgccggttnanccacgtnggcattcncagtaggcacgttgaccgacaagaacaggaact

SEQ ID NO: 103148 - DNA, 362 bp, Triticum aestivum
  unsure (1)..(362): unsure at all n locations
  Clone ID: PAT_TA_103148
ccgggggtcagcggatacatcgncgccgagaagagcaaggttgttgagcagttgcagtcaggcagcgcgtccagcaagaagaacctgcgaaccgagctgcccgccgtcggggatcccgacggagtcataaacgagctnnaggcgctcaaagacaaggatgttgagatngcaagggcaaantgcnnccggcnccgtttatatcgctgggagcgagtctgaaggccatttttnacttataaacaaggcctactctatgtttncacacacaaanccactgnntcanngatgtttcaagaagtgtggcacangttanaggcttganagttngtagcaatgacagcttgtttttgctttggagcaaa

SEQ ID NO: 103149 - DNA, 421 bp, Triticum aestivum
  unsure (1)..(421): unsure at all n locations
  Clone ID: PAT_TA_103149
agctccatgcttaagatggccgccattttcacgctggccctgttcgctgcacagctgctaatggccacgccgacggcggcgtcagcaagcgtctgctatcagacagcgtataagtggtgcatcgggagcgctaatcctattttcaagtgctgtctactgcgaaactgaggctttcaagatttgtcagtactgtccgtgaggcatggcaaagaggaagaggaatacaacacatgcacctcacccgggtgccgactatctttcctcgtttattagctttatgacttgtgagaggccccgtattttctttcctttacttccatttatcatgnggcagttgcttnacaangnattttgccttctttggggtcaacatgttactgtggttgtccaaagaatncctcgaataaactgtccttnattt

SEQ ID NO: 103150 - DNA, 374 bp, Triticum aestivum
  unsure (1)..(374): unsure at all n locations
  Clone ID: PAT_TA_103150
caataaagacggaggtgccaaccatcgtcacaagttaacaaatcacccatgtgtagaccgtaatgctcaaaataaanaagctcgccagatgcctattcagcaggcaccggngaatgcttgaccttttnggcccttgcccataaatgtccaccgctgggttgccagtatcctgattgccgaanacttaagggactnttcggtcatgcaacgaggtgccaaaaacgggcagcccggagggcttgtcactttgcnaangacggggnctttgntcanctncttcccgaactttgcaaagaatcaaagtgtccatnccgagatgcaggggatctcaaagcccatttaagggggaccagcaccagtcccaatccagaagg

SEQ ID NO: 103151 - DNA, 299 bp, Triticum aestivum
  unsure (1)..(299): unsure at all n locations
  Clone ID: PAT_TA_103151
cgcgccatccccaaggcggcgtgggaggacatcttcccctggttcgccaaggccggcgccgggttcatcctgctggagccccacggcaggttcatgagcggcgtcccctgttgaaataagccacggcgtgtgtggtcgggctcgtcgggcgcgacggatgcgcgcgggacgggcgggacncactggtgccatcgggcttgtcgagctcgtcgggcgcgttggtgacgtgcgggacgggcaggacgtgcgggacgcaatagcgtggcgtgtgtgtgtttaggtttggatgggtcgccggn

SEQ ID NO: 103152 - DNA, 401 bp, Triticum aestivum
  unsure (1)..(401): unsure at all n locations
  Clone ID: PAT_TA_103152
ggcctcatcggcgaggtcatcagccgcttcgagaagaagggcttctacctcaaaggtttgaagctccagaacgtggagaagtcgttcgccgagcagcactacgccgatctgtcctcaagcccttcttcgctgggctcgtggagtacatcgtctccggcccggtcgtcgctatggtctgggagggcaagagcgtcgtctccactggacgcaagatcattggcgccaccaaccccctggcctntgagcccggcaccatccgtggtgacttcccgtcgacattggnaggaacgtnatncatgggaaccaattaattganaatcccagaaaggaaatcncctggnggttccttggggcnttgccaatggaggaccacccncccaacttggttttcaaggcttaaa

SEQ ID NO: 103153 - DNA, 249 bp, Triticum aestivum
  unsure (1)..(249): unsure at all n locations
  Clone ID: PAT_TA_103153
cccccacccccctctcgnggcgcggnacagcacggaggagtcggcgggagatgtcgggcgtgacggcggatgaagacaagaacccgnggcgacgcggagccccacatcaacctcaagtcaagggcagatgcaatgagttttcttccctcaagnatcgacacactgaaaactgtgaaccctctgcacctcnttgtgattcactcctgcttctttcatgtctagctctggacaacctagactgaatgagag

SEQ ID NO: 103154 - DNA, 318 bp, Triticum aestivum
  unsure (1)..(318): unsure at all n locations
  Clone ID: PAT_TA_103154
cccccaaggttnggnttgggggttggggggnaaaaaatttttcccccggcccaaccttggtgggnccccggcccggccanaccccggccantntccatggggggcggcngttaccaaangtttcggtggtcggggaggcctatnggaaggaaggaancantcgggacngtgnatngaagttcgtgcancgcgtgcnttgctgggantacagcacaccgccatngtgcctacagccacccccaaggcacccttcgtcagcacaggtttgttacttcntagctgtgcaganagcagccagttgtttgtaccaccagttan

SEQ ID NO: 103155 - DNA, 378 bp, Triticum aestivum
  unsure (1)..(378): unsure at all n locations
  Clone ID: PAT_TA_103155
cctgcaaagggattcagcccaccgccntttgggaangggaacttcnaggngcccggncangnactttnggccgganccgcttaaccaaatggcaacggccctttgggggcccaagccccccttaacgtggggttcggggccggccggcnggccccaggccctncncaatgctaacttggganttnttaactttaanaagggcgtttcaattcattaaattncgggcacaaccggnaaacttttnnncgcccccctttggncttttttttaaaaacccaaaacnncncaaagnaaccnaaatttttnttgaaaataaaaaacggggtttccttcttnnntnacttaaggggttggaaaattaacttattncgcccaaaa

SEQ ID NO: 103156 - DNA, 255 bp, Triticum aestivum
  unsure (1)..(255): unsure at all n locations
  Clone ID: PAT_TA_103156
caaaaactcaaaaaaaaatactagaaaaattcaaaaaattccaaacttttttgtggggggtagataattgaacgcgtgaggtaccccccaaaattcaactcatttggacacgggagttacagaaacctacaaaatagcaaattgcatgctcatttttgaaacccaatattttgttaatgcttaggggttctggtacaatgctacttgattactctaanttatagtttgtaatnactcancccncgcctnagttnt

SEQ ID NO: 103157 - DNA, 330 bp, Triticum aestivum
  unsure (1)..(330): unsure at all n locations
  Clone ID: PAT_TA_103157
ncgtattncaacgcgcgctcttctcgctttcgtctacccaaggacggagggtctngcccggcgacatgggctccctnaaatcgcgccncctttttttcttncttttggtggccctccccgggggggaaaaaacttcttttttaacacccggggtttcaaaccttnggngncccccaaaaaaagggntnaaagnccccccaattnaaaaaaatttttngggncntttggggcgnccctttggcgnaaanaaatttttttttnaaanattttttttcaaacnncccnaaaactttttttttnggggccccttttttaaaaaaaaaccaaaag

SEQ ID NO: 103158 - DNA, 288 bp, Triticum aestivum
  unsure (1)..(288): unsure at all n locations
  Clone ID: PAT_TA_103158
cgctcgcgctcgcctccgtcgccgcggtctccgcccgacgtcttcttccagganaaggttcgaannatggttgggaaaacccggtgggtcaagtctgagttggaaanaagggatgaaaaacatggctggtgaaatggaaaccncacatctggaaaaatggcatggagaatgctgnggacaaaggtatccaacctcaaggactacaggtttaccccnttcggcgggtacccnggttcacaccaggacanaactntgctcntttacgngaancngaacgaactgatcgtg

SEQ ID NO: 103159 - DNA, 299 bp, Triticum aestivum
  unsure (1)..(299): unsure at all n locations
  Clone ID: PAT_TA_103159
cggctccccaagacgttcgccaactncgtgcaggcgtacgtgcacgtccgcggagaccgccgccgcgcacgtcctcgtcttccagtcccccgccgccgccgggcgctacctntgcgtggccgacggggccgtgctncaccgggaggacgtcgtcaccatcctncgcaagttcttncccgagtactccatncccagcaagtgctcttacgaggtgaacccncagganaaanccgtacaanaanttgaaccancggcttcttgagctgggcctcgagttcacgccggtggggcantgcctc

SEQ ID NO: 103160 - DNA, 225 bp, Triticum aestivum
  unsure (1)..(225): unsure at all n locations
  Clone ID: PAT_TA_103160
ccggcctgcanatcggtcganctatntacctctcaccaagaaatttgaacanggcggccggtctgcagtgttcgggccccgcgtcgactgactggcccggtgctcactgcctttcaganaactnattcggctctcnctgaccctcagaggaccaacgccngtataactaggatctacgcnggactnactgtgaagactgtgataggcaatccgtcttcccatccg

SEQ ID NO: 103161 - DNA, 244 bp, Triticum aestivum
  unsure (1)..(244): unsure at all n locations
  Clone ID: PAT_TA_103161
cgagtagnagagaacgcggcgaatatgtgtcctgaactcanaaagcgggcctcnaantcctcaaatgcgcncggcaagtctgctcgncccaatgagtcaacgagatctcatgccaactccgcaaacattcganctgtaaagatgttcatcatcagaacctcaaaanncattcagtctgtgcaggaggcnatgagccaacaaaggcctcctctgatttgtagcgtagggtccaggagctagctcc

SEQ ID NO: 103162 - DNA, 300 bp, Triticum aestivum
  unsure (1)..(300): unsure at all n locations
  Clone ID: PAT_TA_103162
cgagtgtcggcgagcggcgccggggtgttgcacgtgctgaagctcacgggacttngccaaggaggaccactacatggtcggccggtacgacgacgaggcgggacaccttcgtgccggcgggagcccgagcgcggcgacgatcccggcaactggcgccggctcgaccacggccacctntacgcgtccaaatccttntacnaancccgcaaaaaggcggcccttctttggccttgggtgganaaaaacaacggcggcggcgtcccaggggctgggcgggcattcangcgttcccgagggcga

SEQ ID NO: 103163 - DNA, 344 bp, Triticum aestivum
  unsure (1)..(344): unsure at all n locations
  Clone ID: PAT_TA_103163
cggcgttccagctcgagaaggtcaagcgtatgttgccggcgttttcttcatgctgngaagacattgttagcagatggaggaccgtccctaggctcgaagggttcatgcgagctggacgtttggccggagctcaagaacctgacgggggatgttatttctcgcaccgcattcagcagcagctacctcgaggggaggaagatctttcagctacaggaggaacaagcttanccccttantaacnaacattcgggggcttctcattcccggctacttgttcttgccaaccagaaacaacagaaggatgcatcaaatcaacaaggagatcgaatcgattctgaaaaatc

SEQ ID NO: 103164 - DNA, 342 bp, Triticum aestivum
  unsure (1)..(342): unsure at all n locations
  Clone ID: PAT_TA_103164
ncttccgtctcccggatttcgccgcnnccgcagccgcagcagctcgccgcccacgcctcctacccgtcgacgagatggtacgctgcttctattcttcgtccctcctttcatacaaacacccaaaacatgtttcctttgctgattctccgcgtagatctgcggaatactgtagaaattgttcctttcagaggatccctggttacgtattcttggtggatttgtttccgncanaatcctantgngtgcttgatgctaaatcgcaaggcctagccgtgtcaaagtcgagcaccatcgaatcctnttggtccatttgcgttatatncttcggntgcctgccaatnn

SEQ ID NO: 103165 - DNA, 341 bp, Triticum aestivum
  unsure (1)..(341): unsure at all n locations
  Clone ID: PAT_TA_103165
cgtgctcgtcgccgtttccatcttcgtggccatccactcgctgcggcagcggcgctcgctgggcctcccgtcgtggccggtggtcggcatgctcccgtccctcctnctnggcgtccggggcgacatgtacgagtggatcacgggcgtcctnaaggcgcgcggcggcacgttcacgttctgcgggccgtggttcaccaacctgcactgcgtggtcaccgccacccgnnggaacttgaagcacctgctcaagaccaagttcggcaacttcccaagggcccctacttccgngacaccgtgcgcgacctnctnggngacggcatcttcggggccgacnacnaggt

SEQ ID NO: 103166 - DNA, 343 bp, Triticum aestivum
  unsure (1)..(343): unsure at all n locations
  Clone ID: PAT_TA_103166
ncgccaggatgctccgccgcgccgccncctccgccgccacggcgctccttcgccgggccctctccaactcgccacggccacgctcctccgccgcggccaccgcagtcgcgtcctcctcggccgtgaactccatcctcctccgctccctcaaggagcactacctcgaggtctccaaaatgacgcccccgcccaagatcagcccgcccaagccctacaacattgtcaaagggcgccctggaccagacctcgggccccgtgctccgccgcagctacggcgaggccggcgaggagatctccatctccgtcgcaggctctccaacatcatgccccccggtgccgactc

SEQ ID NO: 103167 - DNA, 343 bp, Triticum aestivum
  unsure (1)..(343): unsure at all n locations
  Clone ID: PAT_TA_103167
ccaatctctagcttgttgcgaatttggagagctagagcaaccaaattagctgctgnaacaataagcttccgcccatgaggtncccctcttcagtgtttgcgtgggctgcggcggtgctgctcgccgtggccgccttctctgcgatggcggacgcgtcgcctccgccgtcaaagtttctgaaggttgggttctacaagcacacgtgcccacaggccgagtacatngtgctgaacgccgtccgccgcgccttcgcccgcaacccaggcctcgccggtggcatcatccgcatgcatttccacgactgtttcgtcaggggttgcgatggctcgctgctgatcaactn

SEQ ID NO: 103168 - DNA, 345 bp, Triticum aestivum
  Clone ID: PAT_TA_103168
cgaacgctccgggcctctctctgtttgctctcgcgtccgccgcgcccgtcccgtgccgcctgcgcccgcgcgtgtgctcgctcgccgcctccgatccaccggcccaccaccgcgccggcggcatggcggatcagctcaccgacgaccagatcgccgagttcaaggaggccttcagcctcttcgacaaggacggagatggttgcatcaccaccaaggagctgggaacaagtatgcgtttcgctggggcagaacccaacggaggctgagctccaggacatgatcaatgaagtcgacgctgatggcaacggcaccattgacttcccagagttcctcaacctgatggcc

SEQ ID NO: 103169 - DNA, 330 bp, Triticum aestivum
  unsure (1)..(330): unsure at all n locations
  Clone ID: PAT_TA_103169
cctgcaaaggattcagcccaccgccnnttgggaagggagcttcgaggcggccgnccgcggcacttcggccggaccggcttagccaatggcacgggcccttgggggcgcaagcgcccctaacgtgggtcggggcgggcggcgggcgcaggcgtcgcatgctagcttggattctgacttagaggcgttcagtcataatccggcacacggtagctttcgcgccactggcttttcaaccaagcgcgatgaccaattgtgtgaatcaacggttcctctcgtactaggttgaattactatcgcgacactgtcatcagtagggtaaaactaacctgt

SEQ ID NO: 103170 - DNA, 501 bp, Triticum aestivum
  Clone ID: PAT_TA_103170
cccccatccaccttcctccgccaccccaccactgcaacccgcaagccggaccagcccagcctccttccgccagtgcggcccgccccgccgagctccacctcgctggcgcctagatccggcgaggcccaaggcatccccagccacatggagtcccggggacgggtccgatccggcaaccaccaccgaacattgcttcccggcaatggatctgggtcagcaaccacccccctgcgcggccacgacccgcacatcttcccttgcatctcccacatcccgaacacacccgcacctcccacccccgcaccatccatggtaatcccctccaccttcttccgccactgcctcggccggtagccaaatctccggggattccctctactttcttctgacccggcaggccactgccttgcccatgcccagtacgccacgctccactgccaatggaacccaccttcggatccggtgatccccggcgacgcgaatcgcaaaccaccgcttttg

SEQ ID NO: 103171 - DNA, 438 bp, Triticum aestivum
  unsure (1)..(438): unsure at all n locations
  Clone ID: PAT_TA_103171
cggactccctcttcctccgcgccctaatctccgtcgtaaacggagacgccgtcgttcccacgctgcacctcgagccgtcgtccacgccgcacattgccgctgcagttccggcctgcgccagctgcggcgtggacgggtgcatcggctgcatgttcgttgctgcggcggcgccggccggctcgagcagcgaggggcnaaggatgctccgccgcgagctttgtgaagggcggcggcgtggggaagatcacgcggaggaggagctggagcaagttcaggggcgtgaggcagcgctcgtgggggaagtgggcggcggagatccgcgacccgcaccgcgccgtgcgcaagtggctcggcaccttcgacaccgccgtggatgccgcccgcgcctacgatctcgcggcgctcgagttccgtggccaccgcgccagactcaacttn

SEQ ID NO: 103172 - DNA, 491 bp, Triticum aestivum
  Clone ID: PAT_TA_103172
ctggggccccggtgtggtggtggcgacgcggcggcgacccgtgcacacgatgcttgatggaggttccttcaccggatccgggtgaaaacctagttctcggcttgatgccaagaccggcgttggcggcactcttttgtgtgattaccttcttgaaggcatcgccgtggagaagctccagacctctatccgctacctccggggaaaatcctagatcagtagatcagatgacggtggcgcgttggtgtcgttttcttcttgggggcgtcattcttggaggcgtacacgggttcgagggaccagtgagcggtttttttggtggagcggtgcttcatcctgcacattgatgacggcggatctcggcggcgtggcgcaattggagactcggcgcccgatgcgtggtgctggactcgcgcaggagggggttgctgtctggcgtcatgatggcgtcgatggcagagaggcctaacaaggatagaagcctcaatatctgt

SEQ ID NO: 103173 - DNA, 436 bp, Triticum aestivum
  Clone ID: PAT_TA_103173
cgtggcctctcacctgaattgaatagcttagatcaaattaaggatattgagaggcctgttgaaattcctgactatggtcttctatgtgatttgctttggtctgatcctagttctgacacacaagggtggggggagagtgacagaggtgttgcttgtactttcggtgcggataagcttgtagaatttttggaaaaagaatgatcttgacctcatttgccgagctcaccaggtggtagaggatggctatgagttctttgcagaaaggagattagtcaccatcttttcagctccaaactactgtggagaatttgataatgcgggtgctttgttaagcatagatgaaagcttaatgtgttctttccagatcttgaagccaaaagaaacaggagcaccacattcaagaaaaccaatttcaaacaaggcaccgacagtggac

SEQ ID NO: 103174 - DNA, 390 bp, Triticum aestivum
  unsure (1)..(390): unsure at all n locations
  Clone ID: PAT_TA_103174
gctcttcatggagctgccggcggcgccggaggagatcccggcggcgtgcaggagcgccgcgccggagtatgcgcggctggtgcagcaggggctgggcgccacgctgctggggctgctgccggaggcgctgggcctccgccccggccacctggaggaggagcacgggtgccttggaacgggatcagcctcgcctgccactactacccggcctgcccggagccgcagctcaccctcggcaccccgcggcactccgacgccgacttcctcaccgtgctcctccaggactccgtcggcggcctccagattctcgtcgacctcnaggccgaggacggcggagaacggaagcggccggtgtgggtggacgtgccgccggtggcgggggcgctggtg

SEQ ID NO: 103175 - DNA, 510 bp, Triticum aestivum
  unsure (1)..(510): unsure at all n locations
  Clone ID: PAT_TA_103175
ttccccaccagcaccttccggcnaaacacagcacctctccccggcgaagcagcngcgtccaatggcccccaaggcggagaagaagccggctgccgcggagaagaccccggcggccgagaagaccacggccgggaagaagcccaaggccgagaagcggcccccgaagtccaaaggagggcggcgctgacaagaagaagaagaaggccaagaagagcgtggagacgtacaagatctacatcttcaaggtgctgaagcaggtgcacccggacatcggcatctcctccaaggccatgtccatcatgaactncttcatcaacgacatcttcgagaagctcgccggcgagtccgccaagctcgcccgctacaacaagaagccaaccatcacgtncagggagatccagacctncgtacgcctcgttctccccggcgagctngccaagcacgcagtgtccnagggcaccaagccgtcaccaagttcacctnctcctagaccacgatggttctctgtaa

SEQ ID NO: 103176 - DNA, 481 bp, Triticum aestivum
  unsure (1)..(481): unsure at all n locations
  Clone ID: PAT_TA_103176
gatctccagcccagccaaacttttctcaccttcgaagaagaagcagcagcatccatggcccccaaggctgctgagaagaagccagtggagaagacccccgcgggcaagaagcccaaggcggagaagaaggtgccggcgtccaaggagggcggcgacaagaaggggaagaagaaggccaagaaaagcgtggagacgtacaagatctacatcttcaaggtgctcaagcaggtgcaccccgacgtcggcatctcctccaaggccatgtccatcatgaactccttcatcaacgacatctttgagaagctcgctggtgagtccgccaagctcgcgcgctacaacaagaagcccaccatcacgtcccgcgagatccagaccttcgtccgccttgttcttcctngngagntttccaannacacnctgtttnnagngggcnccaaggccgtcaccaagttcacctngtcctaggctcctcgtcattagt

SEQ ID NO: 103177 - DNA, 478 bp, Triticum aestivum
  unsure (1)..(478): unsure at all n locations
  Clone ID: PAT_TA_103177
atggtgagaaggtggattcgatttcttggaaaagatgaagctctaaaattgatgaattggaataacagtgacccttatttcagtttaagggtgaatacaacaaatggctatacaagggatgatcttgttaaccgattggaagatttgcaggttcactatgaaaagtcaattatggacgaatttgttcgcattcgtgaggggcatgcaggcagtcttcaagctggattactgaaagaaggcatgtgtgccgtgcaggatgagagtgcaggttttgttgtgtctgtcgtcgatccacaacctggggaaacaatcatggattgttgcgctgcacctggcgggaagactttcttcatggcatcccggctggcaggacaagggaaggttcggctcttgacataaacaaaggccgcttgcnaattctcatggangcagcaaaatgccacaatcttgatgatataatcactgatatccatggtgn

SEQ ID NO: 103178 - DNA, 481 bp, Triticum aestivum
  unsure (1)..(481): unsure at all n locations
  Clone ID: PAT_TA_103178
ctgcaaaggattcagcccaccgcccgttgggaagggagcttcgaggcggccggccgcggcacgtcggccggaccggcttagccaatggcacgggcccttgggggcgcaagcgcccctaacgtgggtcggggcgggcggcgggcgcaggcgtcgcatgctagcttggattctgacttagaggcgttcagtcataaatccggcacacggtagcttcgcgccactggcttttcaaccaagcgcgatgaccaattgtgtgaatcaacggttcctctcgtactaggttgaattactatcgcgacactgtcatcagtagggtaaaactaacctgtctcacgacggtctaaacccagctcacgttccctattggtgggtgaacaatccaacacttggtgaattctgcttcacaatgataggaagagcccgacatcgaaggatcaaaaagcaacgtcnctatgaacgcttggctgncacaagccagttn

SEQ ID NO: 103179 - DNA, 426 bp, Triticum aestivum
  unsure (1)..(426): unsure at all n locations
  Clone ID: PAT_TA_103179
gccgccgccgcaagccgtccgcctcgctcttctcccgagcctggtcctcatcctntcgcctctcctccccaacacagatttaacaatctagagttagcgcctccgtccgtctcgtagctgctcagatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactcggagaagaccggcaacaaggacttccttgagctcagcaacctcctcgtcggtaacgttggcctnatcttcaccaagggtgacctcaaggagg

SEQ ID NO: 103180 - DNA, 524 bp, Triticum aestivum
  unsure (1)..(524): unsure at all n locations
  Clone ID: PAT_TA_103180
cgaattccagcacatccttccttcttccaagtaccgggccggctagttgaggaggaaagatcgatagacctggtactacttgaatatacacattaatggcggcggcgagtaggagcgcgccggagtggtggcgagatgggggaagcgtcgacgacgggggagcggaggtcgaactgagccttacggcttcggaccgggagcagcagcacggcgaggaggagcatgaccatattctacaatggccgggtggtcgccgtcgacgtcaccgagctccaggcaagggaaatcataaccatggcgagccaacaaattctgaccgagcagcaggacagcggcggcggcggcggcggcactgcagtggcacagtacggagctcatgagaatccaagccagccggcgccgcaacgttgggctccattgctggcttcacgttcgcttctcagggacangggctgctgcgccggtcaccagccaagcggccgctcgagcatgcatctagagggccgcatcatttnattagttat

SEQ ID NO: 103181 - DNA, 298 bp, Triticum aestivum
  unsure (1)..(298): unsure at all n locations
  Clone ID: PAT_TA_103181
ctcctcccgccgcccgtccgccccacccgccgccatggcccgccgcagcggaggaggaaggtngttcccgccctgctccacgtgctgctccagtgagaaacccaccagcgccagcccgtccagctcctccacctgctaccacccagagcagcggtggtggtatnatgagcgggattgggtccaccaattnnttcaagggcattggcttttcggtactggaagtgccatggcncacagggctgttgatgctgtgatgggtcccngtaccattcagcatganactgttgttggtgaggct

SEQ ID NO: 103182 - DNA, 295 bp, Triticum aestivum
  unsure (1)..(295): unsure at all n locations
  Clone ID: PAT_TA_103182
ccggcggtgtacctgagggcctttgtccagganacggaccgcggagcgtcgctgctgcgcgangaggaggcctcgcgcctgctcttccctncctcctctagccccgaggaggcgtcgccnaggctcccgcatctncngaaggcgccgtcgctgtcggagatggccacccttcttaccagcagctttaanttttaacaaaaancatcggnccgtnncatttttcnaaantnttggngaaacaggcctgcaaactgcnttactgtatttccngaaggcccanttncantatncnaaa

SEQ ID NO: 103183 - DNA, 409 bp, Triticum aestivum
  unsure (1)..(409): unsure at all n locations
  Clone ID: PAT_TA_103183
cccaaacatcatctcctccacctctcaaccaagccaaggccaagagcccagtgaagcagcggccatggagggcaaggaggaggacgtgcggctgggcgcgaaccgctactcggagcaccagcccatcggcacggcggcgcagggcggcggcgcggacgagaaggactacaaggagccgcccccggcccccttnttcgaggccggggagctcacctcctggtccttctaccgggcggggatcgccgagttcctggccaccttcctcttcctctacatctcggtgctcaccgtgatgggcgtggtgggcaacccgtccgggtccaagtgcggcacggtcggcatccagggcatcgcctggagcttnggcggcatgatcttcgtgctcgtctactgcaccgccngcatntct

SEQ ID NO: 103184 - DNA, 349 bp, Triticum aestivum
  unsure (1)..(349): unsure at all n locations
  Clone ID: PAT_TA_103184
cgtcgaggacgacggcgcggcgagctacaacttcgcgtncgtggacgcggacaagcccaannacgtgcgctaccacgagcagctgctgaagctggtccgcgtcggcggcactatcatctacgacaacacgctctggggcggcacggtggcgctgccggcgggcacccccatgtccgacctcnacacccgctttttcgncgcctaagggacctcaacgccaagctcgccgncgacccgcgcatcgaggtctgccagctcgccatcgccgacggagtcaccatctgccgccgcatcgtctaggcgggcgggcgtcggcccggcccggcgtgatcgtnatccgcgcgcgcct

SEQ ID NO: 103185 - DNA, 356 bp, Triticum aestivum
  unsure (1)..(356): unsure at all n locations
  Clone ID: PAT_TA_103185
ccatcctactgattaacagccaagcttcttctactgctagtctgaaggcagtggttactgctagtatcactatcgtgagttgccgactatttgtcaatggcggccttcgcaaagatcgccatggagtgcgtgcacgatcccctcatctggctacttattgcgtcggtggccttggtcatcctgcgaagacggcggctgaacccgccgctccctccgggccccaagccgctgccgatcatcggcaacatgatgatggcggaccagctgactcaccgtggcctggcggcgctggcgaagcagtacggcgggttgctgcacctccgnctgggctcgctccgcgtcttcgcggtgtcgac

SEQ ID NO: 103186 - DNA, 358 bp, Triticum aestivum
  unsure (1)..(358): unsure at all n locations
  Clone ID: PAT_TA_103186
ccactaccagaaccctttaatttaagggaggagctatatcttgatgcactgnntnatggccattctgctgaaggagttcnngaattttcctcggaaaaaggattttcaaatgcttctcacttcccacaatcttttcaaaaactaatgtcccagaagagtattactaaagttactgaaaagactcgactactttctgatccagtagaagtgacctccctgggngctgatgataccggaggtccagatagaagctctaacaagcatgtctcanttccagtcaataccaatatttctgatactccaagccgccattcgatctctttctgtgaaaacagtacaccaaagcaagtcatctcat

SEQ ID NO: 103187 - DNA, 357 bp, Triticum aestivum
  unsure (1)..(357): unsure at all n locations
  Clone ID: PAT_TA_103187
catgctttgtctctgtccctntctacacgggattcctccccctnctcttctggngtggacatggcaagctggctaggcanatgaccctgctgntggccttctgcgattacctgggcaacgctgncaaggattnagtgtcagctcctcggccgtgttcccctcccgtgaggagagtcacagctaccgaagatgagaaggaaaatgccatggaatatggactgccttcatcgcacgctctcaacaccgtttgtttgangggatacatgtnacattatgncctcacatatggaccatgtgatggtttcacgattgccacgggtctttctctagctttcatgctcgttacntnaattggaa

SEQ ID NO: 103188 - DNA, 278 bp, Triticum aestivum
  unsure (1)..(278): unsure at all n locations
  Clone ID: PAT_TA_103188
aaaattcccacgactcctcctcctcctcctcctctctggatcgatcccctccaacccacctcttccccctctggattgatcccctccaacccagctgccgccaccgnagaantttcnccaaccccggncttctccaccgccggtgacctcttctcttcctccctccctccacctccagcagcagatccatgcaggacagatctgagctccactgtctccgttgctccctttcccctgatcagatctgcctcttgcattctggcacctcgccggcgtgg

SEQ ID NO: 103189 - DNA, 342 bp, Triticum aestivum
  unsure (1)..(342): unsure at all n locations
  Clone ID: PAT_TA_103189
caaacgtatcccaagaacaggccaaagggtgacagtggttgttggtgacccaatcaactttgangacctgatggctgagaacagtaacgactcccaacatatttctagaggtgacctgtatgacaaagtaaccgaaaggattgggcagcggctgcagcaactcaaggtggaggtcgacagattgnggnagagcagaangccgagctccaaaaccgtcacacagacaacacagtcaatgacgggtacaaggtgtggcagcaggttgactgggaatcgttcggcatagggaacatgctgtcntcagccgaacattctttggcccaagagccgncaaagcagatc

SEQ ID NO: 103190 - DNA, 333 bp, Triticum aestivum
  unsure (1)..(333): unsure at all n locations
  Clone ID: PAT_TA_103190
ccgacgaagggggaggccctggagcaggccaagaaagacatgatcggggctctcaagacnctggaggccgacctcggtgataaggactacttcggtggcgaggcgtttggcttcgtggatgtcgcgttcgtgaccttgaccccctggttttacacctacnagaagtacngtgactttcatcgtngaggaacactgcccaaggatcgtggcctgggccgcccggtgcagggagcgtgagagcgtggccaaggcacttactgatcctganaaggtgtntgagatcntnannaggagtatggtgccnactaagcagagtnctangttatctatgtn

SEQ ID NO: 103191 - DNA, 303 bp, Triticum aestivum
  unsure (1)..(303): unsure at all n locations
  Clone ID: PAT_TA_103191
ccttgtctccaagcaagaaagaggccacggccggataagactcaccaagcttagctaagcnacttcaacaatggagggggcgggaacnncactactgtggagccaggtgggctcgccgctggcatccttcccggcgatgctgttcacggtggcggccatggcggccggcgcattcncagtgtacttctacgcgccgtcattgcgcctgcgcagngtgccgggccccctcgcttacggcctcgtcggccacctgccgctgctggacaagcatggctcccaggcgttcggcgtcctcgcaaagaa

SEQ ID NO: 103192 - DNA, 422 bp, Triticum aestivum
  unsure (1)..(422): unsure at all n locations
  Clone ID: PAT_TA_103192
cagatcaggaaatttgatcaagaagcatcttatcaagagctaactaggatgataataatgcatggctatcccctgtcaattgtggagcatgaagaaatgaaaagatttgcgaagggccttaaccctgtgtttaacatggcttcaagcctagatatggaagaatattcaattctgctgtttcagaaagagaagtctgaccttaaggagaaaattgcactttcgtcacgacgagtttcgttatcagcaagtgtgtgggtccctcatggagctgatcccacagtaaagtacctgtgtttgaccgcgcattttattgatgctgaatggaagcttcaaaggagaataatcaagtttggtgtgctttggtcctcaccttctgatttggaaaggatgatacactgtaaggaggcttgtgtgctagaant

SEQ ID NO: 103193 - DNA, 302 bp, Triticum aestivum
  Clone ID: PAT_TA_103193
cgattttgcggtgagatccagccatgtcggaggccgaccggttacgcctccgcgcggcggcgctggcgctcgacggcggcgctgtgcgggacaagccggactccaaggctaacgtgttcgcggatcttgggtccccggtgtcgccgctgcgggcgcgggccagcatgacgacctcctcctcctcctcttccgggtcggccaagtcgccagcgcagtcaaatgttggggcggtgggagcggcaggcgggaggagccactccggtgagctggcggtggagagccacccgccgcggctgccgggg

SEQ ID NO: 103194 - DNA, 286 bp, Triticum aestivum
  unsure (1)..(286): unsure at all n locations
  Clone ID: PAT_TA_103194
acctccgcagttacaccgtgcccctgcaccgctgcatcgccatgatggacctccaggagagnaacgagaggctcttctacaagctcctcatcgacaacgtcgaggagctgctccccgtcgtctacacgcccgtcgtcggcgaggcctgccagaagtacggcagcatttaccggcgccccnnaggggctctacattcancctcgaggacaagggcaaggtgctngaggtgctnaagaactggcctgagaggagcatccangtcattgtcgtcaccgacggtgagcgn

SEQ ID NO: 103195 - DNA, 284 bp, Triticum aestivum
  unsure (1)..(284): unsure at all n locations
  Clone ID: PAT_TA_103195
ccggcgcggcagctgtggcgcccgccaatcggcgcgctggagcttggcatcgtcgggngcaaaggcctcctaccgatgcgcaccgccgacggcaaggggtgcacggacgcgtacgccgtggccaagtacggccncaagtgggcgcgcacgcgcaccatntncgacagctacgacccggcctggaangaacaattacacgtggcccgtgtacgacccgtgcaccgtgctcaccgtcggcgtcttagangacccgntgcattcgcttncgccggacgaggggaaag

SEQ ID NO: 103196 - DNA, 274 bp, Triticum aestivum
  unsure (1)..(274): unsure at all n locations
  Clone ID: PAT_TA_103196
catcccctgcgtctcccacgactgcgacgacgtctccactacgtaccgcccgcctgggngcccgaagcccaaccttcgtggagaccggccgtgcgcctgccccgcatacccgcgcaacccggtcgacgggcgctgccgctctgacgacgccaccacgatcaccctngccgccaatgccacggacgggtcanaaacccgttntacccggtcacnttccgcgccgtcgggtcctgcgcgccaggggagcttctggagtcgctcncggtgggagcgg

SEQ ID NO: 103197 - DNA, 305 bp, Triticum aestivum
  unsure (1)..(305): unsure at all n locations
  Clone ID: PAT_TA_103197
cggagatgcaaaagcggtgtttgtggtggaagaagacatagctgcctacaaagtgagagcgatcgatgacccgaggaccctcaactgaccaatatcctctacatgaggccgccagtgaacatggtgtcccacaatgagttcatcgccatgtgggggaggaaaacaggcaggacttcctcggatcgagcgtattccggaggcggatctcctgaagctgatcaagggtaggaagggtacatgcatcattgtgcacctcccaggcacgcatatggtggtctgtctgtacatagttgcagctnccctgc

SEQ ID NO: 103198 - DNA, 353 bp, Triticum aestivum
  unsure (1)..(353): unsure at all n locations
  Clone ID: PAT_TA_103198
ctcccaagccaatatggatcgaatgcagaaaattactcccaatcccaagaactacgnngtgctccatcgtatcatcgtctcatcnctcttcttgctgctgtcatgtaccgcggcgagcggccagcaagccccgtacaagccactcatctcccggctcgccaaggacctcaacacctccctctacaccatcatcatcaaggccgacaagtcgccgctcctcctcgacctcgccggctcgctcgtctggtcaaacttgcccgccgtcggcgcagagcactgtggcatgcgggtccggtaagtgcggcagcgcggccagccaggagtgcccacaccgctgcctgcacgtggacggg

SEQ ID NO: 103199 - DNA, 295 bp, Triticum aestivum
  unsure (1)..(295): unsure at all n locations
  Clone ID: PAT_TA_103199
aaagggggaagggtccgatccggggcgagaactcctccgcacctccgcacctccgngccgcatccaaacagatccacacccgaaatccccgaaaccctcgccggcgaccatggggcagggcacgccgggcggcatgggcaagcagggcggcgccccgggcgaccgcggcaagccgggcggcgacggcgacaagaaggacaagaagttcgagccgcccgccgcgccgtcccgcgtcggccgcaagcagcgccgccagaaggggcccgaggcggccgctcgagcatgcatctagagg

SEQ ID NO: 103200 - DNA, 348 bp, Triticum aestivum
  unsure (1)..(348): unsure at all n locations
  Clone ID: PAT_TA_103200
cccgcgttctctcgtctccatctgcctctctttgacttgtgcgccactgagaactcttcttggagaacctctgaatctcgagaggcattgggtccgtcctgagttgttgttagtgttgccttggtctttcgtttctggctttcgtgccgatccactccggtgctgttcggcggcggtcacgatggccggcggcccggttgtgaacaccggaggggggaaggactaccccggcaagctcaccatgttcgtgctcttcgcctgcatcgtcgccgccaccggcggcctcatcttcggatacgacataggcatctccggtggcgtgacctcatgaaccccttcctgatgaan

SEQ ID NO: 103201 - DNA, 305 bp, Triticum aestivum
  unsure (1)..(305): unsure at all n locations
  Clone ID: PAT_TA_103201
cggaccggagagagggtgcagtgcaggtttgccatgagatgctgctccactgaaggatcgccaagggggagctcaaacaaggggtgtggctgggagagatgttaaggagatgggcaagaagggaagcggctggatcactgcactcaagaaggccttcaccacaaaccccaaggacaagccaacaaatgtgcagctggtagcgcagtacccgccgcagcagccgccgccgcagccgcagcagcagtaccgggggagcgcgagggacaagaagcgatgggggttcgggcggtcgcggcagcacgccn

SEQ ID NO: 103202 - DNA, 308 bp, Triticum aestivum
  Clone ID: PAT_TA_103202
ccgcacggccggccaccacttcccaccacgccgccgggccgccatccccaacacggggccaggccaccagctcctccctcgcgccaccacctctccgggatcgttggtgctccacacccttccccagatcccttccccagatccgtcgggcgtttgccggattagcggagccacatctggatccatggagccagcacccctgagaccccgtcgaaccagctccttctcgcgtgagccaccgctcatccccggcgacctcccgccgccttctacgcgcgtagccacacccccgccatgactcaggacat

SEQ ID NO: 103203 - DNA, 307 bp, Triticum aestivum
  unsure (1)..(307): unsure at all n locations
  Clone ID: PAT_TA_103203
cgcgcgctgcacttactacacacgatcgatggccgtccaagtcgtgacgtccgagctggtcgcgccgagcgaggccaccccgcggcgcgcgctctggctgtccaacctcgacctcggcgccaggaacggttactcccccaccgtctacttcttccgagcgcccgatcgnggcgacggcaaggccgagtccttcttctcggccggngtcctcagggcggcgctggccagggcgctggtcccgttccaccccttcgccggacgcctcggcgcgggccgcacggncgggcggagatcgactgcaacgact

SEQ ID NO: 103204 - DNA, 298 bp, Triticum aestivum
  Clone ID: PAT_TA_103204
cccaatccaatccaatccggccccccctccggtctcaccgagaaacctccgatccaagcgaagccaaggttctctcctcctcctcctcctcctcaaggtatgcgagcctccgatccctcccgtccttgcctcttgttcacatgctatcaggctctgtagattgttaagttgattcccctctattgctgttcgtagtttggtgtagatctgtgggtcgagtagtcattgctggtcaattgctgctggttcggttagtcgaggttgatgatgccggattgtagatataaatcttccctgg

SEQ ID NO: 103205 - DNA, 305 bp, Triticum aestivum
  unsure (1)..(305): unsure at all n locations
  Clone ID: PAT_TA_103205
ttctccgtgnccggcgggagcacatgatctgaacccctccgcgccgcgccgctccgtccatccgccttctgtttcgggggaggagaagacggatcaatcgttcggtatcggagctgaggaagatttcttgctcacatggccggcaccagcgatcgtggatccctcatggaggactggatggccatgccgccgacacccagcccgagaacgctcatgtcaagcttcttgaatgaagacttcagntctggtcaattctccaattttttcggcgaacatgtgagcaacaagccccatgatcaatcann

SEQ ID NO: 103206 - DNA, 342 bp, Triticum aestivum
  unsure (1)..(342): unsure at all n locations
  Clone ID: PAT_TA_103206
cgatttcgcgtcttcgtatggcgcgctcttgttccaggtgtcgcggctggatcgnaacggcgcagaccacgcaaacaaggacncacaggtggtgaagcagcaggttgcggcggggcagtacaagcaagcacaggccacactcaaccgaatgctcaactggatcatcgtcaacagcggccacgtggacgtgtataacttcttgctggacaccgggatggacccggtggtcgcggcgagctcatcgccggcggtgccggagtactcgaggtacctggagagcaagtccgtaggggactccattnaggaggccatgaacggagccatcaagcaaaagctcaagat

SEQ ID NO: 103207 - DNA, 341 bp, Triticum aestivum
  unsure (1)..(341): unsure at all n locations
  Clone ID: PAT_TA_103207
ccgccggagttctttttgctctggaaacagtgtcttcacgatggaggagtgccctactctggcgagctttcttcacaacancngttgttgccgttgtgcttagggcattaatagacatctgtaaaagaggccggtgtggcttgttcgggaaaggcggtcttataatgtttgatgtgacttcgggctatgtcaactatcatgtgattgatttacctccggtaatcactctagcagtttttggaggagtactggggagcttgtacaacttcttcctcgacaaggttcttcgtctctacaatgttatcaacgagaaaggtcgaacttacagactactcctggct

SEQ ID NO: 103208 - DNA, 466 bp, Triticum aestivum
  Clone ID: PAT_TA_103208
cggaagaaggggcagaagcgggcgcggcagcagcggttcgccttcgtgaccaagagcgaagttgatcacctcgaggatgggtacagatggaggaagtatgggcagaaagccgtcaagaacagccctttcccaaggagctactaccggtgcaccaacagcaagtgcaccgtgaagaagcgggtggagcggtcgtcggaggacccctccgtggtgatcaccactacgagggccagcactgccaccaccagacctccttccagcgcggcggcatgcacttccacggcgccgccaccgttgcgctcgccgagcagatgtcgttcgtgtcaactcagcagctgtacaacctgccgcccctgcgccgacaacagatgaatcctgcatcgtcggagtccgccgttagctccgtgccgccgtctttgcagcagctcaacggcggcgacgaactgcgaaggtcaactagctatag

SEQ ID NO: 103209 - DNA, 468 bp, Triticum aestivum
  unsure (1)..(468): unsure at all n locations
  Clone ID: PAT_TA_103209
caatttcagcatttgcagcaagccgctgtatttctatcttattctgcaccagttcnccattattaccatgtcgtgaaccacgcagataccggctcaccatgtccagcccagatagcatcgccgcgccgtcagggtctagcgtcgccaccgccgcatccgacggcaacagcgactccaacgcttctcaccatcatgatacccattcgtctatgcaacatgaagagccagaaattcggagaccggatagcccgtccgatgacgaagccacagatttcacatctgttgtgacaaggtcggaggtggcgatagacgaatccgagccgtcgcctgaagaaacgataccgacagagcagctcgaggcagcggcctcgctgcgagaagtctttgaaacttctgcttcacagcggtttcaaactcggagctcatctatgcgagcacccacacgattatatccccaacgtgacgagg

SEQ ID NO: 103210 - DNA, 467 bp, Triticum aestivum
  Clone ID: PAT_TA_103210
ctcccagcggcctccaagaagaggtttttgattgttgtgtgtagtttccgtcattgaaatattctccggaagcagatatcttgaatattcgtgaagaccttgagcaaggttcagtgacatagcaaatattgagattagcaatggatagcttgtcggaactgtataatctgtggcaaatccagttgattgtgcttcttagcttcgttctacaagtgttcctcttcttcactggtagccttcgacagggtagcaccaatgggttgcttaggggcgccatttggctagcatatctgggagcagacatggtagcaatttatgccctagggtacctctcaagacatcaggataatggcacaatggaaacccacccattggttttcttttggactcctttcctcctcattcatctcggtgggcaggataccatcactgctttctccatggaggacaacaaattgtggttgagg

SEQ ID NO: 103211 - DNA, 467 bp, Triticum aestivum
  unsure (1)..(467): unsure at all n locations
  Clone ID: PAT_TA_103211
cggggatttgttgtctttcatgcaaagtttgcagaaaactacaggctatattctcgcagccactttgttaaaggcatcgagttgatgactctgctcatcgtttatcaactatttggtcaaacttcacactcaaccatcgcatatatctttgttacgtcctccatgtggttcctagtgttgacatggctctttgcaccctttctgttcaacccctcggggtttgagtgggcgaaaattttggacgattggtcggactggaataagtggatcagcaatcgtggtgggattggtgtgtcaccagaaaagagctgggaatcctggtgggagatagagcaggagcatctgaagcatacaggaacaatcggaatcatctttgagataattttgtcccttcggtttttcatatatcagtatggcctcgtttaccagttaactatcgcaaagaacaacaaaagtatcgtggtttn

SEQ ID NO: 103212 - DNA, 347 bp, Triticum aestivum
  unsure (1)..(347): unsure at all n locations
  Clone ID: PAT_TA_103212
caagcggcacgacacgcccgtcgattaagagcgacagagcccggccggttcgtccgaccatggcggcggcggcggcggcgcgggagttaaggcaccggcaggtggaggcgaacggcatcacgatgcacgtcgcggagtccggcccggcctcggccgcggcccccacggtgctcttcgtgcacggcttcccggagctctggtactcgtggcgccaccagatggagcacctggcggcgcggggctaccgctgcgtggcacccgacctccncggctacggcggcacctccgcgccgtccgaccccgcctnctacaccnccttcacgtcntcggggacctcgttcgctcct

SEQ ID NO: 103213 - DNA, 468 bp, Triticum aestivum
  Clone ID: PAT_TA_103213
cccgaactaccacacccaaacgtaccagaggtgcccaagatgcccaaagtgccacaccctacaacgccggaagtgccacaccatgttgtaccagaaatgccccatctgattgtaccggaggtgccaaagatacctgaagtctcgcaccttcttgcgcctgaggcacctaagaccgagctagaacaccctcctacgccagaggtgccaaagatgccagagataccagagataccacaccctgcaatagatgagatgccaaagattcctgaagtacctcacatcgacgtactagaggtgtctaagcctgaagtcccacacccagctgcaccagaggggccaaagggcaaatcacactacccgaagacggaggctaaaccatgatgaagaactccgtgactatgtctatgtagcatgtcctagtatgcacgtacgattatatgtaagctacgatgatgtgtttttcattgg

SEQ ID NO: 103214 - DNA, 356 bp, Triticum aestivum
  Clone ID: PAT_TA_103214
gccggaacctatgcctaagccggagcccaagcctaaacctgacccgaaactagagccaccaccaaagcacaagccgccaacagcttacaattgatgggatactatatatgacaacagaaagatcaaggagatcatggccggggccacaatcgcgatatttctggaataagtagtgtagtaacaatgtcattctatccggctagctcgatagcgatgcatctttctgtattctatgtatttcgttacatttataaagtttctgttccatgcatccatgatgagtattactactttgtaattgttatttgcttgttggtgtaagttcaattttgtacgtgactcgttgttctatttgt

SEQ ID NO: 103215 - DNA, 342 bp, Triticum aestivum
  Clone ID: PAT_TA_103215
cagccgcttttagacaagcttaaatctgctctctatgaagccgaagacatcttggatagtgtcgagtacgagcacctcaagaagcagatccaagatgccaagtcagatggcagtaagatggatttgctaaagaagaatgttcggtctgccatgccgagctcccccctaaaagataaggtgactggtatgtcaaaagtggagttgaagaagagcctggagaagatagaaagtgctataaatgatgcatgtgaaattttgaaacagctgaacttgccatgtgtaagtaatgataaggggagaccagctgttcctaccaatgcacgtagtgcaggcatcagtcct

SEQ ID NO: 103216 - DNA, 297 bp, Triticum aestivum
  unsure (1)..(297): unsure at all n locations
  Clone ID: PAT_TA_103216
tttgctctgagttggtgcttctttcacagtcggtttcgttcgagttgaagccgcccttcgaaattctgtgattggggcgggtgggtggtggcgatggaggagaggtacnaggcgttgaaggagctggggacgggaaacttcggggtggcgaggctggtcagggacaagagcaccaaggagctcgtcgccgtcaagtacatcgagaggggcaagaagattgatgagaatgtgcagagggagatcatcaatcaccgctcgctccggcaccctaacatcataccattcanggaggtttgt

SEQ ID NO: 103217 - DNA, 359 bp, Triticum aestivum
  unsure (1)..(359): unsure at all n locations
  Clone ID: PAT_TA_103217
cgtcgtgcccggagtgtcccggttcaccaagagccgggccgagctcaccgacggcaccgncctcgacctcgacgccgtggtgatggccacgggctaccgcagcaacgttccccagtggctccagggcaccgacttcttcggcaaggacgggtacccgaccaccgccttccccaacgggtggaagggccagtccgggctctactccgtgggcttcacccgccgcggcctctccggcgcgtccgccgacgccgtccgcatcgccaaggacctcgggcaggtgtggcgcgaggagaccaagcccaccaccaagcgggccgccggcgcctgccacaggcgctgtatctccgtcatcttctaan

SEQ ID NO: 103218 - DNA, 360 bp, Triticum aestivum
  Clone ID: PAT_TA_103218
ccgccgacgtcctcgcgctcgccgcccgggactccgtcttcatggctggggacctctactacatggtgcccatgggccgcaaggacggttacgtctcccgcgccgccgacacctccgcgctccccgccgcgacgctcaacgcgtccgagcttatcaaggtgttcgtcggtgaccacggcttcaccgtgccggagctcgtggcgctctccggcgcccacacgctcggccaggcccactgcgccaacttcaagaaccggctcagcggcttcggcaaggccggcaaggaccccacgatggaggcctggatggcggcgtccctggccaagacctgcaaggccggcggcgacggcgccacggcct

SEQ ID NO: 103219 - DNA, 360 bp, Triticum aestivum
  unsure (1)..(360): unsure at all n locations
  Clone ID: PAT_TA_103219
ctcaagaacttaccacatttggagctactttctttgggtcataaccttctaaatggaactattccaaatgattttaatcagctgcacnctctgaaggttttggacctgtcctcaaaccgcctctccggagagatccctcatgcactcgcagacttgacaaatctcactgccctcctccttgataataataaacttactgggaagataccggccgaatttgccaatgcggcatctcttaccacgtttaacatgtcattcaacaatttgtctggtccagtgccaacaaatagcagtgcagttggatgtgacagcattattggaaatcctttgctacaatcttgtcacacgtataccctggct

SEQ ID NO: 103220 - DNA, 284 bp, Triticum aestivum
  unsure (1)..(284): unsure at all n locations
  Clone ID: PAT_TA_103220
agtgcggaaaaagggccaaaagaaaagcgaatccccccaagaatcagcagacacgtgtgtggactcgtctcntctcgaccggggaaggagagagacaatggcgtgcccggcggcggcgctgctcctgccgctcctgctcggcttcctggcggcgccttcgccggcgcgggccaccgacccctacgccgccttcgactgggacgtctcctacgtcaccagatccccgctcggcgtcccgcaaaaggtgatcgcaatcaacaaggagttcccgggccccgtggtgt

SEQ ID NO: 103221 - DNA, 298 bp, Triticum aestivum
  unsure (1)..(298): unsure at all n locations
  Clone ID: PAT_TA_103221
ccgagttgggtatgccatcaagaccgataagcttgatgcactctatgagaaggttaagnngaaaggggttacaaaaacattgttgctngtgaaagcggcaggcatggcactcgctcagcacccagttgtgaatgccagctgcagggatggaaagagcttcagttacaacagtagtatcaacatcgcggtggcggttgccatcgagggtggccttcttacgcctgtattagaggatgttgataagtcagatatatatctgctcgcgcaaaaatggagagccctgctcaagaagacgcgc

SEQ ID NO: 103222 - DNA, 300 bp, Triticum aestivum
  unsure (1)..(300): unsure at all n locations
  Clone ID: PAT_TA_103222
ccaccagaccagcatgcgcacacaccatgccaagccaagcgaagctcgccggagagagaatcgccggagatgtccggccgcggcaagggagggaaggggctgggcaagggcggcgccaagcggcaccggaaggtgctgcgcgacaacatccanggcatcaccaagccggcgatccggcggctggcgcggcgtggcggcgtgaagcgcatctcggggctcatctacgaggagacccgcggcgtgctcaagatcttcctggagaacgtnatccncgacgccgtgacctacaccgancacgct

SEQ ID NO: 103223 - DNA, 354 bp, Triticum aestivum
  unsure (1)..(354): unsure at all n locations
  Clone ID: PAT_TA_103223
cctcgagtagccgtcccaatcctcgatctgttctcaacctcccctccgtccgtcgcagntccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctgg

SEQ ID NO: 103224 - DNA, 800 bp, Triticum aestivum
  unsure (1)..(800): unsure at all n locations
  Clone ID: PAT_TA_103224
tttcccccggaaccggccaaggccccccaattggaaaaatttttaaaccattccaattccggcggccttccaaggcctgccctagcgaaccatcttcccgtggaccttttcctgacgacgagcggatgcccgggaagcaggttatggcaagtccaagcacaaggcataattgggcgaacgaccaaacccaatgggtgcccgggcggttcccagagccctgngaaggacccaattagccggcagcagcgatnatcaantaagccgccctgtttacctgtagcttaacacaggcggattcgcagcaacaatgagggatggctttcacacgggaattctcggcaaagcgccttggagcttatcgggaaaccaaggcaatttcacgcaaggcgatcatacgcattacaagttattcgtccccgggaaaaccaaaggcaaaggggggccaaaagccgttattnaccctttaaatttggggaagaccgtttgttcccagaccgttttcccaagcccttgggcggcttcgggccccgggactctggcaacggcgttctttcangggaaanttttgggttttccccccttggatggtgttagggcgcaaagcnagcaagtttgaaactctaacttctgggcgnaacaatgnaagggtaaaaacnacaacgggagaaacccgaaattattaattttgccgccgaaaatatattattgggcgcaanagaggatttatagacccgtttaccccgttataagccgttgggtgattttctctggcgcgaacaatgacaagttgggagccgtcc

SEQ ID NO: 103225 - DNA, 624 bp, Triticum aestivum
  unsure (1)..(624): unsure at all n locations
  Clone ID: PAT_TA_103225
tcaatcgatcaccccaacgntacnnaaattnaccctnacatcaaatntggannccaaaacgtttggacgtcccactagttggtttgcgttggntcgtcatcacaatcatttgcgatcnccctgtggttcgtntgcgcattcatatgcgncncgacgccaacgcacacacacacacacataccattcgcacacacattctacgcattttgtgcgcaccacatatatcctatgcgacgcantatgcgccttatncgttcggtttgcgccncacttcgcacatacgcacatatgcgcataatccttcgcacattacgcatacgtacgcatccttgtattgcantattgtgtgcacatgccangtcacatgcanttgttgccagcaattgntnaccacacatgcacattttcctcacatgtgcccantcncctgtgtgcacacctgcatgtgcacattgcacatcacattggtttttggtcncatgcacactgcacnatcccncatggtggcacaatatcnccttgcacatcnttgcatattgtgtcacatgtgggcatcacattgtgcacatgccatattgcagtcntattgcacanttgtggtntcacagcaagcatacatcaccc

SEQ ID NO: 103226 - DNA, 542 bp, Triticum aestivum
  Clone ID: PAT_TA_103226
ctcccatcacaaaaccaatcctcctccgcgccccgatccccaagagcatcacctgcaagcaatggacgtctcaggcaccggagctggcgccaagggcaagaagggcgcggccgggcgcaaggccggcggccccaggaagaagtcggtgacgcgctccgtcaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccggaaacgccgccaaggacaacaagaagagccgcatcatcccgcgccacctgctgctcgctgtcaggaacgacgaggagctcggaaagctgctggccggcgtcaccatcgcgcacggtggcgtgatccccaagatcaacccggtgctcctccccaagaggaccgcggagaaggagggcaaggagcccaagtctcctaagaagacgaccaagtcccccaagaagaccaccaaggcttagatcg

SEQ ID NO: 103227 - DNA, 669 bp, Triticum aestivum
  unsure (1)..(669): unsure at all n locations
  Clone ID: PAT_TA_103227
caaaaaaacaccaaccccccctgctgccccgatccccacctcctccttcgatccactcccccgaatgccagatctcgctgccacagcacgcctctggctcgtcggctcctccctgatccagcggcgtcgagctcttcccctcctgccacaagcgccgcctgctccctggctacgccgccgccccctgaccccgacgcgcctcccgccaccggccaccttggccgtgtcgtcgcccccctgatgcacctctcgctgccgatgctgtcgcccctcccgccgtcgtccactccgaacccgtcgccatgcctcgacccgcagtacacaaacaacgccggcggncaccacctccagtggttgcactttggcggccgccggtggcctttcaccagcgctggagccaccccccgcccggccccgtccccacgcttggatccgcatcggcgccgcccggtgcctgaaacggcaccagctccacccgcgcacctggattcggtagccgcaccacccccgtgactggattcggccgccacgccgttctcgagccagtttcaacatccttctccgcatgaggatttgaacttctttnaaatttgcntgaaaattgcctgcaaaattgtgtctgtaaatttcgctcctgaatacaagtgcggtttctgaagagaaattttt

SEQ ID NO: 103228 - DNA, 637 bp, Triticum aestivum
  Clone ID: PAT_TA_103228
gactcgtgccgaattctgcaggccaccgctcctcctccatttccatctcagtcagctccatgccgtcagccatgtccggccgcggcaagggagggaagggcctcggcaagggcggcgccaagcgcaccgtaagtcctcccgcgacaacatccaggggcatcaccaagccgggccatcctggcggtctgtggcggcgggcgggggcgggggtggagagcggactctcgggggctcatctacggagtggaggacccggcgcggcggtggctcaaagatcttcctgtggaggaacggtcatccggcggagcggcgcggtcacctacaccggaggcacggccgcgccggcaagaccctcacccccatgggacggttgtctacggcggctcaaggcgacatgggacggcactctctacgggtttgggcgggctaggctggcggcccctggctggctccatcgggtcggactctgctgggatggctggctggttcctctcgctatgggtttcggtttctggaggtggcggtggtcctgcttttccataggtctgtgtagttagtagaggggatggatctgaatgtactggagttgttggttcttacaagaaatgaatctgaataaaatggaagttgtacttca

SEQ ID NO: 103229 - DNA, 362 bp, Triticum aestivum
  unsure (1)..(362): unsure at all n locations
  Clone ID: PAT_TA_103229
accgtcctgaccaacctgaactcgtcggcgaccaggtgaactgaaggccgccgcgatcagaaacaaatagagctcaaaacctataggggaatggagagcggcgtgagttcttcgggattcacaagctatgtgtttttgacagaacagatggagttagcagctctgagcctgtgattcgtctggcaaaacctggccgaaatcaccagagcgccacgaactggattacccccccccccccaaaangagganaaggaagaagnacgagaaagcacacangatgnagcacanaanatgccaaaanggaaagngaacacaagcgaganggaaagaacnaaaagatccccatnatgatgaggaaagga

SEQ ID NO: 103230 - DNA, 748 bp, Triticum aestivum
  unsure (1)..(748): unsure at all n locations
  Clone ID: PAT_TA_103230
tgaaatcccaatctccaaatgcctgcagctgcatgcagcatgccatgatccccaatcccctccaccacgatgtgccctgcactgaagcagactgtgccctgcaatgtccacctgtgctgtgcaatggctgcctgatgtgaatgcagctctgccaccaatgngctgtgctgctgcaattgtctgtgctgcctgtgccacctgtgctgtgctgtgaatgaatgccccacctgcttcatgtgcctgtgngaactgtgtctgccctcctgctgatgatcctgcaatgtaccagaagatgcactgtgatgctgctcatcctgcaagctccccttccagctgcctcgtcctgtgagatctgctgcagtgacttcaatgacctgacctcctgcttccaggatgctacctgcctgtctcctgcacctgcagngagtgcctgcctgagngcctacctcgtctgtgngctgttcgagtgacaccaacctctgcgccatccactgccaagctgctgtcaccatcatgcccaagngacatccagctcgccctgccgcatccgaggggagaggngcctaggtatctagggtcgccgtgtaatactggctagtagctgttcttgtncttgttgatccggatgtgtgtcagngtgcttcatgnttgtaggtagttgatatgatgtagtacancttatcctaaatgtattgtgatgcttgaatgacaattgcatggaaaaggttcagcatatcgtgcccaagag

SEQ ID NO: 103231 - DNA, 898 bp, Triticum aestivum
  unsure (1)..(898): unsure at all n locations
  Clone ID: PAT_TA_103231
atcactgacagggagacgggcctgttcccgcggtgttcgggttcgtcaccttcgcgtcgtgacgagtgcgatgctgccaggcgatctgagtgccatgaactggccatgtgacctggactgtgcctgcaaccatcacctgtcaactgatgtgcccagtccctgcctgctcctgtgctgtgatgtgctgtgctgtgctgtgctttccaagctgtgctgtgatgtgctgtgttgtgctgtgctttactgtgctgtgcccatgctgcccngctgatgtgtgcttgtgctgtgctgtgctgtgcttactgtgctggctgtgctgtgctgtgttgtgctactgtgatgtgttgtgcctgcatgctgtgcgtgctgtgctgtgtgtgctaccgtgcatgcctggtgatgtgtgctggcgtgctgtgcctactgtgctgtgctgtgctgtgctgtgcgtgctaccgtgctgtgcaatgccctgctgtgctgtgcatcctgtgctggcgtgcaaccttggacgtgtgatgttgaatgggtggggggccccatcgcatgggccagaattagtcncatatgtttaccctgatcccagttatataaatacccgtgatctacccaagaaatggttatagtcgcntcgcntcgacttccacggagataaatccgtaggaatcctcgccatccnggtcgacggtaggggttccngaggatgntatcaggcataccgnttagaatnggtgacgcttgcttatctctggatttcacgngtgattacctgatatcccggttaccacggcatcttgattncggcctaattgcgtttctacaagcatttgaagagtgaanaagcnctgaagcaaaaaggttttgatagcggcaaanacaaaacgcacgacagcaacat

SEQ ID NO: 103232 - DNA, 862 bp, Triticum aestivum
  unsure (1)..(862): unsure at all n locations
  Clone ID: PAT_TA_103232
tgatggaactcgtgtccccaatgatggcaggccaatgaagaatggcccccaatgtccaatgacaacttagatatgttgctgtgatgaatgactcttatttaacaaatgaagctacctgtacctggttctactataatngtntgttaaatactgtggaatacctgtattatatntgaatgtgtgtgtgtgttgccatgtggcctataacgaagtgtaggtatgtgtgtatgtgctgtggtatataaagtgctgaactaagatttatgtatgtaatacaatataatatatatattgtngctaactatacgctgactatttctgaatatatggtatctgtaactgtgtgctaaaacggaatttntgttcataaccgcactattatggtatataactatctgattgcaaaccaaactaaatattggtantcaacttggaatagtggacacangtganttgtttaagccaaattgggtaccacacacgagacagagacaagactagacgaagacgacagaatagaaaaaanaaaagcgtaccacatacgggtagccccggaaactataccggaggacaacgaaaggatgtantatgnacaaacgcgcgttagcgccgcagaaccgcacagggcacgggcncggnacaccgaacacggatattaacacngacagagcgccggcgcgtagaggcaaacgcaagggtaccataccgggcgaccccnaatgcccgnaggccgaagacgcatngagggcccaccgggtgaaaatnccaaaacggggagtatgtcccaagccggcaacgccccactggnaagaggtggangagccaaaggaaaaacccacacacgagtgcaccggggaactac

SEQ ID NO: 103233 - DNA, 988 bp, Triticum aestivum
  unsure (1)..(988): unsure at all n locations
  Clone ID: PAT_TA_103233
ctcgtgcctgaatntctgtgcacgagcacatgctccgaaccgaccgcagcctgccggcaccgctgtaccatctacccccctataacctgagcagtgtacccaggtataccctaccagtccccatatattgcatggaactgagtgttgtgtgttgataattgtgtngtgaccttcttatgtcccaagtggaatgttgctctgcacacgcaacaagtgatacataaacttgccaatgtggaccatgcctactgatccagaatcaacatctgtgtgcattgttgtgattgctggaatgtgacttgtatnaattgggcaggttatncgacacagctggtatttggcncactacttaccttgtggaatatactgtacctggcngcccaagtggatngattggcctggatagtggtatactatattggggacaatgtggctacttgtgccatggcnatggacanggaagtgtggctggagnaatttccaanggccangctaacgcgaatttgaatggtttacccctggccgttgtggccacagaaattatattagggctacagtggaactcgtggacttaacgttanactggacaaaanccccggcctattatcaagagaggcgcctattagcaanaggaaaggtggaaaattcctntggntcanattgagcggtagggtcatataagatcgcatttaaggccccataaaattggaanattgggntccttcacttgcttangacncaacgccctgttggtggaacctttgagcaagcgnngcagagganttgggcattatcacattggggnagaacgccantcataaacctnttggaaaatggaaaagtccacagtttaagtactncctcttttgtggttaccanaaacagaagnagtcagtgnatgcatcnatcatcgctagcattcaaaatacgctcattcctgaaagcatgatggnggtgntgacaccacgggtgtatataaacgtccgtc

SEQ ID NO: 103234 - DNA, 962 bp, Triticum aestivum
  unsure (1)..(962): unsure at all n locations
  Clone ID: PAT_TA_103234
tgtgcactgatgctacacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgctccatggtcaccgtgacttcatcaagaacatgattactggtacctcccaggctgactgtgctgtgctcatcattgactccacacactggtggttttgaggctggtatctccaaggatggccagacccgtgagcatgccctccttgctttcactcttggagtgaagcagatgatctgctgctgtaacaagatggacgccaccactcccaagtactcaaaggcccgttacgaggaaattgtcaaggaagtctcttcgtacctgaagaaggtcggctacaaccctgacaatggttccctttgttcccatctctgggttttgagggtgacaacatgattgagaggtccaccaacttgactggtacaagggccctacccttcttgaggctcttgaccagatcaagagcccaagaaggcctcagacaagccctgagtcttcccttnagacgtttacaagattggtggcctgaactgtggcctgtagncggtgagatggtgtcataacctggaanggttggtaccagtagggacccactggctgacaaactgaggcaacgngaaaatgcaccgaagtccacacggaggnccctgnggtacaaggaggcacaggnaaaacgtgcggaggcntaacnggggtntgaccaacccaagaaaccccagaggagaaacacaacgagtagaaacncgcnaagca

SEQ ID NO: 103235 - DNA, 368 bp, Triticum aestivum
  unsure (1)..(368): unsure at all n locations
  Clone ID: PAT_TA_103235
ctgcagtgaattctgtgcgactgatgctctactactactactactactactactactactcttcttctactctactacttctactctnctncttctacttctactactactacttctacttctncttctactacttctactactactctacttctnctctctacctcgtttcctnatatacttatctatgntgtaatttaatagcccacatnctntctcntgggtcttgcacaagnccagtggctccgtacatnattagcacncaatgcttgccgngcatatggcgatgtacggttggcaatgaaggtgcggnatgcatgtgccatgtgttagcattatgtgtggtgtgcatgccctactggcagaca

SEQ ID NO: 103236 - DNA, 567 bp, Triticum aestivum
  Clone ID: PAT_TA_103236
tcccagcgaaacaccacacctctcctcgtcgaagcagcagcagcagccgcggcatccatggcccccaaggcggagaagaagccggtggcggagaaggccgagaagacgacggcggcgaagaagaccaaggccgagaagcggccgccggcgtccaaggagggcggcgagaagaaggggaagaagaagtcgaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctccgcttagatagtctgttcctgtcttctttgtcgatcgatggtactctgtaatagtcaggtgttcggaccatgtcgtcttgtaactgtttcattatcttgt

SEQ ID NO: 103237 - DNA, 623 bp, Triticum aestivum
  unsure (1)..(623): unsure at all n locations
  Clone ID: PAT_TA_103237
cagcagcccgcctcacatcccacccaaacccagcctccccacacgctccaaccaccagcacgcatggcacccaaggcggcggagaagaagccggtggtggccgcggagaagaccccggcggggaagaagcccaaggcggagaagcgggcgccggcgtccaaggaggccggcggcgagggcaagacgaggggcaggaagaagggcagcaaggccaagaagggcgtggagacgtacaagatttacatcttcaaggtgctgaagcaggtgcacccggacgtangcatctcctccaaggccatgtccatcatgaactccttcatcaacgacatcttcganaagctcgccggggantcggccaagctggcgcggtacaacaagaagcccaccatcacntcccgggagatccanacctccgtccgcctcgtcctccctggggactcgccaagcacccgtctccgaaggcaccaaggccgtcaccaattcacttcatcctangcgttgtccttgtttcatgaattgatggcngcangcatcctgtatttatttgcaacantttnatgttaccatctctgttaaaattgtgctgcttgcggcctgaaaaaatatnatgttctgtttaatcc

SEQ ID NO: 103238 - DNA, 531 bp, Triticum aestivum
  unsure (1)..(531): unsure at all n locations
  Clone ID: PAT_TA_103238
caccaccagcaagccacacagagcagccaagcgaanctcgccggagagagaagcgaagatgtcgggccgcggcaagggagggaaggggctgggcaatggcggagccaatcgccaccggaaggtgctccgggacaacatccagggcatcaccaanccggccatccgtcntctggctcgcaggggcggcgtgaagcgcatctcngggctcatctaccaaganacccgcggcgtgctcaanatcttcctggagaacgtcntccgcgacnccgtcacctacnccgancacgcccgccgcaagaccgtcaccgccatggacgtcgtctacgccctcaatcgccatggccgcaccctctacggcttcagcggctaagccgcgcccgtccggtccaatccgnctcgcnccgccaaattcctntcnanccatcngttgttcaatgttcnttntcttccnctntnatggaattggccgcatctcgccngctgtctgttgttttccantggaatggaaatctcncgcatttttatcccnat

SEQ ID NO: 103239 - DNA, 253 bp, Triticum aestivum
  Clone ID: PAT_TA_103239
gattcggatatgaataagccgaagatgcggcattacgtgcattgctatgcactgcattgtctggacgaggaggcgtcgaacgcattgaggagcgttttcaaagagagaggcgaaaatgtgggagcttggcgacaggcatgctataagcctctggtgaccatagcaggtacccaaggttgggacatcgatgccattttcaatgcacatccacgccttgccatctggtatgtccccaccagcctcagccacgtcg

SEQ ID NO: 103240 - DNA, 569 bp, Triticum aestivum
  Clone ID: PAT_TA_103240
tcccagcgaaacaccacacctctcctcgtcgaagcagcagcagcagccgcggcatccatggcccccaaggcggagaagaagccggtggcggagaaggccgagaagacgacggcggcgaagaagaccaaggccgagaagcggccgccggcgtccaaggagggcggcgagaagaaggggaagaagaagtcgaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctccgcttagatagtctgttcctgtcttctttgtcgatcgatggtactctgtaatagtcaggtgttcgggaccatgtcgtcttgtaactgtttcattatcttgtt

SEQ ID NO: 103241 - DNA, 567 bp, Triticum aestivum
  Clone ID: PAT_TA_103241
gggaggtgaggcgtaccaagaaccctagcctccggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactggagagtggcaacactaaggatgacctgaagcttcccactgatgatgttctgcttgggccagatcaaagaactggatttgctgatggccaaggaacttgatcctgtctgtgatgtccggccatggggtgg

SEQ ID NO: 103242 - DNA, 622 bp, Triticum aestivum
  Clone ID: PAT_TA_103242
ccgttgtcgtcgcctcctcctaaaccactctccctatccccgtttccagaagctaaccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaattgcaaggttctggttgttgccaacccagcaaacaccaatgctctcatcctgaaggagtttgctccatctatccctgagaagaacatcagttgtttgaccgcctagaccacaacagggcactcggtcagatttctgagagacttggtgtccaagtttctgacgtgaagaatgctattatct

SEQ ID NO: 103243 - DNA, 506 bp, Triticum aestivum
  Clone ID: PAT_TA_103243
tggacagatgcctggtgacaagaccgttgggggaggtgatgatgctttcaacaccttcttcagtgagactggtgctgggaagcatgttccccgtgctgtctttgttgatcttgagcccactgtgattgatgaggtgaggactggcacctatcgccagctcttccaccctgagcagcttatcagtggcaaggaggatgcagccaacaactttgcccgtggtcactacaccattggcaaggagattgttgacctatgccttgaccgtatcaggaagcttgcagacaactgcactggtctccagggattccttgtcttcaacgctgttggaggtggaactggctctggccttggttctctcctccttgagcgtctctctgttgactatggaaagaagtccaagcttgggttcacagtgtacccatctcctcaggtctccacctctgttgttgagccatacaacagtgtcctgtccacccactctctccttgagcacactgatgtggctg

SEQ ID NO: 103244 - DNA, 281 bp, Triticum aestivum
  Clone ID: PAT_TA_103244
ggcacgagctcgagtttttttttttttttttttcagggtaaactgctgcaatttccattccatcctagtacagaagtacatccagagaaaaacaaggcaggacaacagcagcgagatgctgcgactaccccgactatcaggctactgatctggtggtggcctagccgccgaatccgtagagggtgcggccctggcgcttgagcgcgtagacgacgtccatggcggtgacggtcttgcgtcgggcgtgctcggtgttaggtgacggcatcgcggatgacgtt

SEQ ID NO: 103245 - DNA, 500 bp, Triticum aestivum
  Clone ID: PAT_TA_103245
ggcacgagctttctgggatgtggttgtggattcaatgaaaggagacacaccagattacagttatctggtcaacctagtaaacgaagtcagggatgcattgcaccagatggccagtaaagggtggaaagaagaaataacaaacaatattaaccttgaaatattgtcccaggtacttgagtcgagcacccagggcacacaatatttggggcagattctgcagtactctctgggcatgctgcgtaaattatcttctcccgcaaaggaagaagaaatgaagatcagtcattgacaaattattgaacgaattgatcggacactctgattctcatgatagagatccaaatgcatttgtaatagctgtcatcaagggcttgcggttcactatggaagagttaaaggctcttcagtctgaagtcagtagagcacgaatccaactattgaaaccaattataaagggctcaggtggggtcgagtcctgcagaaagcttttgccgatcgct

SEQ ID NO: 103246 - DNA, 500 bp, Triticum aestivum
  unsure (1)..(500): unsure at all n locations
  Clone ID: PAT_TA_103246
ggcacgagctttaaccagcttcgtctctctgggctaacacctaatgagttccgtttgttgcctagtgactgtggcagtgctctggcaagcatttttcacggtcagcagttccatgctcagatcatcaaagcaggtgcggacagtgacccccatgtttcaaatgctctcatagacatgtatgcaaagtgtggcttcatcgaagaangacngctgttgtttgagtcaacactgggaaaaggacgtcatctgttggaactcgatgatttctacatatgcgcagcacggtcatgctgaggaagctcttcgtgtttttgggatgatgggaggggctggagtagagccgaactatgtgacatttgtcggtgtgctgtcagcatgtgctcatgcaggccttggtgaatgaaggcttacatcattttaattctatgaaaacaaaatatgcagttgaaccaggcaccgagcactatgcttctgtggtcaacctttttggtcgttcaggc

SEQ ID NO: 103247 - DNA, 500 bp, Triticum aestivum
  unsure (1)..(500): unsure at all n locations
  Clone ID: PAT_TA_103247
ggcacgaggtacananagagagagagagagagagagaganagagagagagagagatccatnnanannnanatagagagaganacagaggnanagacagacacncncacntnnanagngagacagatngagacttatctcntgggggggcccgnacccctccgctctatcctctgtcntgngnantnnctctggaccgtctngtttncatntctgtgactggcncatccctgtncgntttcccacttttttcncntngcagtctcatccccctntncgccgtgtggtttntgnatcatnganaggngcccaccggnttcncccctttcttcntgcatcttccnncncnncnttcatcccgncgaagtngcnttcntngtnnnncgctctcctntctatgttngaacttttcgtcnttctgcgngnnttatgtnttgcatnactctcctnttnttttcctnccattcggtctgccttcttctnnntccctcncnttncttcc

SEQ ID NO: 103248 - DNA, 500 bp, Triticum aestivum
  unsure (1)..(500): unsure at all n locations
  Clone ID: PAT_TA_103248
ggcacnagcntcnccncctctggacgtcatctanagctcacccccgccnaggtcngcctntgnacagcnacgtgcgtgaaacagtcgcagngngttcnggccgntcgttntgtcangnnncggcncgcgaatgcgncnatgaaaganatgaannngntgnagncgaaccngntgacacnncntctaanannatgagtnanaactgtnannttactatnnggntntgcncggtcggaacaatgtgannantacctgatgggcctnggtgtgtttgnnnactantntaattcccnagnannacaccgaaaactggngcctgtcntnnggngggnccngatccccnataccacnaaggattagtcttattcctgcntcatctnnncngnccnngtncntgcntcgtaactggtcaanacttnnncgttacgcaccttaatcnnnctcncaggggggngccntgtacccatncgcttannatnnaantcagcctncatngatcg

SEQ ID NO: 103249 - DNA, 498 bp, Triticum aestivum
  unsure (1)..(498): unsure at all n locations
  Clone ID: PAT_TA_103249
ggcacgagctctctccgcgcccacgaagcaagctctccactcccgatggcccgcacgaagcagacggcgaggaagtccaccggcggcaaggcgccgcgcaagcagctggcaaccaaggcggcgcgcaagtccgccccggccaccggcggcgtgaanaagccccaccgcttccgccccggcaccgtcgcgctccgggagatccgcaagtaccngaagagcaccgagctgctcatccgcaagctccccttccagcgcctggtgcgggagatcgcgcatgacttcaagaccgacctccgcttccanagctccgccgtctccgcgctgcanggaggncgccnaggcctacctcgttgnggctcttcnaggacnccanacctctgcgccatccacgccaagcgcgtcancatcntgcccaaggacatccanctcgcccgccgcntccgtggcgagagggctangctgcttcnttnaatcctngtntctgatctggtctcgagt

SEQ ID NO: 103250 - DNA, 321 bp, Triticum aestivum
  Clone ID: PAT_TA_103250
caccccccacctcccctgcctccatcaaactcacagcccccaccaccgaacctcccaaccccacccgaaccggcatccatggcccccaaggcacacaaaagccggccgcggagaccaaggtcgagaaggcgaccgagaagacccccgcgggcataattcctggccgacaaccggctgcctgcgcggtcaagacgctccctgatgcccgcggcacggcaatacccgggcctcagaaggctccagcaataatggctggaacgtactatatctacatcttccgggtgtcccaagctgtgctcctgacatcgcgctctcctctaa

SEQ ID NO: 103251 - DNA, 296 bp, Triticum aestivum
  unsure (1)..(296): unsure at all n locations
  Clone ID: PAT_TA_103251
gagagagagagagagagagagagagagagagagagagagagagagagagagagagagagagagagagagagagagagagagagagctcgtgccgaattcggccgagtctccccttctttcttctcggcggaggcgacaggaagcggcgaacgcggaaccctccgcctccccttccgctnggctgncggcgtatggcggcgattcggtgcgcggcgnggnngggatcggtggctccctgctccnccggacgctggcggcggtcgtggnaggagggacctcgccggctcgcgcctagc

SEQ ID NO: 103252 - DNA, 677 bp, Triticum aestivum
  unsure (1)..(677): unsure at all n locations
  Clone ID: PAT_TA_103252
ggcacgagccagccgccccccgcatctcgagtagcttccagctcgccggagaggtagcaagcaagatggccggaaggaagggaggcgacaggaagaaggcggtgacccgctccgtgaaggccgggctccagtttcnngtcggccgcatcgggcgctacctcaagaagggccgctacgcccagcgcgtcggctccggcgcccccgtctacctcgccgccgtcctcgagtacctcgccgcagagatgctggagctcgccggcaacgcggccaaggacaacaagaagacccggatcatcccgcgacacctgctgctcgccgtccgnaacgaccaggagctcggaaggctgctcgccggcgtcaccatcgnccacggcggcgtgatccccaacatcaactccgtgctgctcccaaagaagtcccccgccgccgncgagaaggaggccaagtcgcccaagaagaagacctccaccaaagtcccncaaagaagaaggtcgncgncaaggagtagcccgcccataaactacagnncgtaaattgcttangtccatattcagggagaggntgaaggagtttnngttggttnnattcctgncttcctgtgtgtatttgctagcccagtagngcttgnattcatctttaactatgtccggaatgactaanatgcaanccttaaattc

SEQ ID NO: 103253 - DNA, 689 bp, Triticum aestivum
  unsure (1)..(689): unsure at all n locations
  Clone ID: PAT_TA_103253
ggcacgagctctcctccttcaatcctccagcgaaaccccgccccaccccaccgtcagcatccatggcgcccaaggccgagaagaagccggcggcgaagaagccagtggaggaggagcccgcggcggagaaggccgagaagaccccggccgggaagaagcccaaggccganaagcggctgccggcgggcaagtcgtcggcggcggccaaggagggcggcaaggcgaanaagaagccaagaagagcgtggagacgtncaagatctacatcttcaaggtgctgaagcaggtgcaccccgacatcggcatctcctccaaggccatgtccatcatgaactccttcatcaacgacatcttcgaaaagctcgccggcgaagccgctaagctggcgaagtncaacaagaagcccaccatcacgtcccgggagatccagacctccgtccgcctcgtcctccccggcganctcnccaagcacgccgtctccgaaggcaccaaggctgtcaccaanttcacctcctcctgantctcntatttactgtttgggtntntttgttgccgtgttttcctgtnanaatcncatcnctatgtttctggatctcnaaaaatantaacggtgcctgcctcaatgttcattacatgcncctgttattttgttctggtcttccattcctcntctctaatcacctgctggt

SEQ ID NO: 103254 - DNA, 649 bp, Triticum aestivum
  unsure (1)..(649): unsure at all n locations
  Clone ID: PAT_TA_103254
ggcacgagccaccantttnctcgcaccttccggcgaatcaccgcacctctccccggcgaagcagcagcgtccgatggcccccaaggcggagaagaagccggctgccgcggagaagactccggcggccgagaagaccaccgcgggcaagaagcccaaggccgagaagcggccgcccaagtccaaggagggcggcgccgacaagaagaagaagaaggccaagaagagcgtggagacgtacaagatctacatcttcaaggtgctgaagcaggtgcacccggacatcggtatctcctccaaggccatgtccatcatgaactccttcatcaacgacatcttcgagaagctcgccggcgagtccgccaagctcgcccgctacaacaagaagcccaccatcacctncagggagatccagacctncgtccgcctngtccttccgggcgagctcgccaagcacgccgtctctgagggcaccaaggccgtcaccaaagttcacatcctcttagataggctggtctctgnctttcgtgggtgatcgatgggtctctgnaatgctcggtagctggtcggaccatgtcgcttggtaactgggctggtggtgtggcaacacactggttcatcatcntggggaatcagtaacttttgnttaatt

SEQ ID NO: 103255 - DNA, 575 bp, Triticum aestivum
  unsure (1)..(575): unsure at all n locations
  Clone ID: PAT_TA_103255
ggcacgaggatccagcaccgccgccgtttacaccacagcatctcgtcgacggagaggtagcaagcaagatggccggaaggaagggtggcgacaggaagaaggcggtgaccaggtccgtcaaggctgggctccagttccccgtcggccgcatcgggcgctacctcaagaagggccgctacgcccagcgggtcggctccggcgcccccgtctacctcgccgccgtcctcgagtacctcgccgccgaggtcctggagcttgccggcaacgcggccaaggacaacaagaagacccgcatcatcccgcgccacctgctgctcgccgtccgcaacgaccaggagctcggcaagctgctcgccggcgtcaccatcgcccacggcggcgtgatccccaacatcaactccgtgctgctcccaagaaagtccctgccggcgncgagaaggaggccaagtcgccaagaaagaagaccaccggcaagtcttccaagaaagaaaacgggcgcaccaaaggagtagcccgcccgtagcctatctgacccttttaaaaagggnttttttttttttncccccccgngggtt

SEQ ID NO: 103256 - DNA, 581 bp, Triticum aestivum
  unsure (1)..(581): unsure at all n locations
  Clone ID: PAT_TA_103256
ggcacgaggatccagcaccgccgccgtttacaccacagcatctcgtcgacggagaggtagcaagcaagatggccggaaggaagggtggcgacaggaagaaggcggtgaccaggtccgtcaaggctgggctccagttccccgtcggccgcatcgggcgctacctcaagaagggccgctacgcccagcgggtcggctccggcgcccccgtctacctcgccgccgtcctcgagtacctcgccgccgaggtcctggagcttgccggcaacgcggccaaggacaacaagaagacccgcatcatcccgcgccacctgctgctcgccgtccgcaacgaccaggagctcggcaagctgctcgccggcgtcaccatcgcccacggcggcgtgatccccaacatcaactccgtgctgctcccaagaaagtccctgccggcgncgagaaggaggccaagtcgccaagaaagaagaccaccggcaagtcttccaagaaagaaaacgggcgcaccaaaggagtagcccgcccgtagcctatctgacccttttaaaaagggnttttttttttttncccccccgngggttnnaaaa

SEQ ID NO: 103257 - DNA, 582 bp, Triticum aestivum
  unsure (1)..(582): unsure at all n locations
  Clone ID: PAT_TA_103257
ttcgctgttntctccgcctccttctgtgnncangacgccngtttttccctgctacccaaggtcctatcactcctcagcactacttnaacagtgattctagcaactgtgcccttattaagcaccgttctcttaccactaacggtgccgagggttgcaccaactgcaacaaccgcaacaacataatccttacagctgtcttagtaatcacagtgggcacaacaatttaattatcagtaacaatgagcctagggcctgctcggattacactaccatgcctgattataatagcgataaccacgattcgcatattatatgaaagccgcttcgccactacagcgatatgcacagccttgtgtcttatcgcgcacagtttttgctaggtacagtagtaacattctcagcgtaatggtaactgagctaacacacataatattaactacggttataatggtaacagtaacggtttttggcgcgattaaaaccgtaccttattaattaccaactggcaacattattgataacctaatcaccttcaatggcggtagcgcaggccctgcgccgccagctggcggaaaacggcaa

SEQ ID NO: 103258 - DNA, 772 bp, Triticum aestivum
  unsure (1)..(772): unsure at all n locations
  Clone ID: PAT_TA_103258
tgtggncgaanatcttcgcctccttctgtganatgacgccnntttttccctgctaccnangtcctatcactggctgtttctagttttctcttctcttcttcttcttcttgttcacttttgtcaatttattgtctattagcctccactacattcacaacgtgggttgtaactacttaaaccggggttgtactatcaacaacctgcataacctaaacaccttgcctaacctgcctaattctggtgccaacacgcggccttggccgggtaacattttaacccaactcagtcagccgattgataggcataacaacgctttaggtatgccaatgcggcttagtacccctacaagtagactgccaattgcttatacgcttaacagcaattccattagtaggcggtctaccaatgattggtaggggcgcaacaagagtacaccgagcacaacacctatgttaatagtttatgtatagtgtttttgctggttcgcgtaaccaactcattagcgtagtaggccttacgctacttttgcgtcaaaattcgcacaggtaagcgttgcaaacgtcggttatgccaattattccaactcccaacaaactgggtagtctggcttgaantttacatgtgcagggagcaagaccgtagaagtacaatgggggtctatggccaaagtgattactgcngccggtcaaaaggcaggttnnccgagtgcgtaaattcagcgntgccntggcnatagcgggcncccantgagtgagtangaanaacggtttgg

SEQ ID NO: 103259 - DNA, 688 bp, Triticum aestivum
  unsure (1)..(688): unsure at all n locations
  Clone ID: PAT_TA_103259
ggcacgagcgcccatttccctccacaccagcccgacacctcntgctccatcccgatcgatggcgcccaaggccgagaagaagcccgcggagaagaagccggccgccgaggtcgccgagaaggccgagaagacccccgccggcaagaagcccaaggcggagaagcggctgccggcgtccaagtccgccaaggagggcggcgacaagaagggccgcaagaagaacaagaagagcgtcgagacctacaagatctacatcttcaaggtgctcaagcaggtgcacccggacatcggcatctnctccaaggncatgtccatcatgaactccttcatcaacgacatcttcgagaagctcgccggctaggcggcaagctggccaggtacaacaagaagcccaccatcacgtacagggaaatncagacctccgtncggctcgtactacccggngagctcgccaagcacgccgtttncgagggcaccaaggccgtcaccaagttcaccagcaactagggtntccgtcgcggtgtctctagggttccgtncccgtggtctcttctaggaactttngtgtccngtctgtcgtgcccatgttgtatcggtataggtaggtagcgcgcctgctttgtaaatcgtgcaagntggagatggacngntttgaattcaattaatgggagaaggttgagtgngactt

SEQ ID NO: 103260 - DNA, 582 bp, Triticum aestivum
  unsure (1)..(582): unsure at all n locations
  Clone ID: PAT_TA_103260
ggcacgagctccttctctctccaccctttncccaaatctcacgccgcctccatcgccttcttcctaacgcccgccgcgccctcgcccgccgttaacgccctcgccgtcgtcttcgccgncgcggactccagccacatccgagtccaaatcgacctcgccggngaaacgggcggccagaccggcccccgnggnatncccaaaaagntgnattcatggatngactncaacgncacatncggcacgctncaggtccgtctctttgnctngngccttcccaagccggcgngcgcgctgntnttccanccggtncatnttcanttcggccttcttcttcggagnaccnagcccatgctngncggattcgnattcttccangncaactgganncttttnanctnggcctttaaggncaancangggccttcctancttaagnanttccaggcanttaatccancgggttattnggttaacaaagnccggttgcaaaacggctttcccggggtttcccnggnnaaacggttnccctngggttttgggncnttttttngggggggnccnttttngggggggggntttttt

SEQ ID NO: 103261 - DNA, 210 bp, Triticum aestivum
  Clone ID: PAT_TA_103261
aagttcaaaaaggatttagaataaagctatcgagtcaaaataattacttggttctcattctacaaggcgggagaaaactagtgcgtctatagaactatcatcagtatctcctaggtagaatcaaatcaatgcaaagaacacggctgtgctgaaactcatgagactactttctgctgaagttactgcctacattcacaatggacaccaaaa

SEQ ID NO: 103262 - DNA, 477 bp, Triticum aestivum
  Clone ID: PAT_TA_103262
ccccagccaaacttctctctcgccttcgaagaagcagcagccgccgccgtagcatccatggcacccaaggctgctgagaagaagcctgtggagaagacccccgcgggcaagaagcccaaggcggagaagaaggtgccggcgtccaaggagggcggcgacaagaaggggaagaagaaggccaagaagagcgtcgagacgtacaagatttacatcttcaaggtgctcaagcaagtgcacccggacattggcatcttctccaagggcatgtccatcattaactccttcatcaacgacatcttcgagaagctttccggcgagtcttccaagctcgccaggtataacaagaagcccaccatcacgtcccgggagatccagacctccgtccgcctcgtcctccccggcgagctcgccaagacacgccgtctccgaggggcaccaagggcgtcaccaagttcacctcgtcctaaggctcctccg

SEQ ID NO: 103263 - DNA, 394 bp, Triticum aestivum
  Clone ID: PAT_TA_103263
ccggaaaccgactccggcaggcggtggacgctgggaacggtggcgatcctcggcaactgcgtctgcctcgcctgctggtacctgcttcagggcaggatcgccaggaagtacccctacgtctactcctgcaacgccttcctgtccaccttcagcttcctccaggtcgccgtcgtcggsctctgcgtgcagcacaacctctccgcctggatcatcaccaacaagttccagatcctcaccgkcctctamtccggcgtggtcgcgaccggcatgtccttcgtgctgctgacgtggtgcatccagaagcggggggctgtgtttgtcgccgccttcatacccggtgtcgcaggtcatcgtctgcatcatggacttcaccatacctgcatgaaccgctcta

SEQ ID NO: 103264 - DNA, 645 bp, Triticum aestivum
  Clone ID: PAT_TA_103264
aaccgatgagatgggtaacggacttagttagctacacttttyttcttacttctattgtcaatcaatgtcatattctgttaaaaggaggctcaaaaggtttctgtcaccagactcgctgcagatcaattgatatcatgaatggctgtttatttgaaggtgcttcagatgagcgtcttgcctgctgctaattatgttgttcttgcagtgtggaccctgtggaaaatgtaacttgtaacatgggacaatccaactgtattttgcaaccttttgtccctcgctgactaaattgggtgccttgtaggaacatttagataggacttctaatgagattttctctcttatgattaggaaatctgaataggtgtttttgatgaaatcattcttaagactagaagcaaccaactatttcatttagatgggacttctaatgagattttcttaaaggttagaacacctgggtagtttgtttgtgatgagataatttcgaagactaggagcagtccattatgctgaccaggcctgtggtaaaatcattgatgtcgcatgagtgtgtattaaaaaaaagtcattgtattatatggaatgaagctatgttcctcgtgccaatgaggaactaattaattcaccaccgcctgtgcttgtttc

SEQ ID NO: 103265 - DNA, 329 bp, Triticum aestivum
  unsure (1)..(329): unsure at all n locations
  Clone ID: PAT_TA_103265
cgaccagcgccctcgcaccttccggcgaatgancgcacctstvcccggcgaagagncagcgtccgadggcccccaaggcggagaagaagccggctgcvgcggagaagactccggcggccgagaagaccaccgcgggcaagadgcccaagggcgagargcdggcgcccaagtgcaaggggggcggcgccgacaagaagaagaagaaggccaagargagcgtggagacgtacaagagctacatcttcaaggtgctgaagcaggtgcacccggacatcggtatctcctccaaggccatgttcatcatgaactccttcatcaacgacatcttc

SEQ ID NO: 103266 - DNA, 762 bp, Triticum aestivum
  Clone ID: PAT_TA_103266
cttcctgagactctgtccaggtgccagatctgcaacagtacagaacctggtggatcgtctaaaaaacattggtgatctgctgtctgtaactgttacccaatatggtgatctccatctacaagtttcaacttctcttgttaccgttggttcagaattcaaaaggcttcggattcttggtgctcgtgcaaatgcacctgttgttgatcaaaatgtgagtgctaccattcgtatggaaatggcggttgagagaggcgaagcactgtcagtgcaagtgagtatgaagcacctagttaagagcctacaatgtcatttggccaagccagattgtaccttctatggtattgctcccaatggtgcttgcttgacagtgatattccagtacttcattccaggaacacggttgacggacaaatccattagcttttactgtaggcttccagtccttgaccctggcaccagctaaagtaaactatatcacagcatggtacttacttgcttttattatcagtagattaggttaggtaacattatctagctggtgtgcctttagttttatgacttgtttgtggctttcatatatattaacttgatgtcttgcgttggtgacattcgggtgtgggtacctcaatatcgaccctgaaaaatacctgaatcgttttgatctacaaaaatgttgtgctagtttctttgttccagattatmacttgcagttgcatgcaccccttttccacttcaatataaattatttgatgttttttgtct

SEQ ID NO: 103267 - DNA, 338 bp, Triticum aestivum
  unsure (1)..(338): unsure at all n locations
  Clone ID: PAT_TA_103267
gcgctcgcngcgtcgccgtcattccccgccgccgtcatctgcgcctacctcgccacggtgctcctcctccaccgccgcatcctgcccctcccgcccctcccgccgcgcgccctccgcgccgtctccgcgctgcacaactgcgtcctcctcgccctctccgccgcgatggccgccggctgcgtgctctccgccgcggccacggcgccctcgccgcgctgggccttctgcttcccgccgggcggcgccacggagccgtcgggcccggtcttcttctgggcgcacgtcttctacctctccaagatgtacgagctcggcgacacgctgctcatcctcctcgc

SEQ ID NO: 103268 - DNA, 391 bp, Triticum aestivum
  Clone ID: PAT_TA_103268
csaccagccccctcgcaccttccggcgaatcaccgcacctctccccggcgaagagcagcgtccgatggcccccaaggcggagaagaagccggctgccgcggagaagactccggcggccgagaagaccaccgcgggcaagaggcccaaggccgagargcdgccgcccaagtgcaadgrgggcggcgccgacaagaagaagaagaaggccaagaagagcgtggagacgtacaagadctacatcttcaaggtgctgaagcaggtgcacccggacatcggtatctcctccaaggccatgtccatcatgaactccttcatcaacgacatcttcgagaagctcgcdggcgagtwcgcaagctcgcccgctacaacaagaaggccaccatcacctcca

SEQ ID NO: 103269 - DNA, 317 bp, Triticum aestivum
  unsure (1)..(317): unsure at all n locations
  Clone ID: PAT_TA_103269
cccagctatagcctctcccctctccaccttccaantatcactcctaccgtctcttctcagggtcaaactccgatgatcagaaaaacaacggcaataaaggtatgadaattcgtttctacagaatatcttctactccggaggggcaggaacaagcgacaaaaaggtagagaaaaatgaagaggttttcaagggaccaagacgcgtggtagtcaacatcaccgacatcaaacgaccacccctacctcaatatgtcgacaagtatccaccctgctcgacccaccagtgccaccacagtgatcatgagatagcttgttatg

SEQ ID NO: 103270 - DNA, 857 bp, Triticum aestivum
  Clone ID: PAT_TA_103270
ccatcacatgcttagtcagaaggagaagataatctactgcgggtggcttgataggtttagggggatttttgatccatgttttgttgcaagtgcacagcttaattataattgtgtttctgtgcacccggtggatcatatgaagctaatttttcttgcatttccattgcaggaagagctttgcagggatgctggtgaaactaactgggattacattagcactatgatgcaccctgatgtgatgggatgtagaattgattgggtgaagaagaagaaaattatgatagtccatgaaatgactgagaccgatccggcgtgtgagatgaaaatcaaacatgaggctttagccaagaagttccaacataggttctgcaccttattcaacgacatgttcggtgctggcttggttgagacccgtggattgtcgtttgtgtatccgttggtggctcaacatgggcaatgcagcagtggagtgtatatcttgcactacttcgtcgagttcatcagactacctacaatcaacactaacccaggctcagatcgagcacttgcgcaagaagtttgcctacgaaatagtgaccatgaagggaaacaatggggatattccggagctcttatacgacataatcattgactgaagtgaaggcggtggtactctgagagtgagtgcagtcaggcaagatcttttggttgtgcttgtgataaaccctagtttgacacgagtgagttggcgtgccattttgcatcacaaaatccccagccagagtaatgttatgttgtaccttgtaaggattaagtttgcactatctatatttgaggaacaagcttgggaaaagttttttcaaacggaggaagtactt

SEQ ID NO: 103271 - DNA, 866 bp, Triticum aestivum
  Clone ID: PAT_TA_103271
ccggtcccggcgaagaagaaaacggagaaggtgaccaacccgctgttcgagaagaggacgaagcaattcggcatcggtggcgccctcccgcccaagaaggacctccaccgcttcgttaagtggcccaaggttgtgcgcatccagcgccagcdccgcatcctcaagcagcgcctcaaggtgcccccggcactccaccagttcacccgcaccctcgacaagaaccttgcaacaaacttgttcaagatgcttcttaagtaccggcctgaagacaaagttgccaagaaggagaggcttctaaagagggcccaggctgaagctgaaggtaaaactgttgaggccaagaagccaatagttgtgaagtatggccttaaccatgttacctacctaatcgagcagagtaaagcccagctggttgtcatagctcatgatgttgatccgattgagctggttgtgtggctccctgctctttgcaggaaaatggaggtcccttactgcattgtcaagggaaaatctcgccttggatcgattgttcacaagaagactgcctctgttctgtgcctgaccacagtgaagaatgaggataagcttgagttcagcaagatccttgaggctattaaggcgaacttcaacgacaaattcgacgaggttaggaagaagtggggtggtggtgtcatgggctccaagtcgcaagcgaagaccaaggccagggaaaggcttatcgcaaaggaggctgcgcacggattgaactaagtttagcattgttgaaccatatctattcctcatccttgagtagtgtgcaagcatactgtggcagtttggctccagttttgaaagtcatttttgtttgtctgaaacatcttggaaga

SEQ ID NO: 103272 - DNA, 398 bp, Triticum aestivum
  unsure (1)..(398): unsure at all n locations
  Clone ID: PAT_TA_103272
ggnaggtgaggcgtaccaagaaccctagcctccggatncatccatccgcccctcgctgccgctgcatctcgtctccaccaccccacttgcccccggacccaggaggatcgtcggagatgtcggacaccgatgagcaccacttngagtccaagggcgactccggcgcctccaagacctaccctcagcaggccggcgccatccggaagggnggacacatcgtcatcaaggcccgtccctgcaaggttgttgaggtctccacctncaagactggccgcgtttggncacgcaaagtgtcactttggtgccattgacatctttaatggaaagaacttgaggatatcgntcttcatnccacaactgngacgtccccatgttgaccgcaagaatatanctgattg

SEQ ID NO: 103273 - DNA, 400 bp, Triticum aestivum
  Clone ID: PAT_TA_103273
tacaagatctacatcttcaaggtgctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttg

SEQ ID NO: 103274 - DNA, 450 bp, Triticum aestivum
  Clone ID: PAT_TA_103274
gtccgacggggtccggcaagacgcataccgtctttggtactgcgagaaatcccggcctggtaccgctcacgctacagaagatcttcgccgcggcagatgaatccgaaggtggcaaccaatcgccaaggtcattttacttgtcaatgttcgagattctctgtgaaggaaaaggagaacagattctcgatcttttgtctggtggagcagagctggtcctccagcagtcagcaacaattaaaggccttaaagaggtggccatttcaagtgccatggatgctgagagcgtagtttcacgtggcatgcttaagcgcagcacagctgcaactgatgctaacagcgagtcaagccggtcacagtgcatcataactatacgtgctgttcataaaaaaattgaacaacaaagtgagtaccctattagtggatctgtcctgaccattgcagaccttgctg

SEQ ID NO: 103275 - DNA, 845 bp, Triticum aestivum
  Clone ID: PAT_TA_103275
agacgagcaggcctagcttcctagcagcagcagccagagagatattttatgctagtcgagtagatgaatctcttcaccacccacccacccctcgtagagagagcgagctttagagcccagagcgaccaatgagacctagcgcctcctcctggtaggttcaatgagccgagccagagcgcgagctttcggaatgcgaacgaggccctaagaaagttgtgctctttccaagcttcttcgatttggttaaactcctcggcatctccgcaccaccattcacttcttgccggcgcccttgggttgggccgtccaatcccggcgcaatcgtcgattccgtcacaacttccaaagaagctgcgtcccctttccaagtttaattggaagcacgaatgggaagtccccttggttggcttcccgggtggcaagggtggggccctggggaattcccaattggaatcccccttttcttaagaaatttctttgggctttaaacccccgaaagttctttcttaggggcccaacccgggtacgggaaattccccccaaattcgggcccttttcaaaattttcccgggtttcaaagcccaaaccccaaaaaccttttgggccccttttctttttcgggggggcttttgggaaaccgtttcccgggcggggggcccccggggtgccctttttttggggaattgggggtgtggggcttcccctttcttgcaattgcaagttttggcaatggctaaattcctttttccgaaagggctccaatgcttggaatgcttgaatttgcaaggaaatcctgatcattgtgggaggggaaattgcgggttctttttttaagggccaggcaa

SEQ ID NO: 103276 - DNA, 478 bp, Triticum aestivum
  Clone ID: PAT_TA_103276
ccaccagcaccttccggcgaaccaccgcacctctccccggcgaagcagcagcgtccgatggcccccaaggcggagaagaagccggctgccgcggagaagactccggcggccgagaagaccaccgcgggcaagagcccaaggccgagaagcggccgcccaagtccaaggagggcggcgccgacaagaagaagaagaaggccaagaagagcgtggagacttacaagatctacatcttcaaggtgctgaagcaggtgcacccggacatcggcatctcctccaaggccatgtccattattgaactcctttattaaacgacatttttcgagaaagcttcgcccggcgaagttccgccaaagctttggcccggtttcaaacaaagaaagccccaccattcaccgttccccggggaagaatcccaagaacctttccggtcccggcctttggttccctttccccccgggccaaaggcttttggccc

SEQ ID NO: 103277 - DNA, 568 bp, Triticum aestivum
  unsure (1)..(568): unsure at all n locations
  Clone ID: PAT_TA_103277
ccagctcggtcgccatccgccaagtacatccgaggagaagcacggcaaggctctcccggccaacttcaagaagatgctctccgtccagctacgcgcctccgccgccaagggcaagctcgtcaaggtcaaggcctcctacatgctctccgacgccgccaagaaggacgcgcccaagcccaaagccgcggcgaagccctccaaggacgccgccaagcccaagaagaaggcggccgagaagcccaagaagaccgccgccgctggcaccaagcgcaaggcgcccgagaagaaggaagctggtcaccaagggccaagaaagtcgcccgcttgccaaaggccaaaggccgaaaggcccgaaggaaccggtcccggttcccccgggnccggcaaaggaaagggccccgcaaagggtccgccccgcccggccttggaacctggaancctggaatccccgggncccggattaggccttggggccctttaagggaaagtggccttnggaatggttnccccaaaggggggccttgggncccaaaaaaggggatggccctcaaatnccttcccccttggg

SEQ ID NO: 103278 - DNA, 439 bp, Triticum aestivum
  Clone ID: PAT_TA_103278
actctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgcccgcatttccacttctcaagggagttgttgcaacaactgatgttgttgaggcttgcactggtgtgaatgttgcgggtatggttggtggattccccaggaaggaaggaatggaaaggaaggatgtatgacgaaaaatgttcaatctacaagctaagcatctgctttgaagctatgcagcccaattgaagggttgggtgtgcaaccagcaaacc

SEQ ID NO: 103279 - DNA, 424 bp, Triticum aestivum
  unsure (1)..(424): unsure at all n locations
  Clone ID: PAT_TA_103279
caaacacctcctccctcactcccacctccgaagcttcagcggcagccatggcccccaaggcagacaagangcccgcggccgagatcaaggtcgagaaggcggcggagaagacccccgcgggcaagaagcccaaggccgagaagcggctgccggcgggcaagacggcgtccaaggaggccggcggcgaggggaagacccggggcccggaagaagggcagcaagggcgaagaaaggcgtggagacgtacaagatctacatcttcaaaggtgctgaagcaggtgcaccccgacatcggcattcttcttccaagggccaatgttccattcatgaaacttcctttcattcaaaccgaaccattctttccgaagaatggctttcgccccggccnaaggttnccggnccaaagggcctttggnccccggtt

SEQ ID NO: 103280 - DNA, 427 bp, Triticum aestivum
  unsure (1)..(427): unsure at all n locations
  Clone ID: PAT_TA_103280
cacctcaccaagacaggtctacctcaccggagatatatgatgatatgcgaagatgtcggggcgcggcaagggaggcaagggtctgggcaagcngcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatcccgcgacgccgtcacctacaccgagcacgcccgccgcaagaccgtcaccgcatggacgtcgtctacgcacttaagcgccagggacgcacccttctacggatttcggaggctagggccaccaccaccagatttagaagtgtcttgggggttccgtgggccgttggatgtaaatt

SEQ ID NO: 103281 - DNA, 426 bp, Triticum aestivum
  Clone ID: PAT_TA_103281
gaaggccaagaagagcgtggagacggtacaagatctacatcttcaaggtgctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttg

SEQ ID NO: 103282 - DNA, 351 bp, Triticum aestivum
  Clone ID: PAT_TA_103282
ccaagtcagaagcagccaactatgagaaggggtacggagaacccatgcctgtaaaggaagtagctgaccgtgtagcgagctatgttcatacagcgtacacgctacgtgaaaagctcaggccttccggccgtggaggccatgtgggaggctatgatagggacaggccacagctctacatgaacgacccttcaggcctctcctataaacatttgggcgctgcgccgggcaaaggaagacaagctgccaaaacggagattagaaaaattcaagctaaatgagctaacctgcagggaatgcatcaacgaaggttgccaagataattaaggcgcacacgacgaaacagaaagacac

SEQ ID NO: 103283 - DNA, 404 bp, Triticum aestivum
  Clone ID: PAT_TA_103283
ccagatctgaaccgtccacctttagggggggcccgactacccctagaccctatatttgagtgcgtcatacaacgacacttggaacgtccctttacagcgaaaatggctgggaaaacccggtccaaacacccctcagtgacgttgcagtacatcccacagtggccagctggggtaatgaccacaaggcggggaccaatcgcccgagagaccactagcacatcatggatggcgaacggaagatggcgggcctcaataatccggacaaatcatctagagatcatcgtgctatccgctcatagactaaccaataggcccaaacttgcaaaactccgttctcatataggaatacaccgagatagggtagaatggtgctccccagccgaacaagaatccactattaaacg

SEQ ID NO: 103284 - DNA, 470 bp, Triticum aestivum
  Clone ID: PAT_TA_103284
ccaaccaatccaccaagcaaaccccgatggcccgcacgaagcagacggcgaggaagtccaccggcggcaaggcgccgcggaagcagctggccaccaaggcggcgcgcaagtcggcgccggccaccggcggcgtgattaagccgcaccgcttccgcccgggcaccgtggcgctccgggagatccgtaagtaccagaagagcacggagctgctcatccgcaagctgcccttccagcgcctcgtcagggagatcgcgcaggacttcaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcaagacgcatccggggcgagagggcctaggatagtgtctgtctcttctgcaggtgtagagat

SEQ ID NO: 103285 - DNA, 530 bp, Triticum aestivum
  Clone ID: PAT_TA_103285
tccatctccaaaccgcagcagcagcaacccatccctcgccgccggtcggccccagcagctccgatggcccgcaccaagcagacggcccgcaagtccaccggcggcaaggcgccgaggaagcagctggccaccaaggcggctcgcaagtccgccccggccaccggcggcgtgaagaagccgcaccgcttccgcccgggaaccgtggcgctccgggagatccgcaagtaccagaagagcacggagctgctgatccgcaagctccccttccagcgcctcgtgcgggagatcgcgcaggacttcaagaccgacctccgcttccagtcctccgccgtctccgcccttcaggaggccgccgaggcctatttggtggggctcttcgaggacaccaacctgtgcgccatccacgccaagcgcgtcaccatcatgcccaaggacatccagctcgcccgccggatccgaggggagcgcgcctaggctctgtatgcgtcccgtgtccgctgctcttggttcctgctagatgtttatgactc

SEQ ID NO: 103286 - DNA, 550 bp, Triticum aestivum
  Clone ID: PAT_TA_103286
cggcggcgcgcaggcgaatcagcagcggagccaagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagcaacaatgtccagaggaagcttgagaagcgccagcag

SEQ ID NO: 103287 - DNA, 439 bp, Triticum aestivum
  Clone ID: PAT_TA_103287
cgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccaccagattagagtgtctggggttcgtggtcgttgatgtaattgcagcatctcgctgttgtttgctatcttctgtagaatggaatggaatggaaattgaactagtttatccttg

SEQ ID NO: 103288 - DNA, 439 bp, Triticum aestivum; identical to SEQ ID NO: 103287
  Clone ID: PAT_TA_103288

SEQ ID NO: 103289 - DNA, 400 bp, Triticum aestivum
  Clone ID: PAT_TA_103289
cacgtgccgtcttcccctcaattgtcggtcgcccacgtcatcagggtgtgatggttggtatgggtcaaaaggattcgtatgtcggtgatgaagcccaatcgaagagaggtatcttgaccctcaaatacccaattgagcatggtattatcaccaattgggatgatatggaaaagatctggcatcacactttctacaatgaattgcgtgttgccccagaggagcatccagttttgctcaccgaagccccattgaatccaaaggctaatcgtgagaagatgacccaaattatgttcgaaaccttcaattcgccagccatgtacgttgccatccaggctgtgctctccttgtacgcatccggtcgtacaaccggtatcgtcttggactctggtgatggtgtctc

SEQ ID NO: 103290 - DNA, 438 bp, Triticum aestivum
  Clone ID: PAT_TA_103290
cttaattgtaattacgcgtccgagcctggcacgtcaggaggccctattctcaaggggaatagggttgttggggtaaactctgattcttttggaggacacaagttttccatctctgtcataggtgtatgcaacacactgcggaggtggcttaacatggaaaatagcggtgttggaatcgatgacatgctagcaatgcttgctcgggaatgaagaatctagcaggactggtgaaaactgcatcgtcggaggcaacatgagaaggttccatgagcacggttgctcactaataacgcatgacccaggggttgtagttctagtgcactctaccactagtatgtttagtttgatttctggatatttagtattatcatttgtaatatgtgcgtctttgtcatgatgtaacccatgagcgtatgttatgtgtagttttaatgttcc

SEQ ID NO: 103291 - DNA, 600 bp, Triticum aestivum
  Clone ID: PAT_TA_103291
ctcccatctccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacgttaacattgtctcaaatgctagctgcaccactaactgccttgctcccctagctaagatcattaatgacaacttcggtattattgagggtttgatgaccactgttcatgccatcactgcca

SEQ ID NO: 103292 - DNA, 580 bp, Triticum aestivum
  Clone ID: PAT_TA_103292
gacaaacatcatgctgaaattgtgtctcagttggagtgcaaaatccaagaatccgtggcaatgaaagaggagcttcagaaacaatatgcctctttaggagagagcctaaagaaagtggaagctgaacaaatggagtgccttcgatcttatggagacgaaaaggaggctaggattgctgcagaatcttcaaggaacgagctttcagaagaactcaacagagttaagttggagcagaagcgtcttaatgatcagatcaagatgcttcaagatacaaataagaggcttcaggaatacaacactagcttgcagcaatataattgcaacctccaagctgacgcaacaaagaatgctgaaacaatagacaagctgcaaaaagagaagaatactatggttgaaacaatgaatggtttgaaagatcattctaactcagtaaagttgcagcttgaaatggcaaagtcttcacagagtgaagcgttgaaacaaaaaaataacttattgagtgaggttgaagctctcagaggtgaattacaccaagtaagggatgaccgtgatcataaatcagctgaaataaattcgttgt

SEQ ID NO: 103293 - DNA, 518 bp, Triticum aestivum
  Clone ID: PAT_TA_103293
aacgaagttgctgaggttttagatacattccatgtgttagctgaacttccctctgatagctttggtgcgtacgtgatatccatggcaacagctccttcggatgttctagcagttgagcttctgcagcgcgaatgccatgtgaagaagccactgagagttgtgccgttgtttgaaaaactagcagatttagaagctgcaccagcagctctggcacgactcttctccgttgagtggtacagaaacagaatcaatggaaaacaagaagtaatgattggttattcagattctgggaaggatgctggccgtttctctgctggttggcaactgtacaaagctcaagaggagcttattaaggttgctaaggcttttgggattaagttgactatgtttcatggaagaggagggactgttggaagaggtgggggtcctacccatcttgctatactgtcacaacctccagagacaatccatggatcacttcgggtaaccgtccaaggtgaagtcattgagcagtcctt

SEQ ID NO: 103294 - DNA, 450 bp, Triticum aestivum
  Clone ID: PAT_TA_103294
ctcgtgcagatccccatgtacaacgagaaggaggtgtacaagttgtccattggagctgtttgtgctctcacatggccgccagaccgtattataatccaagtcttggatgattcaactgatcccattattaaagaactagtggagcttgaatgccaggagtgggccagcaagaaaattgacataaagtatgaagttagaaataacaggaagggatacaaagctggagctttgaagaaaggcatggaacatgtatatgcgcaacagtgtgaattcgttgctatcttcgacgcagatttccaacctgaatctgacttccttttaaaaactataccatttcttgtgcataacccgaagattgcgcttgtgcaaacacgctggaagtttgtgaactacgatgcttgcctgatgacaaggatacaaaagatgtccctggactatcatttcaaagtc

SEQ ID NO: 103295 - DNA, 400 bp, Triticum aestivum
  Clone ID: PAT_TA_103295
cgaagatgtccggccgcggcaagggagggaagggcctcggcaagggcggcgccaagcgccaccggaaggtgctgcgcgacaacatccagggcatcaccaagccggcgatccgccgtcttgcccgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgtcaggggcgcaccctctacggattcggcggctgacctgcgcccgctgctccaatctccaatctccatcgactctgactctgctagctgctgttctggtgctatggtttcgtttctga

SEQ ID NO: 103296 - DNA, 400 bp, Triticum aestivum
  Clone ID: PAT_TA_103296
aaccaaaccccagctccatggcgacggtggcgatggacatctcgaagcccccgccggccgcgtccggcgacgagtcggccaagggcgcgcgtggcggaggcgaggggttgcgccagtactacctgcagcacatccacgacctgcagctccagatccgccagaagacgcacaacctcaaccgcctcgaggcccagcgcaacgacctcaactcccgagttagaatgcttagggaagagctacagttactccaagagcctggctcttatgttggtgaggtggtgaaggtcatgggcaaatcaaaggttctagttaaggtgcatccagaaggcaaatatgtagtagatattgataagagcatcgatatcacaaaaatcacaccttcaacaagagttgctcttcg

SEQ ID NO: 103297 - DNA, 490 bp, Triticum aestivum
  unsure (1)..(490): unsure at all n locations
  Clone ID: PAT_TA_103297
ggcacgagcatactgatcccatttacatactatgcaaaactggacggccttctaaatatttaaaactactatttgttgtgtaatctgtatcacctcttcatactctgtatatgctttcgacttactccctccgtctgaaaaaacttgtccctcaaatacatgtatctagcaccaagttagtgctagatacatccatttgaaagataagcttgagacaagtttttctggacggagggagtactaggtaaaagtgcgtgagaatgatggccttttattcattcaagagctctaaatgacaccgttgtattggcaacatattcagtcatttcggatcatcttgttggtgtgtgctgtaaaatgagttgtgacatttgttggtatgtgctgtaaaaaactgaaaaaaagcagttcatgtttatttttcttctgaattttgntcccctgtaagatgtggcctactgnatactcttgggataaatgagtgtgacat

SEQ ID NO: 103298 - DNA, 495 bp, Triticum aestivum
  unsure (1)..(495): unsure at all n locations
  Clone ID: PAT_TA_103298
ggcacgagcggagatggaacgannggcgtgttgccgatgccgtcgtgatggaggacgagaggtcggtccgcttgatcagccaggaccatgatctcgggttcctcgacatccgttctcggggctctgtccaggagccgtggacatattgtaacacgacgaccccgacgtgctatccgaagctcgccgtgcacggcggactgctcttagcgtccaaggatgacagcatctcggtgtatggcggcccaaatcatgaccgcctgaggctggcgctgcgtgggagccaaggcggtggcgccattgccgacttctccgttgggggcgaccgtctcttcgcggtgcatcatgaggacaacgtgccggatgtgtgggagacactgccacctcccatcgctagtatttaggctatcgtcattgatctacattcgtaccagtctaccggggcttggatagtgagcccggcttcagatcgtaatatatatttgtgctttggaattg

SEQ ID NO: 103299 - DNA, 400 bp, Triticum aestivum
  Clone ID: PAT_TA_103299
ctcccatcacaaaaccaatcctcctccgcgccccgatccccaagagcatcacctgcaagcaatggacgtctcaggcaccggagctggcgccaagggcaagaagggcgcggccgggcgcaaggccggcggccccaggaagaagtcggtgacgcgctccgtcaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccggaaacgccgccaaggacaacaagaagagccgcatcatcccgcgccacctgctgctcgctgtcaggaacgacgaggagctcggaaagctgctggccggc

SEQ ID NO: 103300 - DNA, 480 bp, Triticum aestivum
  Clone ID: PAT_TA_103300
aggcggagaagaaggtgccggcgtccaaggagggcggggacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctcttcctcgtctgatgaattctgtagctagctgtgtgtgttctgacagtgtcatcttgtaacaatggtgctgcctgaataaatagtcgtgttgctgcttg

SEQ ID NO: 103301 - DNA, 500 bp, Triticum aestivum
  Clone ID: PAT_TA_103301
cttccgcgggacactatggcacggcgggctgaggaggacaggaggttcgacttgatcagcagcttcctgttgggctccgagaaaggccatgcgctcaccgcaggccggctggccgggcagcccctggtcgatgactggcgctgtctcgagaccatggtgagcagctacgaggatcactgcggtccgctgtcgacctacgggcgcaagtacctccgggtgcttgccagcgtctgcaacgctggcatcccagaggaggtcatggcgaaggcggcatctcagctgtgctggtaagtgtggttgtaaggatccgagatggttggagttgctatatgtgagtcagctgcttttctactactgcgttttaggactgttttcagtgcccaagctcgtgctaataactagggagaacagagcaccacatttgcttgtgcgcgcaagacgtagcagcgctgctttcttaattatgaaggaaaatattgtacattagaaaactactacaa

SEQ ID NO: 103302 - DNA, 567 bp, Triticum aestivum; identical to SEQ ID NO: 103236
  Clone ID: PAT_TA_103302

SEQ ID NO: 103303 - DNA, 954 bp, Triticum aestivum
  unsure (1)..(954): unsure at all n locations
  Clone ID: PAT_TA_103303
ggcacgagccactctccaccggccgcctcctcctcttcgacccagggccagggaggatttcacccgccgaggctgagccgagtcaccggtcagcccctcgcttccttcccgctctcgcctcctcggctcttcccccgctgcccggcgccaccgcctccgcctccgccggcagccgggaccgtggagcaacggcatgtctcttgatctcttctcctctaggttcttgttttcttctggcgctgcgaagaagctccccagcaggagaagggtcacgttcgttgctgccgcttcttcgtctccgtccacaccatcgccgccacggtcgcaggatgcctcctcttcttccaggcaaaggagtgtacgtgccacgccgttgagtcccagcaaaggtgcgtctcgacctgccggtagcaatggcaggactaggaggaggaggcagaggaggacggtcgagggagggcaagaacaaggcggctgcgtgccgtcggtggaggaggcgtccataagggtagggacgctgtatgagaacggcgatccactagggcggaaggagcttggccggtgtgtcgtggagtggctaaggcaggggatgcagtccatggcattcaaattcgctttccgccgagcttcanggtgacatggcggactnaaccacagcggcattggactctgaattggggatcggcagaaggccagcttgggtttgggatccaggcacaggcttaatcttttcgtccatncccatgcccaaagggtctggaagtcacttctgnttttaaaggcctgtacgcactaaccccaccnttttngaacaattttcaagggtgagcttcctgctggcctgcctgaagttattaagaaccagggggctnantttacaatgggggttcaagcanaaatgggaaattgttaaaggnaaagggccaatntaattattaaccgaacaanttggcg

SEQ ID NO: 103304 - DNA, 1000 bp, Triticum aestivum
  unsure (1)..(1000): unsure at all n locations
  Clone ID: PAT_TA_103304
ggcacgagctgtcagttacttcccctactctcagttgctctcctcttcgtctcctcttccgatccagagctagggttcatcgagttttcctctcctttgtgtccccccctctcactttctcgtctgatctactctacttttgtggttatttagctgttagttttgtaccttttgttgttctatatgcaggatttgctctcagggatttcttgggttagggatctttgtgctccatctgcttgttcaggcttctttttttattttatgcgggcatggtttgccctatctgccataatccggatggaccctgtgagccaggtgatctagttctccacgagtttgacgttgtcctcaatgaaagttgctttaggcacatgtacattccctacaattttagagcttttgtagcttattacattgatgagcagagggatgctgctatgatgttacagtacaagaaggttgagcctgctcttcttacttatgaaggaaggtcttaccctcctttgtttaagcattgacccaatttagcaagttttatggcaatgcttggttgagttaactatgactatggtcttcgtgctggagaccggatagtggtctctctggaccatatgacctttgatctgaaagtggacactttatcggggtgcagaaagggtgcttnctaatctttggggtgcttttggaaaaattggccnatggataattaccagtatggtggctatgctggcttcttctcagcaaaataacggttaactaatcatgagaacccgttcntttctttngggggctcttttcaagacaaattcctggcgttgnccggccatttggggcatcttnatgaatnnncacccaacattncaccaacnntnaaaccggcatattnatggggggaaaatccccaanaatgntggttggaaacttgaanaaaattggtgatgtgcccaatgcnttggcactctgggnactttggntaaggggntcacngaancccnct

SEQ ID NO: 103305 - DNA, 973 bp, Triticum aestivum
  unsure (1)..(973): unsure at all n locations
  Clone ID: PAT_TA_103305
ggcacgagtatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactcttgacattgctttggggttttcttttccatttatctttcttggttggtcctaagataagaatatggtgtatgtccatgtttccccgacatgactcgaaaaaacattgcttcgtatgtgaatgcttaccgatggctatgnatatggcacatgcncataatattataagtacaatttgccactatgnattgggtaattaatgagaacattttgcnccnaaaaaaaaaaaananaaaaaaaaacttgaaagtnttttaaaacggccggggccccttgattttcncccggtgggnaccagnaagngtcccaattgcctntaggagncgattacaattactggccgnttttanaacnnngactggnat

SEQ ID NO: 103306 - DNA, 947 bp, Triticum aestivum
  unsure (1)..(947): unsure at all n locations
  Clone ID: PAT_TA_103306
ggcacgaggagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggngcacgtggaatcccgtgtgaatcagcaaggaccaccttgcaaggctaaatactcctgggtgaccgatagcgaagtagtaccgtgagggaaaggtgaaaagaacccccagtgggtagtgaaatagaacgtgaaaccgtgctgagctcccaagcagtgggaggggaaagngatctctgaccgcgtgcctgntgaagaatgagccgncgactcataggcagnggctttggttaagggaacggaacccaccggagcncgtagcngaaagcgagtcttaataggggccattggtcactgcttatggaccccgaacctgggtgatcnatccatggaccagnantgnagccttnnatgaaacctaaccnnangtncccaacccgncttgangntnaatgaattagccggnntgaactctgncggttnggggntgaaaatgccacntcnganccccananctaatcttggnttctttccccncnantgtcnttncnngccccattnatttgantggtccatcttannggcttaaangcacttgtnttcgcttccgnctntactctaanncggtacncaaanctgnnggcannct

SEQ ID NO: 103307 - DNA, 950 bp, Triticum aestivum
  unsure (1)..(950): unsure at all n locations
  Clone ID: PAT_TA_103307
ggcacgagctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagntttgtcaactcttgacattgctttgggttttccttctcatttatctttcttaattgntcctaagaatatgtgtaatgtccatgtttcatgtacgaacatggcttcgaagaaaacatgcttcgtatgtgaaatgcttatnngtgggcttatggatatgcacggacccataataattattncaatatggccgactattataccnttttaaanggnnnaaanaaancnatcactntncnanntaaaaaaacttggagangtnctttttaaanncggcccncggggccccantngatttttntcancccgggttgggggtacccaagntnaagggnncccnattctgccctttaaggggg

SEQ ID NO: 103308 - DNA, 1023 bp, Triticum aestivum
  unsure (1)..(1023): unsure at all n locations
  Clone ID: PAT_TA_103308
ggcacgagataacttctcgccaaaggtctcaggtttttcactctcaagggcgcttaccattgagtacaattatgatgactctgtagtcgttcgaaggcactacagcgacccaagcttcgtacaatgtgggcttcttacagtcaaaagcgatgtgtacagcttcgggattattctcatggaactcattagcaggaagctctcaacatatgatgaagattgtgaactaacagaccttgttatcctgtataacaaagcatatgattcagagaagagaggagcggcgatgtttgataaggatatcacagccgataaagacatcatactgcttgaagacattgggaagctagcaattgagtgcacgaaactgggaccagatcttaggccaacaatgaaggaggtggcagaacgcctcgagattcttagagcatcttggggcaaagctagccaagggaggtagttggatctggggctatggcaaatgccactggaaggaggacaaccctgtttaaaacatttgtgccgctgaagcttcatgattaccgntctctgagctcagctcacaattctaatattggntntggtttgtactgntatgatttatgtaatcttggtggagaagcatcacantaantcncacaatntaaactcgagagtcttctanagcggccgcgggcccatcgatttttncacccggtggggtaccaggtaantgtcccaattcgncctatagtgagncccattacatttnattggcctcgttttacaacgccnnnacttggnaaaacctggcgttacccaacttaancncctttncagnaacatncccntttngccagctggcgtcataaccnaaaaggcccgtaccgntcgccctttcccaanagttgcccanccctgantggccnaatggngaatccattttttaagcggttnacngggntaaaactncnngnttttaatggnttgggnnntttaaattcncagtncccaggttantttangnccctnancccttcnagccct

SEQ ID NO: 103309 - DNA, 838 bp, Triticum aestivum
  unsure (1)..(838): unsure at all n locations
  Clone ID: PAT_TA_103309
ggcacgagctcccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctcggcgagatcgtggacccgctctaccccggcggcagcttcnaccccctgggcctngccgaggaccccgaggcgttcgcggagctcaaggtgaaggagatcangaacggccgctcgcatgttctccatgttcggcttcttcgtgcaggccatcgtaccgcaaggggccctggagaacttgccgacacttgncgacccgtnaacaacaacgctgggccttgcaacaanttngtcccnt

SEQ ID NO: 103310 - DNA, 827 bp, Triticum aestivum
  unsure (1)..(827): unsure at all n locations
  Clone ID: PAT_TA_103310
ggcacgagcccaggtcccagccccagcagcccgcaactctcggcggcgcttgctccccgtcggcgcactcgcttctccctggttcctcggcgccgctcgctctaccccgttgtctctggcgtgcagcctctcttgcctcccccctcgtcgccctagccggccgcgggtgcgcccgcgcccccaccgttgttgtggcctgctggccggaggcgcacgcgcccgcgtcctggtccccgcctcgtcgtcaccggagtcgcgctgcgccgttcgcctcctttcctgagctctcgtgccttcctcctctctcccgccctaaatcggttctgcatgttacggaatacgcatgtcgtccacctcctgcctagcccctcccatcccctgccgtagggntanggctcccacctncctccgncgncgncgagaggccatcactcagatttaagccttggcggagctgctcacaccaagggatggaggctggttcacatctcatgcttcaggcaggagcaagacgtgtcaacaaacatctgatgatggcactggcttcaaatacaatgaagcaggcggagatctcaggggaccctgacctganggaggaagactgnggaagccccancagggatgatcaaaattatttaaaggnagactggttngtaagaacgcncaaaataaaggaaaaatctacatgatncaatantncaagatttcggantgaaccccntgntccangtacattggacttggacaaaacaacttaactcaanncattngtttttgtggatccntnacnattttnncntgntggcttccnggnanactgcccnanc

SEQ ID NO: 103311 - DNA, 761 bp, Triticum aestivum
  unsure (1)..(761): unsure at all n locations
  Clone ID: PAT_TA_103311
ggcacgagccgcgccgcacccgcaccggagcgtcggtccgtcgaacacctagcaggcagccatggccctccacctcctcactcccacccacctccaccacccctcctcccccctcccgcgccgccgcgccgccgcctcggccacagccacgctcgcgcacccactccgcgcccacccccgcctccgcctccgcctcgccaccgccgcgtcctccccgcgcaccgggccacgccgcgccggcatgtcggccatccgcagctcgctcatcgacccggacggcggcgcgctcgtcgacctcgtggcgcctccggggcgccgcgcggcgctgcgggccgaggcggaggcgctcccgcggntgcggatcgcggccgnggacgtggagtgggcgcacgtgctcgccgagggctgggcgtncccgctgngcggcttcatgcggaagcacgagtaccttncagtgcctccacttcaaacttcctncgnctcccctccggnggcctngtcaacatgtcgntctccatcgtgcttcgccgtcnaaagangcccgtcaaaggaaccggcgttcggggntccgncccccgaacgttnncgccttgccnggccccccaacggggtgaagctnccttagacngtccnttnnggaantgtttgaaataanaaccttnacaatttantgnantaaanggatttgncannnaacatgggggggganactnngngccctnggcttaaccttaangntccnatnaagggcaaaaaancct

SEQ ID NO: 103312 - DNA, 418 bp, Triticum aestivum
  unsure (1)..(418): unsure at all n locations
  Clone ID: PAT_TA_103312
ggcacgagcgccactcggtacccgacgcttctcgatcgtgcgccgcgagactttctcgtcgctccctgcagccaacaccactttcacccgcgcgcatttgatagctagcctggcccggccggcgatctatncacccagtcacctcgcgtcacccgcctagctatntatntacgcgcgcacctanacccgaagaagctgnccagctagtcactgactgntagttggatcatgggggcgctggcggcgtcgatcgcgtctnangtgccgtcggggatgctgancgcggggctggcggcgctngcggcgctnccnaaccccggcganctggtgcncaaggcggcgcggctggaggaccaactnangganctgnttcggctnaacngccnnggcgccngggcgggggcngacaaggggccng

SEQ ID NO: 103313 - DNA, 292 bp, Triticum aestivum
  unsure (1)..(292): unsure at all n locations
  Clone ID: PAT_TA_103313
ggcacgangcggctaactggtgctacgcaaccgtagncgcgccccgtgcccgctcctccaccatngtcgccagcctcggcacccccgcgcccttcaactcctcctccttccgccccaagctcatcaggaacacccccgtccaggccgcccccgtcgcacccgcattgatggacgccgncgtggagcgcctcaagaccgggttcgngaagttcaagaccgaggtctaccnacaagaagcccgattttntttgagcncctcaaggccgngccaggcgcccaagtacattttgtt

SEQ ID NO: 103314 - DNA, 537 bp, Triticum aestivum
  unsure (1)..(537): unsure at all n locations
  Clone ID: PAT_TA_103314
ggcacgagaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggngacttcaccaggggcaacggcaccggaggcgagtccatctacggngagaagttcgccgacgagaanttcgttcacaagcacaccaagcccgggatcctttnnatggacaacgccgggcccaacaccaacggatcccagttntttatttgtaccgncccctgcatttggttngacggaaagcacgtggtctttggtgaggtcgcnnagggcatngnacgnnntcnagaacntnnanaangtngg

SEQ ID NO: 103315 - DNA, 485 bp, Triticum aestivum
  unsure (1)..(485): unsure at all n locations
  Clone ID: PAT_TA_103315
ggcacgagccacgcctgcctcatctctcggagcaggaggaggaggagcttgcaggaacaatggcggcccagggtcttctctctgggaggcagctgctggggaggcctctgcagtcttccatctccaggtcgtcttcctcccggaagncccccttcgtcgtcagggcatcttccagcccccctgccaagcaaaatgacaacaagcagctgtggtttgcgtccaagcagtccntcacctacctcgacggtacgctgcccggngactttggcttcgaccccttggggctgcccgacccantagggcacncgtgcgggttcatcgancccanntggcttgtncttaccgnccgaagatnttttaattggnntgtancgnctattgatgttntatgccttcattattttntnntcncttantnncacanctnatantcnnnntctntatattntntncnttcncttntnncctctacananactttactt

SEQ ID NO: 103316 - DNA, 388 bp, Triticum aestivum
  unsure (1)..(388): unsure at all n locations
  Clone ID: PAT_TA_103316
ggcacgagctcctagcaagctatatacctacatagtacagccatggcccccaccgtgatggcctcgtnggccannttcgtcgntcctttncaggggctcaagtccaccgncggnctncccgtnagccgccgntccaacggngctagcctcggnagcgtnagcaacggtggaaggatcaggtgcatgcaggtgtggcccatcgagggcatcaagaagtttgagaccctgtnttacctgccaccgctcancaacggaggcccttcctcaagcatgtcgactacctgatccgctccaagtggccgnnttgtctcnagttcatccctgggtcgtnttttttnttccctnagctcaanccattttcnggntncctcttntnnctcnnttnntt

SEQ ID NO: 103317 - DNA, 506 bp, Triticum aestivum
  unsure (1)..(506): unsure at all n locations
  Clone ID: PAT_TA_103317
ggcacgagcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctnggcgccctcgggtgcgtgttcccggagatcctgtccaagaacggcatcaagttnggcgaggccgngtggttcaaggccggcgcccanatctttttngagggcggnctcgactacctgggnaaccccaacctggtgnacgcgcanagcanncttgccatctgggcggtgcangtggtgctcatnggcttcatngagggctaccgtntttgtngngggcccctcngnnanggtctcnacatcatttatcccggnccggggctttnaaccatttngncttncnnacnnnnccnnannctnncngcngaanttnaanttgaaangaaannttannnaaacngt

SEQ ID NO: 103318 - DNA, 819 bp, Triticum aestivum
  unsure (1)..(819): unsure at all n locations
  Clone ID: PAT_TA_103318
ggcacgaggctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaaagtgcattgcagtttttgtcaactctgacaattgctttgggttttccttctccatttatctttcttatttggtcctaanaanatgnggatgtccattgtttcattgtacgaaacatngnttcgagaaagcatgctcgtatgtgaatgctatcgggggtttttatatgcncggcccctaaaaattatacaatatgncgaatatataccnttttaatggnaaccaaaaaat

SEQ ID NO: 103319 - DNA, 697 bp, Triticum aestivum
  unsure (1)..(697): unsure at all n locations
  Clone ID: PAT_TA_103319
ggcacgagaccgatcaccagcacagncgcgcatncaccgntgctagcaaggncgaccaagcagnaccgagatggntgctgncttctcctccaccgnnggngccccggcttntacgccgaccaacttncttgggaagaagctcaagaagcaggngacctnggncgngaactaccatggnaagagctccaaggccaacaggttcacagtnatggnanngganaacctngacgagangaggaacacggacaagnggaagggtcttgcgtacgatatctccgacgaccagcaggacatcancagagggaagggcatcgtggactcgctcttcaggcgcccacgggcgacggacccacgaggccgtcctcaagcttctactagtacgttagccagggactcatagaagtacgacttcnacaacaccatgggaggcttctacatcgctnctgctttcatggacaagctngttgtncatctnttcaagaacttcatgaccctgcccaacatcaagatnccactcatnttgggtatctggggaggcaanggtcaaggnaaatcattncagtgcgagcttgncttcgccanatgggcatcaacccaatcatnatnagtgncggagagttganaagngggaccccnganagccagccaggttattaaggnggggtaccgtgngggtgnngacatgatcnaanaangg

SEQ ID NO: 103320 - DNA, 776 bp, Triticum aestivum
  unsure (1)..(776): unsure at all n locations
  Clone ID: PAT_TA_103320
ggcacgagtctggccgcacttgccatgtttgaaccgtggacttctcctgccccgatgcgatttcgatacgaactcgatgcgtacaactgcaaccagcaaccccagctttccccaccgtcgctgtttatttctgctgcctccacggagcatcgctacccttcttcgatccggactcaaccgcggacgtgaagtggcgctagacagcagcgacgagacgcgcggcggcgtccagatctcgaccctctcgctcgatcgtgatcggtgttcggaggggctggagcgaatccggtcgtagtcctccaattcgaggcttcatttgcttggcctccacccgtcgacatcagatcggagcgcccatagccttcttcgacccagaaacaaccgcaggtgcgacaagacgcgcgacggccggcggccactgcaaatctggaacccctcactcgatcgtgatcctggntcgggggggctggagcgaatccgcacctanttctacaaatcgaggcttgatctccatccggaaaggttgcaangctttgaattttcgagaagaagctggaagcnagttgacaacanaagcnnggttcctctctggggntctgagtggggganntcaagaatcattnccnngnaacnaaaaggatctnncttcnnnnanatttggttgaanaagggattttgatacccntcccaaaggaannttntnctccgnttgccgtttganncnncantnttcnnggnangaaaantggnataaancccctngntnnncatttcca

SEQ ID NO: 103321 - DNA, 207 bp, Triticum aestivum
  unsure (1)..(207): unsure at all n locations
  Clone ID: PAT_TA_103321
ggcacgaggctgtccgtcacacacaggatggcgtccgccatggagctctccctcctcaaccccgcantgcaccaccacggcatcgcggccaagacggcctcccccctcccggttctccccgcgcgccggggcgccgtccgcttccgcgtgagggccgccgtcgcggcgccgtccgaacccgncgcgaagcccggntcgcccaagaan

SEQ ID NO: 103322 - DNA, 535 bp, Triticum aestivum
  unsure (1)..(535): unsure at all n locations
  Clone ID: PAT_TA_103322
ggcacgagtaccaagccaccgaccaacatggcagcgtctctccaagccgcggccacgctgatgccggccaagatcggcggccgggcctcctccgcgcggccgtcgtcgcacgtcgcccgggcgttcggcgttgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtnccggcaccgcgaaccagtgcccgaccattgacggcggttttganttcttccccttaaggtcgncaagtctagatgaanaagtttncctggancccanattttttatcgtnaangtnganggcaatncagaanaaannaagncgtnngctcttccaagaaaantaanactcantnatcccgtttttaantttananctcttttac

SEQ ID NO: 103323 - DNA, 615 bp, Triticum aestivum
  unsure (1)..(615): unsure at all n locations
  Clone ID: PAT_TA_103323
ggcacgagcaccagcacagccgcgcatccaccgctgctagcaaggtcgagcaagcagcacagagatggctgctgccttcttctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaactttatgaccctgcccaacatcaagatcccactcatntttgggtatctggggaggcaaagggtcaaggaaaaaccttccagtgtgagcttgtnttcgccnagatgggcatcaaccccaatcattgatgagttgccgga

SEQ ID NO: 103324 - DNA, 816 bp, Triticum aestivum
  unsure (1)..(816): unsure at all n locations
  Clone ID: PAT_TA_103324
tcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgcttcaagccaccgggctgcgaggagtcggcaaggcctaaacaagctcattaccacgggccacatataaagtgccattgcagnttttgncaactctgacattgctttggggtttccttctccatttgctttcttacttgtcctaaaaaatgngnatgnccatgttcatgnaacaacatggntngaaaancgngctnnnatgtgaatgcnatcggggntntntntntnccatnccatnatntattatcnatntgnnnacnatnnnttngggnaantaanaanganaaaatntttcncc

SEQ ID NO: 103325 - DNA, 591 bp, Triticum aestivum
  unsure (1)..(591): unsure at all n locations
  Clone ID: PAT_TA_103325
ggcacgagggaacattaagtaaattcttcagatcaggctgccactgtcaaaactgggtgtgttccttccggtaatttctcttttggcagcatctgagcgtggggatttcaggatgattgttgcctcctcggttcataagaaggaaaatcctctagcgttgcttgggcaatatagtgatgatgaagaagaggatgaagtagcaacagatcaacccattggtgaaactaaggggagcccaacagatgcaagtgctgaggttattcatgatcagggtgatataactggggataacggcgatgcagatagtgaactgcctgcttctgttagtgttcagcaggaggtatctcaagctgatgatgtcaaaattatcacagaaaccgttgctcaggaatttactgttgcccctgatccaactctggaaaatgagtgtgtgacagcaatggaagctgtcccagattcatctggcatgcaaattggtggtgacattggtgggaattggaaggctatnatgcatgacngagtaatcagngctactactggnacacagntacaggagaaacttcttngggagantnctaaggantaacttca

SEQ ID NO: 103326 - DNA, 453 bp, Triticum aestivum
  unsure (1)..(453): unsure at all n locations
  Clone ID: PAT_TA_103326
ggcacgagacataagatttttgctaccannncctaagctcnaatggagggtgagaagaactcgttcnttgacctgatgtncancagcnagctgttcgcggaggccgncaanacgggctacnacaagaatagcgtcgagggcatcnacaaggaaaaggtagcctggcgcctccgccganatcntctactccgccgncaantncggcaagctggangacangccgnnggngcagnacctctagaaggctgangggtacctgaaacagtacagntccggcgganccnanaanganaaaaccgacncacctgctgncgctgacgcaccgaagccgnatgcacccaangatgcagcgcctgcgcctgcccctgccgcggaggaanaganatcgtccgatgggttcngactntacnacgtnntnaanggggctncntncttncngnnnaaatagnngcc

SEQ ID NO: 103327 - DNA, 313 bp, Triticum aestivum
  unsure (1)..(313): unsure at all n locations
  Clone ID: PAT_TA_103327
ggcacgaggccactcgcccgcatcgccggtgccaaggtcctcgccttcgaccggccggcgtttggcctgacctcccggnccagatggtccggcgatgacaccaagcctctcaacccttactccatggncttctcggccatggccacactggcattcatagaccacctcggcgccgggaaggccgaccttgttgggcactctgccggttgcctcgttgcagtggaggcgtacttcgaggcgcccgagcgggtagcggcgctggtgctggttgcaccggcgattnttgngccgaggaagggtgagaaagagaaca

SEQ ID NO: 103328 - DNA, 979 bp, Triticum aestivum
  unsure (1)..(979): unsure at all n locations
  Clone ID: PAT_TA_103328
ggcacgagntntgtngaatgancngnangnccgaancatggngcacgccnagctctcaacgattagcntcatcgnatatttatgcttnttnnnaanggngtnngggcctancccaantattntctgcgcgganattttncccacctccgtncgnggnatntgcatanncatatgcgcgctaaccttgtggatcgggagacatcatcgtgacctacactctccccgtgatgctcaacgcatcggnctgnctgganncttccgaatatatgctgncgctngcatactggccnttggattcgtcnacatganggtccctgatacaaagggcatgcccctgnaggtaatnaccgagtncttntctganggngcanancnaggnaaggaagccacagactacttgctctgatctggngatccgagnatctggtggnaattntgnggcgncatanctactactacactgggtaacctgcgangctttggngaagaaacttnaaagagagcaagatncggaanactttacattgtnaaggctgaatcgtgtggccanaagccaacttttngaaagnacgaatattgtacttaaaatnatttggnnttttaacttttgcaaactttctatttgcgtttnttcacaaantccttgcccatggaaactaaaggctagttatcaaccatnnatgttcgtttanngggncnaaaaaaanaaaaaaaaagaatanttcccgggngtgcttttttngaggcgggaccggtngnccccnttggnttttttcaaacccggggggggngtcnctnntaaaaggcccccccaatttgcccccttaaaangaagttncnaataacaattnccctggnccncttttntttcaacttnggggnacangggaaaaaaacctnggggttncccaaatttaaangcttggaanaaaaactnccctttttcccaattgggggaaaaccnaaaaggcccccccct

SEQ ID NO: 103329 - DNA, 949 bp, Triticum aestivum
  unsure (1)..(949): unsure at all n locations
  Clone ID: PAT_TA_103329
ggcacgaggcggtggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtgagggaaaggtgaaaagaacccccagtgggtagtgaaatagaacgtgaaaccgtgctgagctcccaagcagtgggaggggaaagtgatctctgaccgcgtgcctgttgaagaatgagccggcgactcataggcagtggcttggttaagggaacggaacccacccggagcccgtagcgaaagcgagtcttaatagggcgaatgtcactgnttatggaccccgaacctgggtggatctattncatgancagggatgaagcttnggatgaaaacttanncagaggtccgaacccgacttgttgntgaaaaaaataaccggattaantttgtgggttaggggtggaaantgcccccttnaaacccanagcttncttggtttttccccnaaatgcgntttgagggcgccncnntttgactgggccttttagggggtaaacccttgtttnggggngggctttnccaacggnnccaaattngnggcaant

SEQ ID NO: 103330 - DNA, 679 bp, Triticum aestivum
  unsure (1)..(679): unsure at all n locations
  Clone ID: PAT_TA_103330
ggcacgatcgtctcgccatggccgcgtcctccctgctccgctcgctctcccgcgtctcgcgccgcggctgcgcgcccgcgttctacaggccgcggnccgctctcgccgctctcgaccgccgcggctgcancggcgtccgacgcgggggatgctgcngngctgcggagggggctcgcggggctggggccgacggccaanggggagaagccgcggntggtgntgntcggnacggngtgggcggggtcgnncctcatgaaggacctcnanacnaccggctacnacgtcgnntgngtatnnccgcgcaancacatggncttcacgccggtgntcgcctncacctgnctnggnacgctngagttncgntccgtngccnagngcatacagncnngccgnntccacctcncccgggttcnagttcctnctngcccgntgcaccggcgtgnaccccnacgcgcacacgattgattgggagacaagtcactgaaggtagagaaagataccttnaagccgngggaaattnaaggattnntaatgaaaaagttggncntttggatnttggagcntgaaggcattnaacttttnggtatanggngggagttaaatggaacatgccaaancttttantttcgnggaaaanttaaatgaanncttnaaaanaanaatcccgnangnaaaggnc

SEQ ID NO: 103331 - DNA, 485 bp, Triticum aestivum
  unsure (1)..(485): unsure at all n locations
  Clone ID: PAT_TA_103331
ggcacgaggccgcctccgccatccagccgccgcgccgaccactcccgaacccctcacgctcgctgtccggtgcgccgcgaaggcnnngccggctccggcagcgccggcgaggcccatcccgccgccgaagctggtccgctgcccggcgctggaccggcaggcggcgcgcgcgagccggctccgcttcgcccgcaagctcctcaccctgctcctctccaagccgcgcggcttcctcccgctccgcgtcctcctccgctgccgccgcttcctcggnctcccgcgccgccgcccgctcgtccccttcgtcctccgctaccccacgctcttccgcctnttccaggcgcccatctcccgcccgctctcgccctccctnttcaccctngccgtcgcgctcgccgccgancttgccgcctgcgcggggncgagcttgncccggactttgcgganaaggtgcaaccgctnctcctnatgaccccccnggtgca

SEQ ID NO: 103332 - DNA, 843 bp, Triticum aestivum
  unsure (1)..(843): unsure at all n locations
  Clone ID: PAT_TA_103332
ggcacgaggacacttntcccgtcccgtccccagccaacctccnatccccgtntcgcgtcgcancggcagntccactccctcgccatgggcaagattaagatcggaatcaacggnttcggaaggatcggnaggctngtcnccagggtcgccctccagagcgacgatgtcgagctcgtcnccgtcaacgacccctttatcaccaccgagtacatgacctacatgttcaagtacgacaccgttcacggccactggaagcacagtgacatnaagctcaaggacgacaanacgctgctctttggcgagaagccagttaccgtcttcggcgtcaggaaccctgaggagatcccgtggggtgaggctggtgccgattacgttgtggagtccaccggtgtcttcactgacaaggacnaggccgctgctcacttgaagggtggtgccaaagaanngnggtcatntctgncccaancaaagatgccccctatgtttgaggntggtgtnaatgaggacaagtacacctcagacgttaacattgctcaaatgctaggtgcaccactaactgccttgctcccctatcaaagatgattaaatgacaacttngggtatnattgngggtttgantgacccctgttannccatcactggncccacanaanacccgttnatggnccctnnancaaggnactcgganaagntngcnaagggcccnaaagcttttnanaatcattccacnancnctggtgcttggcaaagnnttgctgnncaagntctttcttgnttngaanngggcaancttaaccggcanngttttttgggttccccttntgnnagnnncnntngcntntc

SEQ ID NO: 103333 - DNA, 567 bp, Triticum aestivum
  unsure (1)..(567): unsure at all n locations
  Clone ID: PAT_TA_103333
ggcacgagccgacggaactgccggctgttgtggtgcacgatgtgcgggtctggcatctgcctcattgcctgcgcgacgggagctgcaatagctggcctcgtcatcgccacccatgccatggccgcattgttggcagcggctcctgcctgtgcagcgccgcgtgtttcctgctgctcaaccctcgcttggatgaaacgcctgcagcaacacatggaccggcttgacgccgcagccaggggcgccgatgtgctcaacaatgacatggacaccattgaacggctggtggataggctccacgccactgtcaagggtgacaagatcttggttaggctaaggcttgagcgcgggagggggcaacaccacaccatngaagaggtggtgcggcagctccgaaagaaccatcctagcctactatgccagctcgccgacctctangagcacatcttgnctctactttgcagccgntaacngntcaaggctattccttgtcacccacctcaatgcccagtctgatcccacgccnagttgcctntttanngatttactgattnnattgnacaaccattt

SEQ ID NO: 103334 - DNA, 643 bp, Triticum aestivum
  unsure (1)..(643): unsure at all n locations
  Clone ID: PAT_TA_103334
ggcacgagcagccgccgagggtctccgccaccgccgccttcccatccttgcccccccgttcccccacccggcccggcgccgntcctggagatacttcgcggtttcttcacccgctcgtcccgctcaggtctctccagcgttctagggttagcctcctctgttctgggatttggctcgccttgccgcgccgccctggtctcgccggcatccctgcaccgccgaaggagcctcgaccgcggccgcccaccctcggctcgctcggctagtgtgcacctcctgccctaaccacccgagcagcgcctcgtagtcgcacgctaccgcatctgagggtcgctcctgtttcgccgaatcgcggccggttccgccatggcggcgatggggcaggagggggacgacgtcgaccactacgaggtgctccgnctgccgtccggcgaggaaggcgcggcgctgagcgtnaagcagatcgagaaggcctaccggacgcagcgcggttncggcaccccgacaagcgccccnacgaccccaacgccaccgntgacttncanagcctcgccagntnatacaanttcctccgggacaaantccctttgccnanaagttttaagnccccgncctccttgnnncgncngngaaggaccctttg

SEQ ID NO: 103335 - DNA, 298 bp, Triticum aestivum
  unsure (1)..(298): unsure at all n locations
  Clone ID: PAT_TA_103335
ggcacgagcaaaaccggcgtctcctacaaacccagtaacctggaagaggacgaagagaatctgtacggagcattaatgagtcttcaaacgatggtggacgtccgcaaaaagagtttgtatatcaaaaagatgattcagaccggttccgcacacctgccaaaatgaatttgcaaaaggatgataacggcgttgatgtaacttcttcgnggaanccacacctttttactgtcacctgngnacntgnnctngnntcannggctnatnctnctcgcttattnntnttcttcacnctttctct

SEQ ID NO: 103336 - DNA, 920 bp, Triticum aestivum
  unsure (1)..(920): unsure at all n locations
  Clone ID: PAT_TA_103336
ggcacgagctcgtgccgcgccgccgcaggctttgactccatcgcctctccctcctcttcgtctccggccggccaggtagttaacagctccagcagccatggggaaggagaagatccacatcagcattgtggtcattggccatgtcgactctggcaagtcaaccacgaccggccacctcatctacaagcttggaggcattgacaagcgtgtgatcgagaggtttgagaaggaagccgctgagatgaacaagaggtctttcaagtatgcctgggtgcttgacaagctcaaggctgagcgtgagaggggtatcaccatagatattgctctgtggaagttcgagaccaccaagtactcgtgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcatgctctccttgctttnctcttggtgngaaacagatgatctgctgctgtaacaagatggatgccaccactccaagtactcgaaggccccgttatgaagaaattgtcaagggaagtctctttcatacctgaagaaaggccggttaccaacccttgacaanggttccccttnngtttcccatcttcttggggttcgaagggccgaacaacnattgaatttngagaaggncccacccnaccctttgacttgggtaccaangggcccccaccccttttnttngaggggcccttgngaccccanaatnnaattggangccccaaaaangggcccttccgnaaaaagncccctggggntttttccccttttnangaaaggtggtnccaaaaaattggnngggnanttgggnaacttgnggcct

SEQ ID NO: 103337 - DNA, 844 bp, Triticum aestivum
  unsure (1)..(844): unsure at all n locations
  Clone ID: PAT_TA_103337
ggcacgagatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtnccgcattatcggattcgacaacatgcgccaggtgcagtgcgtcagcttnattgccttcaagccaccgggctgcgangagtccggcaaggcctaaaacagctnactcaccacgggccacatataaagggccattggaanntttgncaactcttgacattggctttgggtttttctttctncatttggnttttcttacttggtcctnaanaaaantgggtnttgtnccatggttcnttgtaaacaaacaatgggntcngannaaaagncggtggcttcgttttgtgaaaatgcaaatncggggggnttattngtntnttgccccnatggcccnntaaattatttttattaccaaatnntggtcnnactaaaaaaaaaaaaat

SEQ ID NO: 103338 - DNA, 580 bp, Triticum aestivum
  unsure (1)..(580): unsure at all n locations
  Clone ID: PAT_TA_103338
ggcacgagcctaactaaagcccactagcggtagtaatccttgtcaagccgggtgacaccgcggagggagcggagcggagcatggaggccatggacgtcaagtacaggccggccctctaccccaacggctccgtcaagaagctccggcaggcggcgcccgtgccgccgccgccgccagcggcggtggaggccgtgcccacgtacaaggagtgcctcaagaaccacgcggcggccatcggcgcgcacgccgtggacggctgcggcgagtggatgccggtggtggagctcaacaccgccgacccggcctcgtacaagtgcgcggcctgcggctgccaccgcaacttccaccgccttgtgatggtggaggggtcgncgcgcaccgnccccgcccccgccggcctgctgccggcgccgccatgcccatgcccatgcccatgccggccaccgtgctccatggctgccgcaacgcgggcacgggcaggagacgccggatgaccggctcccgggcgtngacgganacantntgactncnactcggatggntncnantacnaanacnagcgctncgtntnccngnccaa

SEQ ID NO: 103339 - DNA, 325 bp, Triticum aestivum
  unsure (1)..(325): unsure at all n locations
  Clone ID: PAT_TA_103339
ggcacgagcacgcctgcctcatctctcggagcagcagcaggaggagcttgcaggaacaatggnggcccangnncttntntttgggaggcagctgcttgggaggcctctgcagtcttncatctccaggncgnnttcctcccggaagcccgccttngncgtcagggcatccgtncagcccccntgccaagcaaaatgacnacaggcagctgtggttcgcgtccaagcaanncatcacctacctggacngcacgcttccctggtgactttgaattctcancccctggggncntcccnaccctnaaggnncnccanncganncntcaat

SEQ ID NO: 103340 - DNA, 844 bp, Triticum aestivum
  unsure (1)..(844): unsure at all n locations
  Clone ID: PAT_TA_103340
ggcacgagccaggcccgagtgccgccgtcaccaccagcgcccgaccccgagctcctcctcccgtgcgcctcctccctggcttccctcgcgcgtcgtccggcgaccggcgccgccgccgccgaccacccaggtcacgccgccgcttccatgccttctctctctctaatcttcttgtctctcctctccaggagctcagcgccagcgccatggatgtccagtcctcgagctctccttggagattcgaacgccgccacgggacctccaccagccagatccggcgcctacctcccggatccgcgctccctccacctcctctacccgatccggcgccgtcgaacccgccaagacctccaccatggagttcctatagctcgtcccctgcctcctcgtcctgtgctcgagggagacgcccctccagcgcatccaggacaaggcccaccgccagccggtcgttgttgcactcaccggcgacctcaccctcccctctgcactgccctccacctcaactgatgcttctcaccaacagggatatatttagctggtcatagcttggggatgttctctgttaatttttgacacaaggtgtttgtgtgttttgtcaagccaatgnttcatgaagcttttatctttgctataaatgaacatgggntgagaaangtcccttnaatgaaaggaggaagtatagtnttggccattgcttgggaaggaaggnaaaaatgctttnttnctggaccgaggangaaaaaaaggggggcnccgttnaaagntgcngtggnancgcnccctcananttgtgatgaaagnanncgnnccangncggnaagnaggnatggnaanctaaanc

SEQ ID NO: 103341 - DNA, 832 bp, Triticum aestivum
  unsure (1)..(832): unsure at all n locations
  Clone ID: PAT_TA_103341
ggcacgagcagacaacatccacaacacagngacaaggaagcagtgaagagtagctagcatccatggcgtgcatcaataccttgcagagctgctccatgttcaaaggggccaagagtaaggccagaagaggtagagccagtggcgggacctttgagtgccgggcgtccacgttcatggacgggagcgggctccggctcgggctcgacgagaaccccgatgccatcatctccggggagtggcccgagaacttctccctcctcagctacgacgacctccgcgcatacctccagtcacagcagcagcagcagcaacaacaaccatcccatgccggcgatcagtctctgtcatctcctctcttgatgatgcttcttcttcctgctgatcttcagcgggggcctctcctgcgtgaggccatgtcgacgcccgtgctgatggtcacagcggagcaggcgctggtggaggttgaaggccacttcagctcgtgtcaggcctcccggttgtcgacagtgcccgcccgatgtgtnggggtccgtccgtcaagagcgatcacgttgaggggcttacatgggcccaaaancgaaaaattgcagatgtgatgacattttccagcaatcacgcttattattgcgataaaaacaagtggacccgatgcccgcaactcttgatggctcagggaanaaanantccccnggattnaccggnttagnanaccngggacaaattcaaaggtaataanggtttggntnnccccnngnaagaacnttttttccccccgtttggaggcccatgcnntaaatttttaaaaaatgccgggnatnccttgcccccngct

SEQ ID NO: 103342 - DNA, 1006 bp, Triticum aestivum
  unsure (1)..(1006): unsure at all n locations
  Clone ID: PAT_TA_103342
ggcacgagtagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggntgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtcggcaaggcctaaacagctcactcacgacaggccatatataaagtgccattgcaagttttgtcaactctgacattgcttttgggttttccttctccatttatcttttcttatttggnncctaaaaaanatgngnaatgtcccatggttcatggtaccaaacaatggntttggagaaaagcaatgcctccntaatggngaaanngctttttcggggggggntattgttatanttgcncccgggncnccnttaaattattttattnccaannatnggncnaacttnaaaaaaaaaaaaaaaaaaaaaaaaacttnggnggaagnnncttttttaaaaaacggggccnnggggggcccccatnngaatttttccacccccnggggggggggtnccccaggnnaaagnggnncccccaanttnncccctttannggggggnngnntttancaantncn

SEQ ID NO: 103343 - DNA, 902 bp, Triticum aestivum
  unsure (1)..(902): unsure at all n locations
  Clone ID: PAT_TA_103343
ntgttacgccnctcgaaattaaccctcactaaagggaacaaaagctggagctcgcgcgcctgcaggtcgacactagtggatccaaagtcatcacacaccacaccaaccgacccgtctactttctttcgccttgctctacccgcggtcccacgtgctnccagccatgtgcggcggngccatcctctccgacatcatcccgccgccgcgccgggccaccggcggnaacgtctggcgggcggacaagaagaggagggccaggcccgacgccgccgcggggaggccccgccgngtgcccgaggaggagttccaggaggaggagggcgacgcgtagttnnaggccgacttntanggnttnnnggangcggaggaagantcnnacggtnaggccaaacccttanncgtccgcaggaccaggcttcttcggagatggactgaaggcaactgctgctggtgatgatgactgtgcctcaagagtatgatantaggatgagaaagagccaattcaggggcatncgtcgncgtcttgtgtaaatgggattgtgtgaaataagagatcctcgcaagggtgtccatgnctggcttgtaacttacaantctnntgaagaagctgncacngcctatgatgttgnagnccacagaattcctggcaagannnctaaggtcaattttccataantaagcttaccatgggtnctnattaacgcttgcgnttacctntgngaangtncccnnattnaacaccgaacnanaatccanttacncaanaccatgggcaannctnatgtgaatnnctgccctggntgntnctatacntnaaatnannaatttgngnngncttnanaacntntnnttngtgcctnanngnnatgaannnnanggtnnattcntggaantttnctccc

SEQ ID NO: 103344 - DNA, 850 bp, Triticum aestivum
  unsure (1)..(850): unsure at all n locations
  Clone ID: PAT_TA_103344
ggcacgaggcaaactgcaacaatgaccaaatccgcaccaaccatttcatgacaccacacggacaatgaggttcttcaacagcaacacactaggctacagttgacactactgcaggaatgcccagcagtggtgggcggtgctctcaggggtgctcgccactgctaacatggcatcagtggcgggctccctaaccgttattggtaaaggccaattcgtgacggacttcaggtagcacccgccactgatgaggcacactaccaatggtggggcatcaatattcgcccgccattagctgggaaatgtacctatggtggtcttttttcttgcccgccactagtatgattttagaaactaaaaaaaggatgcacctcctggtggtggcactccatggtgcggccctgcccctactcgggaagctggtaagctcgcaagcaacatgtaggctggcaacgcctctgacacgcttgatccaccatcccgagccgtctcggtctgccgttccgccactccacttgcacgacaccgacactcccatagtcgagcaggttgcacatggccttggtgccgccattggagcaccagcatggaccgcgcccgccgttgcagtcacatacatgtactggagcaccatcgcatctgcacagacagaggcaagtagggttggttgatgcaacatgccaaaggagacaaacggngatttggtctcattaagaaggaaaaangggggnaaaagcccccccttnaaaatgtgcnttggngccnnccaaaaaatggaacnaaaggcggnccggnaaattaaaccaanggacnaacnggaggcaaaaaaaggggaattttgagcctttnnacc

SEQ ID NO: 103345 - DNA, 492 bp, Triticum aestivum
  unsure (1)..(492): unsure at all n locations
  Clone ID: PAT_TA_103345
ggcacgaggttcattggcatgtgaaggctaactacaaggagtactggagagtaaagatcacagtgacaaacttcaactacgggatgaattactcgcagtggaacctagtagctcagcaccctaatttcaacagcttgactagcattaccagcttcaactacacagctctgaacccttatggacttatgaatgacaccgctctgttatggggcatcaggcactacaatgattatntcttgactgctggacctgatggatatgttcagtctgagctactattccggaaggacccgtcaacattnaccttgcgggcaggatgggcctttccaagaagagtgtacttcaatggcgacaagtgtgtgacgccgcctncagatgcgtacccgtggttgccnaacncattcaccaaaattaatcatntttagntatcgnccattggntctttggatgctagctnatccctaccttcttgagaanaatgaanaggaanaa

SEQ ID NO: 103346 - DNA, 172 bp, Triticum aestivum
  unsure (1)..(172): unsure at all n locations
  Clone ID: PAT_TA_103346
ggcacgagcgccagtctccggcgaccccgagccccaacaatgccatctccggccacaggagctccagggtctgcaactctagggctcctctcttcatctggtcctccgctacgccccgaatcgatggagatnagggccccgccgacgagcctnaggctcgtgangccncctt

SEQ ID NO: 103347 - DNA, 479 bp, Triticum aestivum
  unsure (1)..(479): unsure at all n locations
  Clone ID: PAT_TA_103347
gccttganactatnnnatcccctttggcnctacccnagggaacaanagctggagctcgcncgcctgcaggtcgacactagtggatccaaagaantcggcacgaggttttttgtcgccngctcgggaccaggaaagatgacgtgngctccacgccgacccntcgccgctctccgcgncggccgcggtctnttnanccgcgccacctccccacctangccaaagcntaccanaccaaggccgcgnccctttgctcacncaccgtgaccgncgccaccctattaagaaaagcncancacgcatgcccgnatcacggcccngcngcgggcgcnantcgaaananancnnaaanngcnncacnncccccnctnnctgancncaaacaacccnncnnccacanatcttnananacaccactcaccntacacgananaacacncgcncacaacnnccnagcctaccaacaactanacanctnnccg

SEQ ID NO: 103348 - DNA, 691 bp, Triticum aestivum
  unsure (1)..(691): unsure at all n locations
  Clone ID: PAT_TA_103348
ggcacgagcacacacacacacacacacacacacacacactcttgtcgccccaccgttcagagttggaagttggaacctcctccttctccgcagcagcaggcggcgtcgggcaggaggtttncggctctcgagggctgctccgtngntgcatgcnaaanaggggcctcttcancaaccntcgctctcngtggnttntcacngatcccgccttnccngacatagngcgcctaaantanaccctcnactcgtcatannnnngactnacactnttttttcnttcanaacacactaccaccatgatcanngctcacannttttgnaccgantgatnctncccctgctctgcncntgctccttntccttttactctttgaaanatatnttcgcncnanccgannanactantnattcttcttttcatnattcncttttccnnnngtaaanatgntttctncttgagtcgannattntntatnctacactncnancaanaatatnnactttatntntantnctncntnaannactcttngantctanttatatnctttctatccgcanantcancncttcnatnnacatctccntctncnantaatntntacantacctactcccatntntntntnctcttgtctgtactnaacnacnctctagctcacctcngtgcatnaatcncatctttannncc

SEQ ID NO: 103349 - DNA, 822 bp, Triticum aestivum
  unsure (1)..(822): unsure at all n locations
  Clone ID: PAT_TA_103349
ggcacgagatcacagttgccggttgcttatcaatggagcaaccaacgccgagaacaacggcagtcgtgccatggttgctgctgctctgcctcgtctgcagggcaccgcaagctcgtgcccagcccgacaacaatgatttcataagcatagactgcggtcttccaggggagacaggctacagggataacaccacctcgttgtactacacgacggacgctggcttcatcgacactaatgccggcataaaccacaacatctccgctcagtacatcaacccgtcgattcccacgagcttgcacagcgtgcgcagcttccccagcggcgagcgcaactgctacactctgggctcactcgtgtccgggctcaagtacctcatccggggccagttcttgtacggcaactacgatggcttcaacaggctacccatcttcgacctctacatcggcgttaacttctggacgacggtgaacatctcatcatccgacgcagcggtgtatgcggaggccatcatggtcgtgccggaagattccgtgcaggtttgcctcaagaacaccgaccgcggggtgccgtcatctctgggctggatgtaaggccgctgacgatcaagctctaccactggccaacgagacacaggccctcgntctggttacaagggttaactttcggacccactggatgaaacaattatcaggtaccccttatgatcatatgaaccggatatgggtncctttttgtcgacattgacaaaaatgggnttgnnatnaaaaacntggggaaaaagggggaaaaattggntgacnagnntttttncnncccncccca

SEQ ID NO: 103350 - DNA, 404 bp, Triticum aestivum
  unsure (1)..(404): unsure at all n locations
  Clone ID: PAT_TA_103350
ggcacgaggccagccctgctcgtcccctcctccccgctccctccatcctctcccatgtcgctgcccctcttctncctgctcgcctcgatagcctcctctcctctgncgtgncgncggccccctccctcctgctacctcctcctccctcctctcagacccgtgccagccgccacccaaaccctatcccccgtttccctcgatccccacagtaaccacatccacagccacccgctccttcttacagccgccgcaccattcctcccttctgcgccctcctccttnctggatccccaccacagcgccgacctgcaagcaaagggcgacgaagagtggcagacaaggacaacgagggagagaaagaagggggatanatacggaggcctnacggtnnnnccctgtgacct

SEQ ID NO: 103351 - DNA, 722 bp, Triticum aestivum
  unsure (1)..(722): unsure at all n locations
  Clone ID: PAT_TA_103351
ggcacgaggtcgagggcatcgtcagcttgggcaacaccgaatgccttgagttttgcatatccccgccgggcactgacccgctgggcatcagcattgagattgggcaggagttcatggccttctcccgtgcctacccagttgccttcttgtggctcacgacgcttatgctcgaatatcatgcttttggacattccgacatcactgacctcattagcacttgcggtaggctcaggcacctcagcttgagattctgcagactgcttgatctgcactccacgctcaagattgatgtgccgtgctctgagctctaggagctcgagttcgtcggccttttgtgcacacggatcgagcttgtctctgtcccgaagcttanacaagtggagtgcaaatgttggctcttcaataaccctccagtgcgctttggctacgttcctgagcttcgcgggttaatactcgcttctaaagccaaggcatggcaagaaccattcgcgctgaacgaatgcctgtcaacgagtgctggtgccaggaacctgtcaacactgactntntggtttnggtaccaaatgaatttggattcaaccagaaccttcgaacagcgcattgntatattcaaaaaacctgacctntgggcggctttttcggatctttcggggagngggaactganctgggacttttgttattccttgaagctnnaccttgccctaacatnaattgggnnan

SEQ ID NO: 103352 - DNA, 359 bp, Triticum aestivum
  unsure (1)..(359): unsure at all n locations
  Clone ID: PAT_TA_103352
ggcacgagcnngngccagcccctntcctcttcccctccctctctncctcccgcagnccctngcagncacaacctacgccgnccgntcccggccgantccggcggctgccggagacgcgcagcactctcccatggntgcctncctcggctccgtcctccccaccaaccagatgcgtnacgctcccatgaaaccctagccgncgcgcgtncgctcnctgccgggccatcgcgtcgtctcctccccgccctctcggtcctcagcaggaggagcgtggctcaccgccgcagctgctccgcgtcgctgcttcctcatcgagctcgcacgtccctgtcacctggaggagcggncgttcgcttgcg

SEQ ID NO: 103353 - DNA, 627 bp, Triticum aestivum
  unsure (1)..(627): unsure at all n locations
  Clone ID: PAT_TA_103353
ggcacgagctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcattcatcggattcnanacatgccgccaggtgcagngcgtcagattatngntttnaaccnccgggctnntaaggagtccggnnaggncttatcangntnnattcangaatagggncatatnttaaagnngncnatttgnangnttngntnnaantcnttanattgnc

SEQ ID NO: 103354 - DNA, 171 bp, Triticum aestivum
  unsure (1)..(171): unsure at all n locations
  Clone ID: PAT_TA_103354
ggcacgaggccggctaggccaccgtactacggactcnggagcagcagacatggnatccacgatcatggccnnnnncttccgcgccgntgtcgccaagacgccgatcntcagcggccagggtcgcgccgccagngccagncncttgcgnganataggcgncgngggcaacgg

SEQ ID NO: 103355 - DNA, 672 bp, Triticum aestivum
  unsure (1)..(672): unsure at all n locations
  Clone ID: PAT_TA_103355
ggcacgagncncctccncanctagcaatncangtactccncnatggtccnagtcgagatggcatcgacngtcacnancgacnggcncttccaggggcttangacgaccggnngcctccncgacnnncggnggtcnggnagngncgngcttagcagngtgagnantggcnganngatcagatgcntgcangnnnngccganngagggcatcaanaannnagagacnctgncttacttgccacccctctncaaggaggccctnctaaagcaggangactacctgatncgctncaagtgggtgccctgcctnnagttcagcaaggatgnnttcgtattncgtgagcacaacagctnccccggctactacgatggtcgatactgnacaatgnggaagctgcctatgttcggntgcaccgacgcaacgcaggtgctcaacgaggtggaggaggtcaanaaggagtaccctgacgcctatgnncgtgtcattggcttngacaacatgcgccaggtgcagtgcgtnanctttcattgncttcangccaccangctgngaggaatntggtaaggnctaaanngnangttgaagnaacacatatacatgccatgttagntcacatttgngggngntctgtttntngntntacttnnngnntantnatatgnnaanatttna

SEQ ID NO: 103356 - DNA, 485 bp, Triticum aestivum
  unsure (1)..(485): unsure at all n locations
  Clone ID: PAT_TA_103356
ggcacgagaaataagtgtcaatcagtatctcctttctccaaactcgccgactccctcacgcatatcgataagtcgaaactcatttgcttgatcacacggtcctctgttcaccattagatattgnccaacttaattcttgtttgctcagtctctgcctttttgttctgttgtgtaaaaaatgctccttttcttgttnaanaaaaanaaaanaaaaaaaaaaaaaaaaaaaaanaacttagttntctttcnagccgaattcnganngnggncnnnaaggtnatccttaccannnnnctgggccganctaaggnngntccctcntaggttnngcttgnctccccctgggnccnnttaatgcgggcttcntancantttgaagngaantcnnnctntgggancntattntnccanaattttggnaaatngggnggccnaancttcanaaaanngntcctttctccncaatncttngnanaanntntttt

SEQ ID NO: 103357 - DNA, 385 bp, Triticum aestivum
  unsure (1)..(385): unsure at all n locations
  Clone ID: PAT_TA_103357
ctgttagccagctcgaaataaccctcataagggaacaaagctggagctcgcgcgcctgcaggtcgacactagnggatccaaagattnggnacgagcacacacacacacacacacacacacacactcttgtcgccccaccgttcagagttggaagntggaacctcctcntcctccgcagcagcangcggcgttgggcaggaggnttccgnctntcnaggncttcncgtttggtgcantgtatnnaangngncctttcnctnnnccgtcgnatcntgtngntttctnnncgctttnngcnntctgtcngtncgtctgnctgtcntattatatgtnactcccnnnttgcgtntnctattattttacnnancnctatnttttaatatng

SEQ ID NO: 103358 - DNA, 418 bp, Triticum aestivum
  unsure (1)..(418): unsure at all n locations
  Clone ID: PAT_TA_103358
ggcacgagtccacctccgatccagatcccctcctcctcctcccgcggccgcacggcgcgccagtcgctnttnttncgcgacctcgcctcccccatcccgtcccaccgcggcggcccccacttcgcctctcccgcggccgccctgccctccgccacgccgccgctgtcgcccgtcttcacgctcgacgaccgcttcgccgccgccgacttcttgcccgaccccaccgcctccgacctgctccccgttgcctcctccccctcgccccgcgccgggacaggcacaggcagccgctcgccctcatgggaccgctcccgcggcaagaagcagaggagggcaaggcggcggagcagagcanaacagagggagagaggatatggcggcacnagcnncttccacgcagncgctgatgttcctgctt

SEQ ID NO: 103359 - DNA, 485 bp, Triticum aestivum
  unsure (1)..(485): unsure at all n locations
  Clone ID: PAT_TA_103359
ggcacgagagctctggttcttgtgtatcaccaagggaatattattgttataagttacaaatctgagatggcgagttcaacgtcttactatttggaaagagattaactcaacagtatattgttgatatgtacatcaagattgaatcaataagtgttgtagccggtgagacacgtgcatgcatgactggaaagcgtattgtgctcccctcgaaatttattggaggaccaagagacatgcgtcgaaggtatctagatgcaatggcattggtccaaaggtttggaaagccagacttattcattacaatgacttgcaacccgcaatgggaagagataactagagagctggaaccaggtcaatcgccacaagatcgtccagatttggtagcatgggtcttcaaggcaaagttggaggatcttaaagatcttttattcaagaggaacttatttggtgnagttnctcntcttnnnccctccacntctttacnc

SEQ ID NO: 103360 - DNA, 404 bp, Triticum aestivum
  unsure (1)..(404): unsure at all n locations
  Clone ID: PAT_TA_103360
ttgntacgcccgctcgaaattaaccctcactaaagggaacaaaagctggagctcgcgcgcctgcaggtcgacactagtggatccaaagaattcggcacgaggagaaatctcatcaatgatccccagtcccttccgccatggcgatctgcaaggcctggatctcgctgctgctcncgctcgccgtcgtcctgtccgccccggcggccagggcngaggaccccanagcatctggtcggccctgaccgacccaagatacctgggcccgttntncgagcagactccatngtacctgaccggngagnatcccggcgactanggntgngacaccgangngntgangntctgctccaaatanatcttanntataactnnntatatantattnacanaattcatncnagtta

SEQ ID NO: 103361 - DNA, 721 bp, Triticum aestivum
  unsure (1)..(721): unsure at all n locations
  Clone ID: PAT_TA_103361
ctttgacgcccgntcgaaattaaccctcactaaaggtgaacaaaagctggagctcgcgcgcctgcaggtcgacactagtggatccaaagttcgtttcaggtctgnggcgtgatctctctcccaagagatgggtggcgcggcgtcgangctcgccgccccgataaagcaccggcgggtggagagggagctggacaacaaggtggcggaggcgctgcgggagcgggccaaggcgaggacgaagacgttccggtcggtgaacagcatcaccatgcgcctncctcgcttcaaggacggcctcaaggacatncgggacgtcttcgaccactacgacacggactncaacgggacgatcgacaacgaggagctgcggagctgcctgagcaagctcgaggtgcggatgtcngagaaggaggccgacgacgtgcaccgntactgngacntcgacagccgcaagggtatccagttccaggagttcgtcgtcctcatatgccttatgtacctgctcttnggccccaacgtcacaccccggggttttcgagttttgagtcggagaaacttnaactacatntttnacnagctcatcgaccctttctnttnttnaacagggacngngacngcatggtgaccaggaaagaacncacccanaggatgaacnangagtntgaccgganaaggacncccncccncataaancanncnannttttttaanggnnanngga

SEQ ID NO: 103362 - DNA, 756 bp, Triticum aestivum
  unsure (1)..(756): unsure at all n locations
  Clone ID: PAT_TA_103362
ggcacgaggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcatgcgcagagcatccttgccatctgggcctgccaggtggtgctgatgggcgccgtggagggctaccgcgtggccggcggcccgctgggcgagatcgtggacccgctctaccccggcggcagcttngaccccctgggcctcgccgaggaccccgaggccttcgcggagctcaaggtgaaggagatcaagaacggncgcctcgccatgttctncatgttcggnttnttcgtncaggccatngtcaccggcaagggcccccttgagaacttngncgaacaactttgncgaacccgnnaaaaaaaaacgcctggggctttgncaaccaantttgtncccggnaangtgaagcnnnannangntnaaacctttta

SEQ ID NO: 103363 - DNA, 416 bp, Triticum aestivum
  unsure (1)..(416): unsure at all n locations
  Clone ID: PAT_TA_103363
ggcacgagcggcacgagtggacgccgccgtgccaccggaggagtgggcgagtgcgtgcgctggcgcagacgcggtgaccatgctggtggtggcgcagctganggatcccatgcgccggtacgaggcggtcggcgcgccgtccatngtggtaatccaggctggacggnccggnaccggcgccgatggcgagaccaggttcaaggnggncaatatgcacgtcggnggcatgcggntgaagacggncgaccggcgtaacgtgtgggacggagagaggctacacgctgacaggagatggcactggctctgtngactatgtngctcggcaaggccnncaagaatngganatttcgnccngggcccgtatcgtngaataatnggnactgacgtgctnngnancatntncacnagggtgnttg

SEQ ID NO: 103364 - DNA, 970 bp, Triticum aestivum
  unsure (1)..(970): unsure at all n locations
  Clone ID: PAT_TA_103364
ggcacgagcacaagtagcgacactttcttctttgtttctttcactacatactactccatataatataccaatgggggagagccgcggcagcatcttcttcttcgggacctacaggccacctgtgcccctggacatcttctcctgcccggctgatccgccgccgtcatctgccgaggacgagcttctcctcaccgacgacgcgtcatacaaccagaacggccggcccgtcccgccggcggcgctcaaggagatcctgggtttcctgggcaagaagaaccccgagctggcctccgactgcggcgccaccctggaggacgtggacacgggccacgtcaccggcatggttttcgtctccgagagggaccgcggccttgagacgctgcacctagctctgcgccgctctaccgggggcaaggtgaaggtgctgagcctgctgggcgacatctatggcttggacgatttaagcgtgcgcatggaggacagcggctgcatcgccggcggctacatggtggatggcgtcaccgtgggccactcactcgtctacgtgtccaccaaggaggaggtaaaagcccggcgcaccccgtggaccgtggtctacagggaccgaacctttgccgaacggcaagaancgagccgccttacttccacaagggccagtaccaatcttgagcccgggccgggttcgcccgttccgggaaanaaagggngggcgggggggcccaacntttccaaaaaaaanccgaagtggggaaacgggcngaaaaatccnaaaaaacccttnaaagaaactggaacaattngggggaaacaatgggangggggccaccttggcccaaanggncttggggggggnccaaaanggccccccnangncnntnnngnannnaaagggaaccccccggnttgggcccnncccngggggcanngnanaannnnnatttttttttcccccnaggggnttnnaaaanaa

SEQ ID NO: 103365 - DNA, 664 bp, Triticum aestivum
  unsure (1)..(664): unsure at all n locations
  Clone ID: PAT_TA_103365
ggcacgagcgagggcganaggaanagggangaggcngnnaancangggggaggngngcgaaggactanaanaatctacnatgacacttgtgtcaaattttnanttctgcnacanttgntgcntctgctcattaacaanangntcnttgannaaaggaaaatangtttgatanncaggacgacttngntaaancctancgcgnacnaatttgnnncttcntgccttanatntntnagngatgcttnnnacngatcngacacaaccnncattcctgtctcactagtcctccaagganatcattcagaccnaccagantccgtaccaagcacccctnatgaagaancacacctggtattgtgcaacaacagcttncacatgatntcacccctgatttcaacgtgtcttggccaagatganactcttgnacctgacagtctttcactcacngccctctnantgaatgatggctttggtgcttcattattttntccaaaccatacntcaanaatgcagcaccatgcttntccatttgttagggacacgctangtacacgagcgaagtttgaatttnctgcccaagaacaagccgcnagctactattatggagtcccactgcaagtaactatgagttncaacntgcttgntccatgggtnaagacaggta

SEQ ID NO: 103366 - DNA, 411 bp, Triticum aestivum
  unsure (1)..(411): unsure at all n locations
  Clone ID: PAT_TA_103366
ggcacgagccccgcctcccctcaccgcgcgcgatggcggtcacgcgcctcgccgtggccgccgccctctcctccgccccgccctcctcccgccgaggcagggcggccccgtcctcgtgccgccccctccccgccgcctcctgttctcgcgcacccaagtccaaggccctgcgcgccaccgccgcccccgccgacgacgcggtcgacgaggaggcccccgcctcctctcctccgtcagatcctggcaggggggtggagaacctggagatcatcgctncggnccggcagggtacaccgnggncatttacgatgcccgnnncaacctgaaacacgttcgtattngaangctaccaggtnggagggtgatngctggangncaanntgatgatnanaaannggannttgataantt

SEQ ID NO: 103367 - DNA, 426 bp, Triticum aestivum
  unsure (1)..(426): unsure at all n locations
  Clone ID: PAT_TA_103367
ggcacgagcacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgtggttcgcgtccaagcagtccctcacctacctggacggcacgctgnccggtgactttggcttcgaccccttggggctgtccgacccggagggcaccggcgggttcatngagcccaggtggctggctacggcgagatcttcaacggcggacggcgatgatgggcntggngggcatgancgccccngaggccctgngcaangnggccnggngcccccgga

SEQ ID NO: 103368 - DNA, 776 bp, Triticum aestivum
  unsure (1)..(776): unsure at all n locations
  Clone ID: PAT_TA_103368
ggcacgagcccgatcgaacgaccagagaaagagaggcctttttcccgancgcgaccgctagggttcctagtcgccgccggcccgccgccgctactgncggccctccgctgcggcgtgcccagccngccgaagcctccgctgncccgccgccggaacaggagcccagnagcgcctccctctcccgcccagcaacgccgccgcccggagctgcgccggcgaccantccgtaagagattatggagtgtaattnttcanatgtgcaaatgtcacactgcgctgagggttccgagactacaatagagatcaaaatcaagactttggattcccaaacatacaatttgcgcgtgaataaatgtgtgccaatnnctctgctaaangacaaaatagctaccgtaactggagtattgtctgaacaacaacgtctgatttgtcgtgggagagtcttgaaggatgatgaacttctctctgnttatcatgtngaagatggccatacgttgcatcttgttgntagacaaccangccagccanctgcatnaagaaatgcaggaaatgaacttgtgtatcaaattcaactngtngtnatggtcgcacgggtngcantattgtgctttgangcttgtaaatttggaccaggggagtgaattntntacattggccaaaatcttcaaacatgttgaccacccacaattcanggtnggatcaanaccttttgatccaaactttnnaaactatgcatntttttnccaatgangncggggcnaacttgnnnngngcng

SEQ ID NO: 103369 - DNA, 291 bp, Triticum aestivum
  unsure (1)..(291): unsure at all n locations
  Clone ID: PAT_TA_103369
ggcacgagcacacacacacacgccaccaaattcatcaagaaacctggagaggatcatggccggcgtgaacaccagtgtggtcggcctcaagcccgccgcggcggtgccgcagtccgcctntccggcgacggcaaagcgcgtgcaggtcgcccgccaaggaccggcggcggcgcttntnggctggcgggcgtctttccgtnaccggcgcttcgcggtcggcagggaagcgtnttnacgagtacctnagaagagcaagctnaacaaggagctnaacgacaagaagagggcggn

SEQ ID NO: 103370 - DNA, 881 bp, Triticum aestivum
  unsure (1)..(881): unsure at all n locations
  Clone ID: PAT_TA_103370
ggcacgaggaagtatccaaaagatttcaatagatgggatgcacacatgcagcagcttagaggcagctgttttaggacccctgcttttgccaacaaactggtcagcttggattagaaagccatcacctgttgaaggagagacgcacatggctaaactcagtttcgtgggtgaaaagcggtaattgtttggttttgtaaaaaaaaagtcacaagtttgcagaacttaatctgaacctttgactactaccagaaaataatggataggaaaattaccaaacaagctgttgactatttgttccatgagccaccagaaagctcctgcagcacactgcttctagatatcggatgtgtctcaacactgcatgtttgtgtcctcaattctcgaaaccttttttttgtcgtcctcaattcttgaaacagtgccttgtttacttcttttttttgcttggtggtgcttctacgtttttgttttactttaagtgcctcagtgaatgtgtgcaccaaagtttttctttttcttgcagagatcccctaacacagagatttatattgctttcatcacgcagtactaatcatgtgccgtccattttacaactaaatgttggatgcatgtggggtaaccgaacatttggccttttacagatgattgtatcatgagaanacatgcttgcagcttcnttggcatgacataaaaagctgacaatttgcatttggtatatctactctgctgnaaagttgggcttaacttaacatatacaanttggccaaagnntnggngcttttaaaaanaacaangagngcncaatnttttaggacaacntngggaaaaaaaaaannntnangggnnttttttttttttttttttccggntaaanannnggg

SEQ ID NO: 103371 - DNA, 970 bp, Triticum aestivum
  unsure (1)..(970): unsure at all n locations
  Clone ID: PAT_TA_103371
ttttttttttttttttttttttttttttttttaacactaanaatctatttcccattgtacttactcggagaagatacagaaactaccttcaacaactatcaagtataacaagcctccaattactgccaagngcttgaggcanaaaaagagcccccanaacacttgatccaaanaatgtaggatggtaactacaccttgcaggtatcatctggacagaaaatatacatctctgttctccatcaatcaaganaatcanaagcggagccgaatgctntgcgcccacattgccgaacaaacataaacatagttccattaatanattctttcacagcactgcataaccttnttggngccanatgccatnttttgcttaatggggacncanaaacttgaatctcatntatcccanacaaaggaggtgacctaaagcaaaacaccttccttttgaggtcatcccgttcacttgaccttatgtaagagcctctagttatgttcccatccttccaaacatccttcaagaaaaataagactggcctcttgcacatagacttctgaatttccttggngcaaaatcaaattcagttctctggctcatcctattaaaagcgatgtaaagtccgctcggatcgctccaattcaggangggagaanaacactggggtacacttgaacacataacccaaagaaaaggcaaggngtaagcttntggcttttatnataacaaactgggcgctgcaanaancttaaggggttttggttttcatggcctttggnaaaaagctccaagcttttcaganagttcaatcccggattttttgggtccccaaccccccatnggggggntcctggtaaaangggccattgggttaacccccccaatatacccngggcatttgcctntggntttcccccnggggggaaaccttttttccngggaaaaaaggcccccccancccccggnaaanaanan

SEQ ID NO: 103372 - DNA, 388 bp, Triticum aestivum
  unsure (1)..(388): unsure at all n locations
  Clone ID: PAT_TA_103372
ggcacgagcaaagttgagacagatagaggatgcggtaggggaggccgggaagggtgctgctggccgcacggctcgtccatgtggctgctcggcgacgtcgagcgtgtggcggggctggaggagttgggtgctgggcctaccctgtgatgagcttgattcctcgcccgcgaccccgtgttcatgccgtcggtcggaggtcgagcagaccgcttgaacggcgctgctgctgctcgtttggagtgcacgggccgttggcttctttgagaggctctgggacgccggtggcgcangcgccacgggtctcgccgcgatgttcngcagcgggcccggctttngatgtgcaccgacggtcaattnaanggccgcggataggancggngnaaggtna

SEQ ID NO: 103373 - DNA, 269 bp, Triticum aestivum
  unsure (1)..(269): unsure at all n locations
  Clone ID: PAT_TA_103373
ggcacgaggaaaccccccttccnaacacctantnnccgaaccccnanggcgatccatggnggcggcggnttggntccgnngagcngtntcntttntggcgctgcctcgcatgccgtctggactcaccatcatgccagccccttcccccgctcctctccccgaggctcagtccctcgtgctccccggcctcggcgctgccatcgcccccgcgatggaactcatggccgccccaagaagaagatctcaaaatatnagaggggtttgagaaa

SEQ ID NO: 103374 - DNA, 280 bp, Triticum aestivum
  unsure (1)..(280): unsure at all n locations
  Clone ID: PAT_TA_103374
ggcacgagccgagttgcgctgcgccacacttccttccgcacgagccaggcacgttccgcttgcgcgcggcgccggaacgacaaaggggtgccgtgaacgtgatggccgcttcgctggctgcctcgctctccttcccgccgcgcggccacccggcccccttcgtccggagcgccccgttggcgtcgccgcggcgaggcgcgggccgccgcaccctccccgtcccggcgcacgccggcggggacggcggcggcgaggggggcncgganaggatactgtancc

SEQ ID NO: 103375 - DNA, 1058 bp, Triticum aestivum
  unsure (1)..(1058): unsure at all n locations
  Clone ID: PAT_TA_103375
ntgnacgccanctcgaaattaaccctcactaaagggaacaaaagctggagctcgcgcgcctgcaggtcgacactagtggatccaaagattcggcacgaggcaggcttccgccgcgtctcaacacgcttgcggtcttctcctcgccgacgccgaaccccttcggccccaataagcgcgtcgccaggtccaggctcaggcccccgccaatctccatctccatggacccggccctcgtcgacccggcccacctccaggcgctcatgctcgcctgcgcgcactcctgcgccatccgcctctccccgccggaagccgccgcgcggccggagcccgtcgacatccgcaagctccgtaccgccgtggcgcacagcttcctggtcgtgtccgtcttctgcgggaccaggttcttggaggaagacgacggaggggacgatcggcgcttcatgggcctggagctggacctcgggctcgggcggcgtggggagcagcggctcgtcgggttcggacgggccgtctccgacgtggggctcaccgcctccgtccatgacgtcgtggttcatccatcagtgcanaggaaaggaattgggcgcaaaatacttgaaaaaattacaagggtactccatagcagaggtatttatgacatttncgcattatgcacangaaangaaaaggcattttttgaacatgtggattcggngatgatcaatgggtgccacaacaatgatgtacactanaaacttgnacgaaaaagcattctatggatgggtgggaaatttgccaatgatactacacggttcnttttgntgggtattatctgntgcactgaaatgcaactggaaaaaagtnttgtttcaanaagggaatttacccctttaatggaccgnntcatgggcccactttttggttnaggaacactnaanaataanaaattgggaacggnnnaantaactttttangnnggaaaggnttttnannnntnaaancnacanntnnnaaataccngnnnggaaanntnnngntnanaaaaaaantnnnacgggnttnnnnnnaaaaaaaaaaan

SEQ ID NO: 103376 - DNA, 679 bp, Triticum aestivum
  unsure (1)..(679): unsure at all n locations
  Clone ID: PAT_TA_103376
ggcacgagcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctcttcaagaacttnatgaccctgtccaacattcaagatcccacttcatcttgggtatntggggaggcagggttaagggnaaaatcatttncagtgcgnagctttgttttncccaagatgggncattcaacccnantcattantgaagttcccggnagaagcttgtaaangntgggnctannnccngnaaanactctaanccacttcttnant

SEQ ID NO: 103377 - DNA, 601 bp, Triticum aestivum
  unsure (1)..(601): unsure at all n locations
  Clone ID: PAT_TA_103377
ggcacgagctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtcggccgaccccgagaccttngccaagaaccgggagctggaggtcatccactgccgctgggccatgctcggcgcgctcggctgcgtcttccccgagctgctcgcccgcaacggcgttaagntnggcgaggccgtnctggttnaaggcccggcttcccanaatctttcaacgaggggcgggccttnnacttaccctnggnnaaaccccaanccctggtggcnacnccgccaaaagcaattncttnnnccnattctngggnccttgnccaagggnggggtgncttnaatgnggccnncccn
